US012800583B2

(12) United States Patent
Kuhn et al.

(10) Patent No.: US 12,800,583 B2
(45) Date of Patent: Nov. 17, 2026

(54) BACTERIAL BIOMARKER FOR RHEUMATOID ARTHRITIS AND RELATED MATERIALS AND METHODS

(71) Applicant: THE REGENTS OF THE UNIVERSITY OF COLORADO, Denver, CO (US)

(72) Inventors: Kristine Kuhn, Denver, CO (US); V. Michael Holers, Denver, CO (US); Kevin Deane, Denver, CO (US); Kristen Demoruelle, Golden, CO (US); Jill Norris, Denver, CO (US); Meagan Chriswell, Aurora, CO (US); William Robinson, Palo Alto, CA (US)

(73) Assignees: The Regents of the University of Colorado, a body corporate, Denver, CO (US); The Board of Trustees of the Leland Stanford Junior University, Stanford, CA (US)

( * ) Notice: Subject to any disclaimer, the term of this patent is extended or adjusted under 35 U.S.C. 154(b) by 597 days.

(21) Appl. No.: 18/251,915

(22) PCT Filed: Nov. 8, 2021

(86) PCT No.: PCT/US2021/072293

§ 371 (c)(1),
(2) Date: May 5, 2023

(87) PCT Pub. No.: WO2022/099317

PCT Pub. Date: May 12, 2022

(65) Prior Publication Data

US 2024/0011986 A1 Jan. 11, 2024

Related U.S. Application Data

(60) Provisional application No. 63/110,753, filed on Nov. 6, 2020.

(51) Int. Cl.
*G01N 33/569* (2006.01)
*A61K 39/02* (2006.01)
(Continued)

(52) U.S. Cl.
CPC .... *G01N 33/56911* (2013.01); *A61K 39/0208* (2013.01); *A61K 39/40* (2013.01);
(Continued)

(58) Field of Classification Search
CPC ......... G01N 33/56911; G01N 2469/20; G01N 2800/102; A61K 39/0008; A61K 38/1774;
(Continued)

(56) References Cited

U.S. PATENT DOCUMENTS

2013/0078237 A1 3/2013 Delaney et al.
2013/0216547 A1 8/2013 Morton et al.
2022/0160712 A1* 5/2022 Turnbaugh ............. C12Q 1/689

FOREIGN PATENT DOCUMENTS

WO WO-2006119115 A2 * 11/2006 ................ A61P 7/00

OTHER PUBLICATIONS

Ahuja et al. "Structural Analysis of Bacterial ABC Transporter Inhibition by an Antibody Fragment," Structure, Apr. 2017, vol. 23, pp. 713-723.

(Continued)

*Primary Examiner* — Jana A Hines
(74) *Attorney, Agent, or Firm* — Sheridan Ross P.C.

(57) ABSTRACT

Therapeutic and prophylactic therapies for rheumatoid arthritis are provided, as are related pharmaceutical compositions. Methods provide for the early detection of subjects at risk of developing rheumatoid arthritis, thus allowing for early intervention, and include methods of sample preparation.

3 Claims, 25 Drawing Sheets

Specification includes a Sequence Listing.

(51) Int. Cl.
*A61K 39/40* (2006.01)
*C12Q 1/689* (2018.01)

(52) U.S. Cl.
CPC ........ *C12Q 1/689* (2013.01); *C12Q 2600/112* (2013.01); *C12Q 2600/156* (2013.01); *G01N 2469/20* (2013.01); *G01N 2800/102* (2013.01)

(58) Field of Classification Search
CPC ............ A61K 38/2006; A61K 39/0208; A61K 39/40; A61K 45/06; A61K 2039/58; C12Q 1/689; C12Q 2600/112; C12Q 2600/156
See application file for complete search history.

(56) References Cited

OTHER PUBLICATIONS

Chriswell et al. "Clonal IgA and IgG autoantibodies from individuals at risk for rheumatoid arthritis identify and arthritogenic strain of Subdoligranulum," Science Translational Medicine, Oct. 2022, vol. 14, No. 668article eabn5166, 16 pages.
UniProtKB Accession No. R5Y4K6_9FIRM, Amino acid ABC transporter substrate-binding protein PAAT family (TC 3.A.1.3.-), Jul. 24, 2013, 4 pages [retrieved online from: www.uniprot.org/uniprotkb/R5Y4K6/entry].
International Search Report and Written Opinion for International (PCT) Patent Application No. PCT/US21/72293, dated Mar. 10, 2022 13 pages.
Holers et al. "Rheumatoid arthritis and the mucosal origins hypothesis: protection turns to destruction," Nature Reviews Rheumatology, Sep. 2018, vol. 14, No. 9, pp. 542-557.
Jubair et al. "Modulation of Inflammatory Arthritis in Mice by Gut Microbiota Through Mucosal Inflammation and Autoantibody Generation," Arthritis & Rheumatology, 2018, vol. 70, No. 8, pp. 1220-1233.
Kinslow et al. "Elevated IgA Plasmablast Levels in Subjects at Risk of Developing Rheumatoid Arthritis," Arthritis & Rheumatology, Oct. 2016, vol. 68, No. 10, pp. 2372-2383.
Mikuls et al. "Antibody responses to Porphyromonas gingivalis (P. gingivalis) in subjects with rheumatoid arthritis and periodontitis," International Immunopharmacology, Jan. 2009, vol. 9, No. 1, pp. 38-42.
Partial Supplementary Search Report for European Patent Application No. 21890351.8, dated Dec. 20, 2024 14 pages.
International Preliminary Report on Patentability for International (PCT) Patent Application No. PCT/US2021/072293, dated May 19, 2023, 9 pages.

* cited by examiner

| Autoantigen | Isolate 7 Mean ± SD | Isolate 1 Mean ± SD | *P. copri* Mean ± SD | Sterile Media Mean ± SD | p-value |
|---|---|---|---|---|---|
| Fibromodulin 345-364 | 2.03 ± 0.97 | 0.72 ± 0.14 | 1.53 ± 0.49 | 1.14 ± 0.54 | 0.004 |
| HCgp39 7-22 | 1.57 ± 0.46 | 0.83 ± 0.24 | 0.92 ± 0.40 | 1.06 ± 0.51 | 0.01 |
| hFibA 211-230 | 1.72 ± 0.92 | 0.56 ± 0.27 | 1.11 ± 0.33 | 1.22 ± 0.29 | 0.003 |
| hFibA 616-635 | 1.18 ± 0.47 | 0.58 ± 0.46 | 0.42 ± 0.29 | 1.22 ± 0.40 | 0.002 |
| Tenascin-C 122-141 cit2 | 2.29 ± 1.53 | 0.78 ± 0.20 | 0.78 ± 0.47 | 0.86 ± 0.41 | 0.001 |
| a-enolase 122-141 cit | 1.24 ± 0.72 | 0.50 ± 0.15 | 0.56 ± 0.36 | 0.72 ± 0.33 | 0.02 |
| Fibromodulin 103-122 | 1.76 ± 0.93 | 0.64 ± 0.37 | 0.92 ± 0.58 | 1.00 ± 0.35 | 0.01 |
| H2A 79-98 | 2.51 ± 1.71 | 0.97 ± 0.22 | 1.22 ± 0.39 | 1.72 ± 0.50 | 0.01 |
| hFibA 246-260 | 1.68 ± 0.89 | 0.86 ± 0.39 | 0.89 ± 0.29 | 0.69 ± 0.25 | 0.01 |
| cH3 | 1.17 ± 0.55 | 0.58 ± 0.25 | 0.61 ± 0.27 | 0.97 ± 0.37 | 0.047 |

BACTERIAL BIOMARKER FOR RHEUMATOID ARTHRITIS AND RELATED MATERIALS AND METHODS

STATEMENT REGARDING FEDERALLY SPONSORED RESEARCH

This invention was made with government support under Grant No. U01AI101981 awarded by the National Institutes of Health. The government has certain rights in the invention.

SEQUENCE LISTING

The instant application contains a Sequence Listing which has been submitted electronically in ASCII format and is hereby incorporated by reference in its entirety. Said ASCII copy, created on Nov. 5, 2021, is named 517709.45_PCT-_SL.txt and is 6,741,597 bytes in size.

BACKGROUND

Rheumatoid arthritis (RA) is a progressive, systemic autoimmune disease characterized by chronic inflammation of multiple joints with associated symptoms such as fatigue. The inflammation causes joint pain, stiffness, and swelling resulting in loss of joint function due to destruction of bone and cartilage. RA often leads to progressive disability. Patients with RA also have an increased likelihood of developing other systemic complications such as osteoporosis, anemia, cardiovascular disease, and disorders affecting the lungs and skin. The disease shortens the average life expectancy of affected patients by three to seven years. About 0.5-1% of the US adult population is affected by RA, and given the average age of onset is approximately 50, the number of affected individuals is expected to rise. Despite declining rates of disability attributed to RA, about 30% of patients do not achieve a minimally acceptable symptom state.

Early treatment of RA is associated with decreased joint damage and disability. In addition, studies performed in individuals considered to have pre-RA defined as clinical risk for RA but not yet classifiable disease have demonstrated promising results for RA prevention. However, identification of individuals at risk for developing RA is a challenging and inexact process, and which therapeutic approaches to utilize in individuals who do not yet have arthritis is an emerging area of investigation.

Despite advances in therapy for patients with clinically active RA, significant limitations in efficacy and safety remain. New methods are needed for identifying which therapeutic approach to use in an individual, as is an increased number of therapeutic targets and drugs for RA.

SUMMARY

In a first example ("Example 1"), provided herein is a composition including one or more therapeutic agents directed to *Subdoligranulum didolesgii* strain D8.

In another example ("Example 2"), further to Example 1, the one or more therapeutic agents comprise at least one immunotherapeutic agent.

In another example ("Example 3"), further to Example 2, the at least one immunotherapeutic agent is selected from: an antibody against an antigen of *Subdoligranulum didolesgii* strain D8; an antibody fragment against an antigen of *Subdoligranulum didolesgii* strain D8; a vaccine against *Subdoligranulum didolesgii* strain D8; or any combination thereof.

In another example ("Example 4"), further to Example 3, the antibody against an antigen of *Subdoligranulum didolesgii* strain D8 or the antibody fragment against an antigen of comprises a variable region selected from a variable region of: antibody MH1 ($V_H$=SEQ ID NO: 3; $V_L$=SEQ ID NO: 4); MH3 ($V_H$=SEQ ID NO: 7; $V_L$=SEQ ID NO: 8); MH4 ($V_H$=SEQ ID NO: 9; $V_L$=SEQ ID NO: 10); MH5 ($V_H$=SEQ ID NO: 11; $V_L$=SEQ ID NO: 12); MH6 ($V_H$=SEQ ID NO: 13; $V_L$=SEQ ID NO: 14); MH11 ($V_H$=SEQ ID NO: 23; $V_L$=SEQ ID NO: 24); MH12 ($V_H$=SEQ ID NO: 25; $V_L$=SEQ ID NO: 26); MH14 ($V_H$=SEQ ID NO: 29; $V_L$=SEQ ID NO: 30); MH15 ($V_H$=SEQ ID NO: 31; $V_L$=SEQ ID NO: 32); MH16 ($V_H$=SEQ ID NO: 33; $V_L$=SEQ ID NO: 34); MH17 ($V_H$=SEQ ID NO: 35; $V_L$=SEQ ID NO: 36); MH18 ($V_H$=SEQ ID NO: 37; $V_L$=SEQ ID NO: 38); MH20 ($V_H$=SEQ ID NO: 41; $V_L$=SEQ ID NO: 42); MH21 ($V_H$=SEQ ID NO: 43; $V_L$=SEQ ID NO: 44); MH22 ($V_H$=SEQ ID NO: 45; $V_L$=SEQ ID NO: 46); MH23 ($V_H$=SEQ ID NO: 47; $V_L$=SEQ ID NO: 48); MH24 ($V_H$=SEQ ID NO: 49; $V_L$=SEQ ID NO: 50); MH25 ($V_H$=SEQ ID NO: 51; $V_L$=SEQ ID NO: 52); MH27 ($V_H$=SEQ ID NO: 55; $V_L$=SEQ ID NO: 56); MH28 ($V_H$=SEQ ID NO: 57; $V_L$=SEQ ID NO: 58); MH29 ($V_H$=SEQ ID NO: 59; $V_L$=SEQ ID NO: 60); MH30 ($V_H$=SEQ ID NO: 61; $V_L$=SEQ ID NO: 62); MH31 ($V_H$=SEQ ID NO: 63; $V_L$=SEQ ID NO: 64); MH32 ($V_H$=SEQ ID NO: 65; $V_L$=SEQ ID NO: 66); MH33 ($V_H$=SEQ ID NO: 67; $V_L$=SEQ ID NO: 68); MH34 ($V_H$=SEQ ID NO: 69; $V_L$=SEQ ID NO: 70); MH35 ($V_H$=SEQ ID NO: 71; $V_L$=SEQ ID NO: 72); MH38 ($V_H$=SEQ ID NO: 77; $V_L$=SEQ ID NO: 78); MH39 ($V_H$=SEQ ID NO: 79; $V_L$=SEQ ID NO: 80); MH40 ($V_H$=SEQ ID NO: 81; $V_L$=SEQ ID NO: 82); MH42 ($V_H$=SEQ ID NO: 85; $V_L$=SEQ ID NO: 86); MH45 ($V_H$=SEQ ID NO: 91; $V_L$=SEQ ID NO: 92); MH46 ($V_H$=SEQ ID NO: 93; $V_L$=SEQ ID NO: 94); MH48 ($V_H$=SEQ ID NO: 97; $V_L$=SEQ ID NO: 98), MH49 ($V_H$=SEQ ID NO: 99; $V_L$=SEQ ID NO: 100); MH50 ($V_H$=SEQ ID NO: 101; $V_L$=SEQ ID NO: 102); MH51 ($V_H$=SEQ ID NO: 103; $V_L$=SEQ ID NO: 104); MH55 ($V_H$=SEQ ID NO: 111; $V_L$=SEQ ID NO: 112); MH56 ($V_H$=SEQ ID NO: 113; $V_L$=SEQ ID NO: 114); MH57 ($V_H$=SEQ ID NO: 115; $V_L$=SEQ ID NO: 116); MH58 ($V_H$=SEQ ID NO: 117; $V_L$=SEQ ID NO: 118); MH59 ($V_H$=SEQ ID NO: 119; $V_L$=SEQ ID NO: 120); MH60 ($V_H$=SEQ ID NO: 121; $V_L$=SEQ ID NO: 122); MH62 ($V_H$=SEQ ID NO: 125; $V_L$=SEQ ID NO: 126); MH63 ($V_H$=SEQ ID NO: 127; $V_L$=SEQ ID NO: 128); MH64 ($V_H$=SEQ ID NO: 129; $V_L$=SEQ ID NO: 130); MH65 ($V_H$=SEQ ID NO: 131; $V_L$=SEQ ID NO: 132); MH66 ($V_H$=SEQ ID NO: 133; $V_L$=SEQ ID NO: 134); MH67 ($V_H$=SEQ ID NO: 135; $V_L$=SEQ ID NO: 136); MH68 ($V_H$=SEQ ID NO: 137; $V_L$=SEQ ID NO: 138); MH73 ($V_H$=SEQ ID NO: 147; $V_L$=SEQ ID NO: 148); MH74 ($V_H$=SEQ ID NO: 149; $V_L$=SEQ ID NO: 150) MH75 ($V_H$=SEQ ID NO: 151; $V_L$=SEQ ID NO: 152) MH76 ($V_H$=SEQ ID NO: 153; $V_L$=SEQ ID NO: 154); MH80 ($V_H$=SEQ ID NO: 161; $V_L$=SEQ ID NO: 162); MH82 ($V_H$=SEQ ID NO: 165; $V_L$=SEQ ID NO: 166); MH83 ($V_H$=SEQ ID NO: 187; $V_L$=SEQ ID NO: 188); and MH91 ($V_H$=SEQ ID NO: 183; $V_L$=SEQ ID NO: 184).

In another example ("Example 5"), further to Example 3, the antibody against an antigen of *Subdoligranulum didol-*

*esgii* strain D8 or the antibody fragment against an antigen of comprises a variable region selected from a variable region of: antibody MH4 ($V_H$=SEQ ID NO: 9; $V_L$=SEQ ID NO: 10); MH28 ($V_H$=SEQ ID NO: 57; $V_L$=SEQ ID NO: 58); MH58 ($V_H$=SEQ ID NO: 117; $V_L$=SEQ ID NO: 118); and MH91 ($V_H$=SEQ ID NO: 183; $V_L$=SEQ ID NO: 184).

In another example ("Example 6"), further to Example 3, the vaccine against *Subdoligranulum didolesgii* strain D8 comprises: heat-inactivated *Subdoligranulum didolesgii* strain D8; an antigen polypeptide from *Subdoligranulum didolesgii* strain D8; a nucleic acid encoding an antigen polypeptide from *Subdoligranulum didolesgii* strain D8; or any combination thereof.

In another example ("Example 7"), further to Example 1, the one or more therapeutic agents comprise an antibiotic effective against *Subdoligranulum didolesgii* strain D8.

In another example ("Example 8"), further to Example 1, the one or more therapeutic agents comprise a *Subdoligranulum didolesgii* strain D8 indole inhibitor.

In another example ("Example 9"), further to Example 8, the *Subdoligranulum didolesgii* strain D8 indole inhibitor is selected from: a protein; a peptide; an antibody; a peptidomimetic; a ribozyme; a small molecule; a vector; an antisense nucleic acid; and a CRISPR-based inhibitor.

In another example ("Example 10"), provided herein is a method that includes: reducing a population of *Subdoligranulum didolesgii* strain D8 in the subject; eliminating a population of *Subdoligranulum didolesgii* strain D8 in the subject; inhibiting an indole-containing compound produced by a population of *Subdoligranulum didolesgii* strain D8 in the subject; inhibiting an indole-related pathway in a population of *Subdoligranulum didolesgii* strain D8; inhibiting or preventing an immune response by the subject to *Subdoligranulum didolesgii* strain D8; eliciting a protective immune response in the subject against *Subdoligranulum didolesgii* strain D8; or any combination thereof.

In another example ("Example 11"), further to Example 10, the method includes administering to the subject an effective amount of a composition of any one of Examples 1-9.

In another example ("Example 12"), further to Example 10, the method includes detecting the presence of *Subdoligranulum didolesgii* strain D8 or one or more antibodies against *Subdoligranulum didolesgii* strain D8 in the subject.

In another example ("Example 13"), further to Example 12, the presence of *Subdoligranulum didolesgii* strain D8 is detected by PCR analysis or whole genome sequencing.

In another example ("Example 14"), further to Example 12, the presence of *Subdoligranulum didolesgii* strain D8 is detected by identifying bacteria comprising a genome represented by SEQ ID NO: 2.

In another example ("Example 15"), further to Example 12, the method includes increasing relative abundance of bacteria from Lachnospiraceae, Ruminococcaceae, or both Lachnospiraceae and Ruminococcaceae in a fraction of a sample from the subject.

In another example ("Example 16"), further to Example 15, the sample is a fecal sample, rectal swab, or an intestinal tissue biopsy.

In another example ("Example 17"), further to Example 15 or Example 16, increasing the relative abundance of the bacteria comprises contacting the sample from the subject with one or more monoclonal antibodies or one or more antibody fragments, the one or more monoclonal antibodies or one or more antibody fragments including a variable region selected from: antibody MH1 ($V_H$=SEQ ID NO: 3; $V_L$=SEQ ID NO: 4); MH3 ($V_H$=SEQ ID NO: 7; $V_L$=SEQ ID NO: 8); MH4 ($V_H$=SEQ ID NO: 9; $V_L$=SEQ ID NO: 10); MH5 ($V_H$=SEQ ID NO: 11; $V_L$=SEQ ID NO: 12); MH6 ($V_H$=SEQ ID NO: 13; $V_L$=SEQ ID NO: 14); MH11 ($V_H$=SEQ ID NO: 23; $V_L$=SEQ ID NO: 24); MH12 ($V_H$=SEQ ID NO: 25; $V_L$=SEQ ID NO: 26); MH14 ($V_H$=SEQ ID NO: 29; $V_L$=SEQ ID NO: 30); MH15 ($V_H$=SEQ ID NO: 31; $V_L$=SEQ ID NO: 32); MH16 ($V_H$=SEQ ID NO: 33; $V_L$=SEQ ID NO: 34); MH17 ($V_H$=SEQ ID NO: 35; $V_L$=SEQ ID NO: 36); MH18 ($V_H$=SEQ ID NO: 37; $V_L$=SEQ ID NO: 38); MH20 ($V_H$=SEQ ID NO: 41; $V_L$=SEQ ID NO: 42); MH21 ($V_H$=SEQ ID NO: 43; $V_L$=SEQ ID NO: 44); MH22 ($V_H$=SEQ ID NO: 45; $V_L$=SEQ ID NO: 46); MH23 ($V_H$=SEQ ID NO: 47; $V_L$=SEQ ID NO: 48); MH24 ($V_H$=SEQ ID NO: 49; $V_L$=SEQ ID NO: 50); MH25 ($V_H$=SEQ ID NO: 51; $V_L$=SEQ ID NO: 52); MH27 ($V_H$=SEQ ID NO: 55; $V_L$=SEQ ID NO: 56); MH28 ($V_H$=SEQ ID NO: 57; $V_L$=SEQ ID NO: 58); MH29 ($V_H$=SEQ ID NO: 59; $V_L$=SEQ ID NO: 60); MH30 ($V_H$=SEQ ID NO: 61; $V_L$=SEQ ID NO: 62); MH31 ($V_H$=SEQ ID NO: 63; $V_L$=SEQ ID NO: 64); MH32 ($V_H$=SEQ ID NO: 65; $V_L$=SEQ ID NO: 66); MH33 ($V_H$=SEQ ID NO: 67; $V_L$=SEQ ID NO: 68); MH34 ($V_H$=SEQ ID NO: 69; $V_L$=SEQ ID NO: 70); MH35 ($V_H$=SEQ ID NO: 71; $V_L$=SEQ ID NO: 72); MH38 ($V_H$=SEQ ID NO: 77; $V_L$=SEQ ID NO: 78); MH39 ($V_H$=SEQ ID NO: 79; $V_L$=SEQ ID NO: 80); MH40 ($V_H$=SEQ ID NO: 81; $V_L$=SEQ ID NO: 82); MH42 ($V_H$=SEQ ID NO: 85; $V_L$=SEQ ID NO: 86); MH45 ($V_H$=SEQ ID NO: 91; $V_L$=SEQ ID NO: 92); MH46 ($V_H$=SEQ ID NO: 93; $V_L$=SEQ ID NO: 94); MH48 ($V_H$=SEQ ID NO: 97; $V_L$=SEQ ID NO: 98), MH49 ($V_H$=SEQ ID NO: 99; $V_L$=SEQ ID NO: 100); MH50 ($V_H$=SEQ ID NO: 101; $V_L$=SEQ ID NO: 102); MH51 ($V_H$=SEQ ID NO: 103; $V_L$=SEQ ID NO: 104); MH55 ($V_H$=SEQ ID NO: 111; $V_L$=SEQ ID NO: 112); MH56 ($V_H$=SEQ ID NO: 113; $V_L$=SEQ ID NO: 114); MH57 ($V_H$=SEQ ID NO: 115; $V_L$=SEQ ID NO: 116); MH58 ($V_H$=SEQ ID NO: 117; $V_L$=SEQ ID NO: 118); MH59 ($V_H$=SEQ ID NO: 119; $V_L$=SEQ ID NO: 120); MH60 ($V_H$=SEQ ID NO: 121; $V_L$=SEQ ID NO: 122); MH62 ($V_H$=SEQ ID NO: 125; $V_L$=SEQ ID NO: 126); MH63 ($V_H$=SEQ ID NO: 127; $V_L$=SEQ ID NO: 128); MH64 ($V_H$=SEQ ID NO: 129; $V_L$=SEQ ID NO: 130); MH65 ($V_H$=SEQ ID NO: 131; $V_L$=SEQ ID NO: 132); MH66 ($V_H$=SEQ ID NO: 133; $V_L$=SEQ ID NO: 134); MH67 ($V_H$=SEQ ID NO: 135; $V_L$=SEQ ID NO: 136); MH68 ($V_H$=SEQ ID NO: 137; $V_L$=SEQ ID NO: 138); MH73 ($V_H$=SEQ ID NO: 147; $V_L$=SEQ ID NO: 148); MH74 ($V_H$=SEQ ID NO: 149; $V_L$=SEQ ID NO: 150) MH75 ($V_H$=SEQ ID NO: 151; $V_L$=SEQ ID NO: 152) MH76 ($V_H$=SEQ ID NO: 153; $V_L$=SEQ ID NO: 154); MH80 ($V_H$=SEQ ID NO: 161; $V_L$=SEQ ID NO: 162); MH82 ($V_H$=SEQ ID NO: 165; $V_L$=SEQ ID NO: 166); MH83 ($V_H$=SEQ ID NO: 187; $V_L$=SEQ ID NO: 188); and MH91 ($V_H$=SEQ ID NO: 183; $V_L$=SEQ ID NO: 184).

In another example ("Example 18"), further to Example 17, the method includes releasing bacteria from the one or more monoclonal antibodies or one or more antibody fragments.

In another example ("Example 19"), further to Example 17 or Example 18, the method includes detecting presence or absence of *Subdoligranulum didolesgii* strain D8 following the contacting step.

In another example ("Example 20"), further to Example 19, detecting the presence or absence of *Subdoligranulum*

*didolesgii* strain D8 includes a polymerase chain reaction (PCR) step or a multiple displacement amplification (MDA) step.

In another example ("Example 21"), further to Example 12, the presence of one or more antibodies against *Subdoligranulum didolesgii* strain D8 is detected by contacting a serum sample or a fecal sample from the subject with isolated *Subdoligranulum didolesgii* strain D8, or one or more isolated antigens thereof, and detecting binding of one or more serum or fecal antibodies to the isolated *Subdoligranulum didolesgii* strain D8 or the one or more isolated antigens thereof.

In another example ("Example 22"), further to any one of Examples 10-21, the method includes administering to the subject one or more compounds selected from: a non-steroidal anti-inflammatory drug; a corticosteroid; a disease-modifying antirheumatic drug; and a biologic response modifier.

In another example ("Example 23"), further to Example 22, a) the non-steroidal anti-inflammatory drug is selected from: ibuprofen; naproxen sodium; celecoxib; diclofenac; fenoprofen; flurbiprofen; indomethacin; ketorolac; mefenamic acid; meloxicam; oxaprozin; piroxicam; and sulindac; the corticosteroid is selected from: prednisone; bethamethasone; and prednisolone; triamcinolone; methylprednisolone; and dexamethasone; b) the disease-modifying antirheumatic drug is selected from: methotrexate; leflunomide; hydroxychloroquine; and sulfasalazine; and c) the biologic response modifier is selected from: abatacept and biosimilars thereof; adalimumab and biosimilars thereof; anakinra and biosimilars thereof; baricitinib; certolizumab and biosimilars thereof; etanercept and biosimilars thereof; golimumab and biosimilars thereof; infliximab and biosimilars thereof; rituximab and biosimilars thereof; sarilumab and biosimilars thereof; tocilizumab and biosimilars thereof; and tofacitinib.

In another example ("Example 24"), provided herein is a method for preparing a sample fraction for detection of *Subdoligranulum didolesgii* strain D8 in a subject, including contacting a sample from the subject selected from a fecal sample, a fecal swab, or an intestinal biopsy with one or more monoclonal antibodies or one or more antibody fragments including a variable region selected from: antibody MH1 ($V_H$=SEQ ID NO: 3; $V_L$=SEQ ID NO: 4); MH3 ($V_H$=SEQ ID NO: 7; $V_L$=SEQ ID NO: 8); MH4 ($V_H$=SEQ ID NO: 9; $V_L$=SEQ ID NO: 10); MH5 ($V_H$=SEQ ID NO: 11; $V_L$=SEQ ID NO: 12); MH6 ($V_H$=SEQ ID NO: 13; $V_L$=SEQ ID NO: 14); MH11 ($V_H$=SEQ ID NO: 23; $V_L$=SEQ ID NO: 24); MH12 ($V_H$=SEQ ID NO: 25; $V_L$=SEQ ID NO: 26); MH14 ($V_H$=SEQ ID NO: 29; $V_L$=SEQ ID NO: 30); MH15 ($V_H$=SEQ ID NO: 31; $V_L$=SEQ ID NO: 32); MH16 ($V_H$=SEQ ID NO: 33; $V_L$=SEQ ID NO: 34); MH17 ($V_H$=SEQ ID NO: 35; $V_L$=SEQ ID NO: 36); MH18 ($V_H$=SEQ ID NO: 37; $V_L$=SEQ ID NO: 38); MH20 ($V_H$=SEQ ID NO: 41; $V_L$=SEQ ID NO: 42); MH21 ($V_H$=SEQ ID NO: 43; $V_L$=SEQ ID NO: 44); MH22 ($V_H$=SEQ ID NO: 45; $V_L$=SEQ ID NO: 46); MH23 ($V_H$=SEQ ID NO: 47; $V_L$=SEQ ID NO: 48); MH24 ($V_H$=SEQ ID NO: 49; $V_L$=SEQ ID NO: 50); MH25 ($V_H$=SEQ ID NO: 51; $V_L$=SEQ ID NO: 52); MH27 ($V_H$=SEQ ID NO: 55; $V_L$=SEQ ID NO: 56); MH28 ($V_H$=SEQ ID NO: 57; $V_L$=SEQ ID NO: 58); MH29 ($V_H$=SEQ ID NO: 59; $V_L$=SEQ ID NO: 60); MH30 ($V_H$=SEQ ID NO: 61; $V_L$=SEQ ID NO: 62); MH31 ($V_H$=SEQ ID NO: 63; $V_L$=SEQ ID NO: 64); MH32 ($V_H$=SEQ ID NO: 65; $V_L$=SEQ ID NO: 66); MH33 ($V_H$=SEQ ID NO: 67; $V_L$=SEQ ID NO: 68); MH34 ($V_H$=SEQ ID NO: 69; $V_L$=SEQ ID NO: 70); MH35 ($V_H$=SEQ ID NO: 71; $V_L$=SEQ ID NO: 72); MH38 ($V_H$=SEQ ID NO: 77; $V_L$=SEQ ID NO: 78); MH39 ($V_H$=SEQ ID NO: 79; $V_L$=SEQ ID NO: 80); MH40 ($V_H$=SEQ ID NO: 81; $V_L$=SEQ ID NO: 82); MH42 ($V_H$=SEQ ID NO: 85; $V_L$=SEQ ID NO: 86); MH45 ($V_H$=SEQ ID NO: 91; $V_L$=SEQ ID NO: 92); MH46 ($V_H$=SEQ ID NO: 93; $V_L$=SEQ ID NO: 94); MH48 ($V_H$=SEQ ID NO: 97; $V_L$=SEQ ID NO: 98), MH49 ($V_H$=SEQ ID NO: 99; $V_L$=SEQ ID NO: 100); MH50 ($V_H$=SEQ ID NO: 101; $V_L$=SEQ ID NO: 102); MH51 ($V_H$=SEQ ID NO: 103; $V_L$=SEQ ID NO: 104); MH55 ($V_H$=SEQ ID NO: 111; $V_L$=SEQ ID NO: 112); MH56 ($V_H$=SEQ ID NO: 113; $V_L$=SEQ ID NO: 114); MH57 ($V_H$=SEQ ID NO: 115; $V_L$=SEQ ID NO: 116); MH58 ($V_H$=SEQ ID NO: 117; $V_L$=SEQ ID NO: 118); MH59 ($V_H$=SEQ ID NO: 119; $V_L$=SEQ ID NO: 120); MH60 ($V_H$=SEQ ID NO: 121; $V_L$=SEQ ID NO: 122); MH62 ($V_H$=SEQ ID NO: 125; $V_L$=SEQ ID NO: 126); MH63 ($V_H$=SEQ ID NO: 127; $V_L$=SEQ ID NO: 128); MH64 ($V_H$=SEQ ID NO: 129; $V_L$=SEQ ID NO: 130); MH65 ($V_H$=SEQ ID NO: 131; $V_L$=SEQ ID NO: 132); MH66 ($V_H$=SEQ ID NO: 133; $V_L$=SEQ ID NO: 134); MH67 ($V_H$=SEQ ID NO: 135; $V_L$=SEQ ID NO: 136); MH68 ($V_H$=SEQ ID NO: 137; $V_L$=SEQ ID NO: 138); MH73 ($V_H$=SEQ ID NO: 147; $V_L$=SEQ ID NO: 148); MH74 ($V_H$=SEQ ID NO: 149; $V_L$=SEQ ID NO: 150) MH75 ($V_H$=SEQ ID NO: 151; $V_L$=SEQ ID NO: 152) MH76 ($V_H$=SEQ ID NO: 153; $V_L$=SEQ ID NO: 154); MH80 ($V_H$=SEQ ID NO: 161; $V_L$=SEQ ID NO: 162); MH82 ($V_H$=SEQ ID NO: 165; $V_L$=SEQ ID NO: 166); MH83 ($V_H$=SEQ ID NO: 187; $V_L$=SEQ ID NO: 188); and MH91 ($V_H$=SEQ ID NO: 183; $V_L$=SEQ ID NO: 184), wherein after contacting the sample with the one or more monoclonal antibodies or the one or more antibody fragments, the resulting fraction comprises an increased relative abundance of bacteria from Lachnospiraceae, Ruminococcaceae, or both Lachnospiraceae and Ruminococcaceae in the sample fraction.

In another example ("Example 25"), further to Example 24, the method includes releasing the bacteria in the sample fraction from the one or more monoclonal antibodies or one or more antibody fragments.

In another example ("Example 26"), further to Example 24 or Example 25, the contacting comprises use of an immunoprecipitation assay.

In another example ("Example 27"), provided herein is a method that includes contacting a serum sample or a fecal sample from a subject with isolated *Subdoligranulum didolesgii* strain D8, or one or more isolated antigens thereof, and detecting binding of one or more antibodies in the serum sample or the fecal sample to the isolated *Subdoligranulum didolesgii* strain D8 or the one or more isolated antigens thereof.

In another example ("Example 28"), provided herein is a method that includes detecting in the subject the presence or absence of *Subdoligranulum didolesgii* strain D8, or detecting in the subject the presence or absence of one or more antibodies against *Subdoligranulum didolesgii* strain D8 or any antigen thereof, wherein detecting the presence of *Subdoligranulum didolesgii* strain D8 or detecting the presence of one or more antibodies against *Subdoligranulum didolesgii* strain D8 or an antigen thereof identifies the subject as being at risk of developing rheumatoid arthritis (RA), as having preclinical RA, or as having RA.

In another example ("Example 29"), further to Example, detecting in the subject the presence or absence of *Subdoligranulum didolesgii* strain D8 includes performing the method of Example 21.

In another example ("Example 30"), further to Example 29, the contacting comprises use of an immunoprecipitation assay.

In another example ("Example 31"), further to any one of Examples 28-30, the presence or absence of *Subdoligranulum didolesgii* strain D8 is detected by PCR analysis or whole genome sequencing.

In another example ("Example 32"), further to Example 29, detecting the presence or absence of one or more antibodies against *Subdoligranulum didolesgii* strain D8 or any antigen thereof comprises contacting a serum sample or a fecal sample from the subject with isolated *Subdoligranulum didolesgii* strain D8, or one or more isolated antigens thereof, and detecting binding of one or more serum antibodies to the isolated *Subdoligranulum didolesgii* strain D8 or the one or more isolated antigens thereof.

In another example ("Example 33"), further to any one of Examples 28-32, the method includes reducing a population of *Subdoligranulum didolesgii* strain D8 in the subject; eliminating a population of *Subdoligranulum didolesgii* strain D8 in the subject; inhibiting an indole-containing compound produced by a population of *Subdoligranulum didolesgii* strain D8 in the subject; inhibiting an indole-related pathway in a population of *Subdoligranulum didolesgii* strain D8; inhibiting or preventing an immune response by the subject to *Subdoligranulum didolesgii* strain D8; eliciting a protective immune response in the subject against *Subdoligranulum didolesgii* strain D8; or any combination thereof.

In another example ("Example 34"), further to Example 33, the method includes administering to the subject an effective amount of a composition of any one of Examples 1-9.

In another example ("Example 35"), further to Example 33 or Example 34, the method includes administering to the subject one or more compounds selected from: a non-steroidal inflammatory drug; a corticosteroid; a disease-modifying antirheumatic drug; and a biologic response modifier.

In another example ("Example 36"), further to Example 35: a) the non-steroidal inflammatory drug is selected from: ibuprofen; naproxen sodium; celecoxib; diclofenac; fenoprofen; flurbiprofen; indomethacin; ketorolac; mefenamic acid; meloxicam; oxaprozin; piroxicam; and sulindac; b) the corticosteroid is selected from: prednisone; bethamethasone; and prednisolone; triamcinolone; methylprednisolone; and dexamethasone; c) the disease-modifying antirheumatic drug is selected from: methotrexate; leflunomide; hydroxychloroquine; and sulfasalazine; and d) the biologic response modifier is selected from: abatacept; adalimumab; anakinra; baricitinib; certolizumab; etanercept; golimumab; infliximab; rituximab; sarilumab; tocilizumab; and tofacitinib.

In a further example ("Example 37"), provided herein is a method of reducing or eliminating a population of *Subdoligranulum didolesgii* strain D8 or a variant of *Subdoligranulum didolesgii* strain D8 in a subject; comprising administering to the subject an effective amount of an antisense nucleic acid or a CRISPR-based inhibitor targeted to a nucleic acid sequence of *Subdoligranulum didolesgii* strain D8 or a variant of *Subdoligranulum didolesgii* strain D8, and/or administering to the subject an effective amount of a composition of any one of Examples 1-9.

In another example ("Example 38"), further to Example 37, the *Subdoligranulum didolesgii* strain D8 comprises SEQ ID NO: 2 or a variant thereof.

In another example ("Example 39"), further to Example 38, the variant comprise at least about 70% identity to SEQ ID NO: 2 and has a least one property selected from: causes local intestinal isolated lymphoid follicles (ILF) formation, stimulates T cell activation, induces development of RA-related autoantibodies, and induces joint swelling.

In another example ("Example 40"), further to Example 37, Example 38, or Example 39, the subject is at risk of (or susceptible to) developing RA, has preclinical RA, has early RA, or has RA.

In another example ("Example 41"), further to Example 37, Example 38, Example 39, or Example 40, the method prevents rheumatoid arthritis in the subject, delays onset of rheumatoid arthritis in the subject, treats rheumatoid arthritis in the subject, or ameliorates at least one symptom of rheumatoid arthritis in the subject.

In another example ("Example 42"), further to Example 37, Example 38, Example 39, Example 40, or Example 41, T the relative abundance of bacteria from Lachnospiraceae, Ruminococcaceae, or both Lachnospiraceae and Ruminococcaceae is decreased in a fraction of a sample from the subject after the administration step.

In another example ("Example 43"), further to Example 442, the sample is a fecal sample, rectal swab, or an intestinal tissue biopsy.

In another example ("Example 44"), further to Example 37, Example 38, Example 39, Example 40, Example 41, Example 42, or Example 43, the method includes administering to the subject one or more compounds selected from: a non-steroidal anti-inflammatory drug; a corticosteroid; a disease-modifying antirheumatic drug; and a biologic response modifier.

In another example ("Example 45"), further to Example 44, a) the non-steroidal anti-inflammatory drug is selected from: ibuprofen; naproxen sodium; celecoxib; diclofenac; fenoprofen; flurbiprofen; indomethacin; ketorolac; mefenamic acid; meloxicam; oxaprozin; piroxicam; and sulindac; the corticosteroid is selected from: prednisone; bethamethasone; and prednisolone; triamcinolone; methylprednisolone; and dexamethasone; b) the disease-modifying antirheumatic drug is selected from: methotrexate; leflunomide; hydroxychloroquine; and sulfasalazine; and c) the biologic response modifier is selected from: abatacept and biosimilars thereof; adalimumab and biosimilars thereof; anakinra and biosimilars thereof; baricitinib; certolizumab and biosimilars thereof; etanercept and biosimilars thereof; golimumab and biosimilars thereof; infliximab and biosimilars thereof; rituximab and biosimilars thereof; sarilumab and biosimilars thereof; tocilizumab and biosimilars thereof; and tofacitinib.

BRIEF DESCRIPTION OF THE DRAWINGS

FIG. 9A depicts data of the presence of FITC-Dextran, to assess intestinal barrier permeability. FITC-Dextran was orally gavaged into mice monocolonized with isolate 1 (n=5), isolate 7 (n=5), *P. copri* (n=6) or sterile media (n=6) 4 hours before euthanasia. At the time of euthanasia, serum was collected and tested for the presence of FITC-Dextran. *=P<0.05.

FIG. 9B depicts intestinal histology data for the mice of the four treatment groups of FIG. 9A. The data are the number and size of isolated lymphoid follicles (ILFs) per colon.

FIG. 9C depicts data for fecal IgA quantity in mice monocolonized with isolate 1 (n=12 gavaged), isolate 7 (n=11 gavaged), *P. copri* (n=6 gavaged) or sterile media (n=12 gavaged). Feces were collected at day 14 after gavage and total IgA concentration was assessed ELISA. *=P<0.05. ****=P<0.0001.

FIG. 9D (MS-5E) depicts data from flow cytometric analysis of Th17 and Treg populations in monocolonized mice. The ratio of Th17/Treg cells is displayed. Mesenteric Lymph Nodes (MLNs) and Peyer's Patches (PPs) were collected from monocolonized mice at 14 days post-gavage (n=7 isolate 7 gavaged, n=7 isolate 1 gavaged, n=7 *P. copri* gavaged, n=8 sterile media gavaged). These tissues were processed and stained for flow cytometric analysis of Th17 and Treg populations. *=P<0.05.

FIG. 10A depicts data for joint swelling. Joint swelling and ankylosis was assessed every seven days subsequently out to 35 days after gavage. (n=5 isotype control dosed, n=4 B cell depleted, n=5 T cell depleted, n=5 neutrophil depleted). FIG. 10B depicts intestinal histology data for the mice. Colonic tissue was collected from isotype control dosed mice as well as T cell and B cell depleted mice at day 35 after bacterial gavage. This tissue was fixed and sectioned, and isolated lymphoid follicles were counted as well as the aggregate size of the ILFs in sum (shown in square microns). FIGS. 10C-10F depict total IgG and IgA in serum and feces from the mice. Serum and feces were collected from the mice at days 14 and 35 post-bacterial gavage. Total IgG and IgA were determined for each of these samples (shown in ng/mL). FIG. 10G depicts data for healthy germ-free DBA/1 mice injected with serium from mice monocolonized with isolate 1, isolate 7, and *P. copri* 35 days after bacterial gavage. Serum was injected IP and the mice were monitored for the development of joint swelling and ankylosis every seven days for 28 days after serum transfer. (n=6 isolate 7 serum transfer, n=6 isolate 1 serum transfer, n=7 *P. copri* serum transfer).

DETAILED DESCRIPTION

Figure 1A:
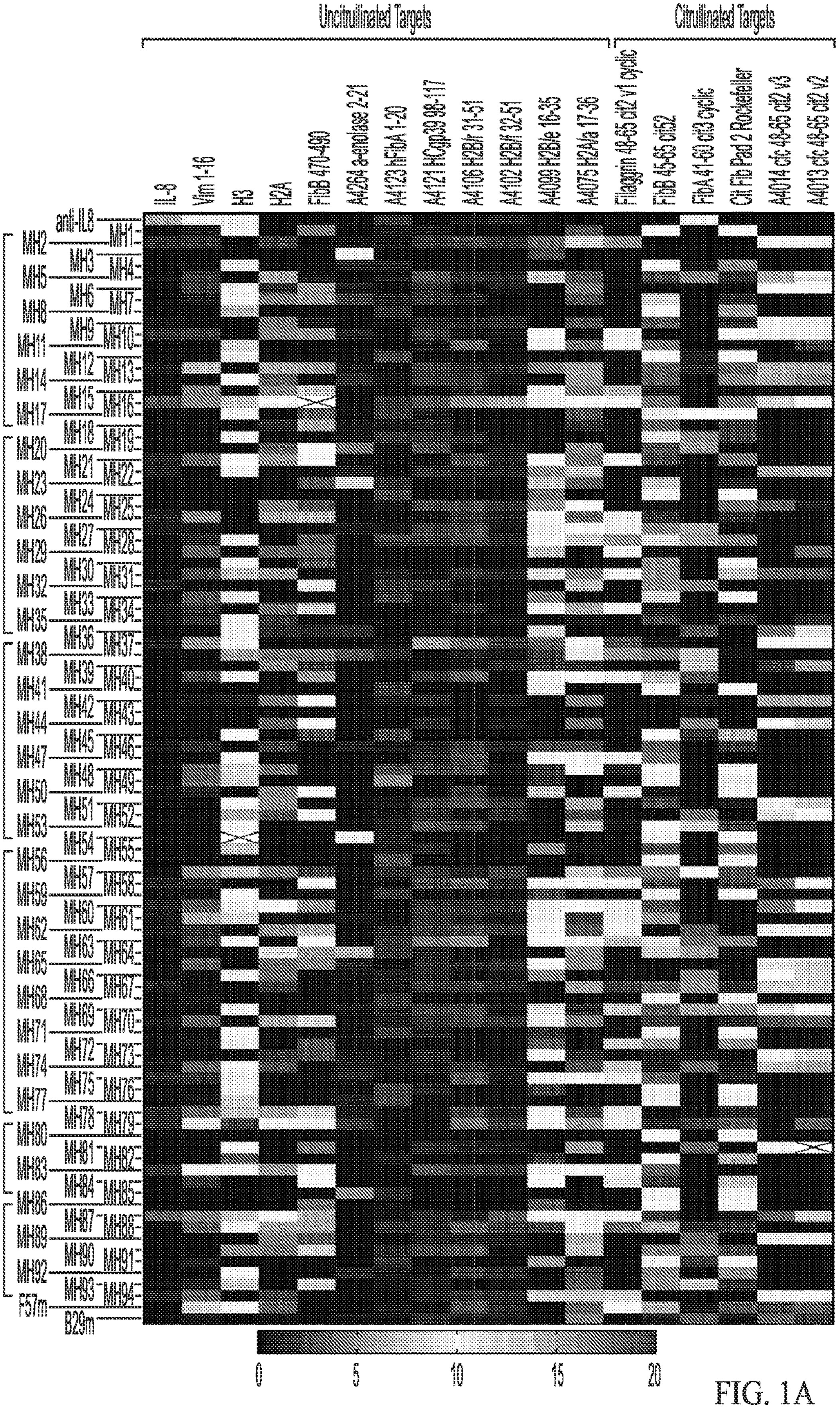
FIG. 1A is a heatmap representing relative reactivity between plasmablast monoclonal antibodies (mAbs) derived from 4 asymptomatic pre-RA subjects (Subject 1: M1-M18; Subject 2 M19-M36; Subject 3: M37-54; and Subject 4: M55-M54 with antigens and 2 early (<1 year of disease) RA patients (Subject 5: M79-M85 and Subject 6L M86-M94) in a synovial antigen array representing a range of citrullinated and non-citrullinated antigens relevant to RA.

In the following sections, various compositions and methods are described in order to detail various embodiments. Practicing the various embodiments does not require the employment of all of the specific details outlined herein, but rather concentrations, times, and other specific details may be modified. In some cases, well known methods or components have not been included in the description.

As used herein, "treat" in reference to a condition means: (1) to ameliorate or prevent the condition or one or more of the biological manifestations of the condition, (2) to interfere with (a) one or more points in the biological cascade that leads to or is responsible for the condition or (b) one or more of the biological manifestations of the condition, (3) to alleviate one or more of the symptoms or effects associated with the condition, and/or (4) to slow the progression of the condition or one or more of the biological manifestations of the condition. The terms "prevent," "preventing," and the like are to be understood to refer to a method of blocking the onset of disease and/or its attendant symptoms. "Prevent" also encompasses delaying or otherwise impeding the onset of a disease and/or its attendant symptoms.

As used herein, "therapeutically effective amount" in reference to an agent means an amount of the agent sufficient to treat the subject's condition but low enough to avoid serious side effects at a reasonable benefit/risk ratio within the scope of sound medical judgment. The safe and effective amount of an agent will vary with the particular agent chosen (e.g. consider the potency, efficacy, and half-life of the compound); the route of administration chosen; the condition being treated; the severity of the condition being treated; the age, size, weight, and physical condition of the patient being treated; the medical history of the patient to be treated; the duration of the treatment; the nature of concurrent therapy; the desired therapeutic effect; and like factors, but can nevertheless be determined by the skilled artisan.

For any compound, agent, or composition, the therapeutically effective amount can be estimated initially either in cell culture assays or in animal models, usually rats, mice, rabbits, dogs, or pigs. The animal model may also be used to determine the appropriate concentration range and route of administration. Such information can then be used to determine useful doses and routes for administration in humans. Therapeutic/prophylactic efficacy and toxicity may be determined by standard pharmaceutical procedures in cell cultures or experimental animals, e.g., $ED_{50}$ (the dose therapeutically effective in 50% of the population) and $LD_{50}$ (the dose lethal to 50% of the population). The dose ratio between toxic and therapeutic effects is the therapeutic index, and it can be expressed as the ratio, $LD_{50}/ED_{50}$. Pharmaceutical compositions that exhibit large therapeutic indices are preferred. The dosage may vary within this range depending upon the dosage form employed, sensitivity of the patient, and the route of administration.

A "subject" means any individual having, having symptoms of, or at risk for developing rheumatoid arthritis (RA). A subject may be human or non-human, and may include, for example, animals or species used as "model systems" for research purposes, such as a mouse model. In certain embodiments, the subject is a human patient having RA or at risk of developing RA. As used herein, "at-risk of developing RA" is defined as an individual that is a first-degree relative (FDR) of a patient with RA or an individual with preclinical RA. "Preclinical RA" refers to the presence of positive levels of circulating RA-specific autoantibodies, i.e., serum anti-cyclic citrullinated peptide positive (CCP+) and/or RF positive (RF+). In an embodiment, circulating RA-specific autoantibodies refers to serum anti-CCP3/anti-CCP3.1 positive and/or >2 RF isotypes.

As used herein, "having RA" is defined as an individual diagnosed using American College of Rheumatology (ACR) 1987 and/or ACR European League Against Rheumatism (EULAR) 2010 classification criteria; such criteria include exhibiting clinical symptoms and clinical signs and biomarkers of rheumatoid arthritis. As used herein, "early RA" refers to an individual within one year of RA diagnosis.

As used herein, a "pharmaceutical composition" is a formulation containing a compound or agent in a form suitable for administration to a subject. Compounds and agents disclosed herein each can be formulated individually or in any combination into one or more pharmaceutical compositions. Accordingly, one or more administration routes can be properly elected based on the dosage form of each pharmaceutical composition. Alternatively, a compound or agent disclosed herein and one or more other therapeutic agents described herein can be formulated as one pharmaceutical composition.

Described herein is a novel species and strain of *Subdoligranulum* identified as being sufficient to cause rheumatoid arthritis (RA) or to worsen its disease course and effects on involved tissues. Embodiments of the present disclosure provide methods for identifying subjects at risk of developing RA, having pre-RA, or having RA. Such methods generally include detecting the presence or absence of the disclosed *Subdoligranulum* sp. nov. in the subject, with the presence of the *Subdoligranulum* sp. nov. being linked to a risk of developing RA or indicative of pre-RA or RA in the subject. Also provided are methods for preventing development and/or progression of RA in a subject, or treating RA in a subject. Such methods generally involve administering to a subject in need of treatment one or more therapeutic agents directed to (i.e., capable of reducing the amount or activity) the *Subdoligranulum* sp. nov.

Using multiple independent methods, the inventors have identified a specific bacterial strain in the family Ruminococcus genus *Subdoligranulum* that is targeted by autoantibodies of individuals at risk for RA and those with classified RA. The *Subdoligranulum* sp. nov. is demonstrated to be sufficient to cause the development of arthritis in mice. The strain, designated *Subdoligranulum didolesgii* strain D8, is being maintained in the lab of inventor Kuhn and will be deposited with a depository in accordance with the Budapest Treaty. The instant disclosure will be updated with details of the deposit once available. A genome contig of *S. didolesgii* strain D8 is provided in SEQ ID NO: 2.

With regard to *S. didolesgii* strain D8, the term "polynucleotide" as used in accordance with the present disclosure relates to a polynucleotide comprising a nucleic acid sequence of SEQ ID NO: 2 or a variant of SEQ ID NO: 2. The polynucleotide variants, preferably, comprise a nucleic acid sequence characterized in that the sequence can be derived from SEQ ID NO: 2 by at least one nucleotide substitution, addition and/or deletion. Variants also encompass polynucleotides comprising a nucleic acid sequence which is capable of hybridizing to the aforementioned specific nucleic acid sequences, preferably, under stringent hybridization conditions. These stringent conditions are known to the skilled worker and can be found in Current Protocols in Molecular Biology, John Wiley & Sons, N. Y. (1989), 6.3.1-6.3.6. A preferred example for stringent hybridization conditions are hybridization conditions in 6×sodium chloride/sodium citrate (=SSC) at approximately 45° C., followed by one or more wash steps in 0.2×SSC, 0.1% SDS at 50 to 65° C. The skilled worker knows that these hybridization conditions differ depending on the type of nucleic acid and, for example when organic solvents are present, with regard to the temperature and concentration of the buffer.

The percent identity values are generally calculated over the entire nucleic acid sequence region. In embodiments, the percent identity values are calculated over the entire nucleic acid sequence region. A series of programs based on a variety of algorithms is available to the skilled worker for comparing different sequences.

A mathematical algorithm useful for comparing two sequences is the algorithm of Karlin and Altschul (1990, Proc. Natl. Acad. Sci. USA 87:2264-2268), modified as in Karlin and Altschul (1993, Proc. Natl. Acad. Sci. USA 90:5873-5877). This algorithm is incorporated into the NBLAST and XBLAST programs of Altschul, et al. (1990, J. Mol. Biol. 215:403-410), and can be accessed, for example at the National Center for Biotechnology Information (NCBI) world wide web site having the universal resource locator "www.ncbi.nlm.nih.gov/BLAST/". BLAST nucleotide searches can be performed with the NBLAST program (designated "blastn" at the NCBI web site), using the following parameters: gap penalty=5; gap extension penalty=2; mismatch penalty=3; match reward=1; expectation value 10.0; and word size=11 to obtain nucleotide sequences having sequence identity to a nucleic acid described herein.

In another embodiment, the percent identity between two nucleotide sequences is determined using the needle program in the EMBOSS software package (*EMBOSS: The European Molecular Biology Open Software Suite*, Rice, P., Longden, I., and Bleasby, A, Trends in Genetics 16(6), 276-277, 2000), using the EDNAFULL scoring matrix and a gap opening penalty of 16, 14, 12, 10, 8, 6, or 4 and a gap extension penalty of 0.5, 1, 2, 3, 4, 5, or 6.

To obtain gapped alignments for comparison purposes, Gapped BLAST can be utilized as described in Altschul et al. (1997, Nucleic Acids Res. 25:3389-3402). Alternatively, PSI-Blast or PHI-Blast can be used to perform an iterated search which detects distant relationships between molecules (Id.) and relationships between molecules which share a common pattern. When utilizing BLAST, Gapped BLAST, PSI-Blast, and PHI-Blast programs, the default parameters of the respective programs (e.g., XBLAST and NBLAST) can be used. See www.ncbi.nlm.nih.gov.

The percent identity between two sequences can be determined using techniques similar to those described above, with or without allowing gaps. In calculating percent identity, typically exact matches are counted.

Variants encompassed by the present disclosure include polynucleotides comprising nucleic acid sequences which are at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.1%, at least 99.2%, at least 99.3. at least 99.4%, at least 99.5%, at least 99.6%, at least 99.7%, at least 99.75%, at least 99.8%, at least 99.85%, or at least 99.9% identical to SEQ ID NO: 2. Variants encompassed by the present disclosure have up to about 25,000 nucleotide differences (e.g., substitutions, additions and/or deletions) compared to SEQ ID NO: 2 Variants encompassed by the present disclosure have up to 20,000 nucleotide differences compared to SEQ ID NO: 2, up to 10,000, up to 7500, up to 7525, up to 7000, up to 6500, up to 6000, up to 5500, up to 5000, up to 4500, up to 4000, up to 3500, up to 3000, up to 2500, up to 2000, up to 1500, or up to 1000 nucleotide differences compared to SEQ ID NO: 2.

Variants encompassed include *Subdoligranulum didolesgii* strains comprising nucleic acid sequences which are at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.1%, at least 99.2%, at least 99.3. at least 99.4%, at least 99.5%, at least 99.6%, at least 99.7%, at least 99.75%, at least 99.8%, at least 99.85%, or at least 99.9% identical to SEQ ID NO: 2. Variants encompassed include *Subdoligranulum didolesgii* strains comprising nucleic acid sequences which have up to about 25,000 nucleotide differences compared to SEQ ID NO: 2 Variants encompassed by the present disclosure have up to 20,000 nucleotide differences compared to SEQ ID NO: 2, up to 10,000, up to 7500, up to 7525, up to 7000, up to 6500, up to 6000, up to 5500, up to 5000, up to 4500, up to 4000, up to 3500, up to 3000, up to 2500, up to 2000, up to 1500, or up to 1000 nucleotide differences compared to SEQ ID NO: 2. Variants encompassed by the present disclosure have up to 20,000 nucleotide substitutions compared to SEQ ID NO: 2, up to 10,000, up to 7500, up to 7525, up to 7000, up to 6500, up to 6000, up to 5500, up to 5000, up to 4500, up to 4000, up to 3500, up to 3000, up to 2500, up to 2000, up to 1500, or up to 1000 nucleotide substitutions compared to SEQ ID NO: 2. In certain embodiments, a variant strain comprises at least one target antigen as described herein. In certain embodiments, a variant strain comprises at least one target antigen as described herein. In certain embodiments, a variant strain comprises at least one property selected from causes local intestinal isolated lymphoid follicles (ILF) formation, stimulates T cell activation, induces development of RA-related autoantibodies, and induces joint swelling.

Compositions including one or more therapeutic agents directed to *S. didolesgii* strain D8 or a variant thereof are provided. Agents directed to *S. didolesgii* strain D8 are capable of reducing the amount of the bacteria in a subject and/or are capable of reducing the activity (i.e., mechanism of pathogenicity) of *S. didolesgii* strain D8. The one or more therapeutic agents can be, for example, immunotherapeutic agents, antibiotics, or metabolic inhibitors.

Immunotherapeutic agents directed to *S. didolesgii* strain D8 include antibodies against an antigen of *S. didolesgii* strain D8, antibody fragments against an antigen of *S. didolesgii* strain D8, a vaccine against *S. didolesgii* strain D8, and combinations thereof. Antibodies capable of binding *S. didolesgii* strain D8 are provided, as are vaccines capable of eliciting an immune response against *S. didolesgii* strain D8.

Methods for reducing or eliminating a population of *S. didolesgii* strain D8 in a subject, inhibiting or preventing an immune response by the subject to *S. didolesgii* strain D8, and eliciting a protective immune response in the subject against *S. didolesgii* strain D8 are provided. Such methods include administering to a subject an effective amount of a composition described herein. These methods are useful for preventing RA, delaying onset of RA, treating RA, or ameliorating a symptom or biomarker of RA in a subject in need thereof. In addition to administering an effective amount of a compound described herein, the methods can further include detecting the presence or absence of *S. didolesgii* strain D8 in the subject. The methods can also further include administering to the subject a traditional RA therapeutic, such as non-steroidal inflammatory drugs, corticosteroids, disease-modifying antirheumatic drugs, and biologic response modifiers.

Also provided are methods for preparing a sample fraction that allows for detection of *S. didolesgii* strain D8, or a variant thereof, in a biological sample, as well as methods for detecting *S. didolesgii* strain D8 in a biological sample and for detecting one or more antibodies against *S. didolesgii* strain D8 in a biological sample.

In some embodiments, the presence of *S. didolesgii* strain D8, or a variant thereof, in a subject, or presence of antibodies against *S. didolesgii* strain D8 in subject, identifies the subject as being at risk of developing rheumatoid arthritis, such as having preclinical RA, or as having RA.

Antibodies

Antibodies, and fragments thereof, capable of binding to *S. didolesgii* strain D8 or one or more antigens thereof are provided. In some embodiments, the antibodies or fragments thereof inhibit the activity of *S. didolesgii* strain D8. In other embodiments, the antibodies or fragments thereof induce an immune response against *S. didolesgii* strain D8 in a subject.

Antibodies capable of binding to *S. didolesgii* strain D8 encompass, inter alia, antibodies that bind to an antigen of interest on *S. didolesgii* strain D8, and are able to bind the antigen present on Western blots, in solution in enzyme-linked immunoassays, in fluorescence activated cells sorting (FACS) assays, in magnetic-activated cell sorting (MACS) assays, and in immunofluorescence microscopy of a cell transiently transfected with a nucleic acid encoding at least a portion of the antigenic protein, for example.

The antibodies or antibody fragments include a variable region capable of binding to a cell surface antigen of *S. didolesgii* strain D8. The variable region can be selected from the variable regions of, for example: antibody MH1 ($V_H$=SEQ ID NO: 3; $V_L$=SEQ ID NO: 4); MH3 ($V_H$=SEQ ID NO: 7; $V_L$=SEQ ID NO: 8); MH4 ($V_H$=SEQ ID NO: 9; $V_L$=SEQ ID NO: 10); MH5 ($V_H$=SEQ ID NO: 11; $V_L$=SEQ ID NO: 12); MH6 ($V_H$=SEQ ID NO: 13; $V_L$=SEQ ID NO: 14); MH11 ($V_H$=SEQ ID NO: 23; $V_L$=SEQ ID NO: 24); MH12 ($V_H$=SEQ ID NO: 25; $V_L$=SEQ ID NO: 26); MH14 ($V_H$=SEQ ID NO: 29; $V_L$=SEQ ID NO: 30); MH15 ($V_H$=SEQ ID NO: 31; $V_L$=SEQ ID NO: 32); MH16 ($V_H$=SEQ ID NO: 33; $V_L$=SEQ ID NO: 34); MH17 ($V_H$=SEQ ID NO: 35; $V_L$=SEQ ID NO: 36); MH18 ($V_H$=SEQ ID NO: 37; $V_L$=SEQ ID NO: 38); MH20 ($V_H$=SEQ ID NO: 41; $V_L$=SEQ ID NO: 42); MH21 ($V_H$=SEQ ID NO: 43; $V_L$=SEQ ID NO: 44); MH22 ($V_H$=SEQ ID NO: 45; $V_L$=SEQ ID NO: 46); MH23 ($V_H$=SEQ ID NO: 47; $V_L$=SEQ ID NO: 48); MH24 ($V_H$=SEQ ID NO: 49; $V_L$=SEQ ID NO: 50); MH25 ($V_H$=SEQ ID NO: 51; $V_L$=SEQ ID NO: 52); MH27 ($V_H$=SEQ ID NO: 55; $V_L$=SEQ ID NO: 56); MH28 ($V_H$=SEQ ID NO: 57; $V_L$=SEQ ID NO: 58); MH29 ($V_H$=SEQ ID NO: 59; $V_L$=SEQ ID NO: 60); MH30 ($V_H$=SEQ ID NO: 61; $V_L$=SEQ ID NO: 62); MH31 ($V_H$=SEQ ID NO: 63; $V_L$=SEQ ID NO: 64); MH32 ($V_H$=SEQ ID NO: 65; $V_L$=SEQ ID NO: 66); MH33 ($V_H$=SEQ ID NO: 67; $V_L$=SEQ ID NO: 68); MH34 ($V_H$=SEQ ID NO: 69; $V_L$=SEQ ID NO: 70); MH35 ($V_H$=SEQ ID NO: 71; $V_L$=SEQ ID NO: 72); MH38 ($V_H$=SEQ ID NO: 77; $V_L$=SEQ ID NO: 78); MH39 ($V_H$=SEQ ID NO: 79; $V_L$=SEQ ID NO: 80); MH40 ($V_H$=SEQ ID NO: 81; $V_L$=SEQ ID NO: 82); MH42 ($V_H$=SEQ ID NO: 85; $V_L$=SEQ ID NO: 86); MH45 ($V_H$=SEQ ID NO: 91; $V_L$=SEQ ID NO: 92); MH46 ($V_H$=SEQ ID NO: 93; $V_L$=SEQ ID NO: 94); MH48 ($V_H$=SEQ ID NO: 97; $V_L$=SEQ ID NO: 98), MH49 ($V_H$=SEQ ID NO: 99; $V_L$=SEQ ID NO: 100); MH50 ($V_H$=SEQ ID NO: 101; $V_L$=SEQ ID NO: 102); MH51 ($V_H$=SEQ ID NO: 103; $V_L$=SEQ ID NO: 104); MH55 ($V_H$=SEQ ID NO: 111; $V_L$=SEQ ID NO: 112); MH56 ($V_H$=SEQ ID NO: 113; $V_L$=SEQ ID NO: 114); MH57 ($V_H$=SEQ ID NO: 115; $V_L$=SEQ ID NO: 116); MH58 ($V_H$=SEQ ID NO: 117; $V_L$=SEQ ID NO: 118); MH59 ($V_H$=SEQ ID NO: 119; $V_L$=SEQ ID NO: 120); MH60 ($V_H$=SEQ ID NO: 121; $V_L$=SEQ ID NO: 122); MH62 ($V_H$=SEQ ID NO: 125; $V_L$=SEQ ID NO: 126); MH63 ($V_H$=SEQ ID NO: 127; $V_L$=SEQ ID NO: 128); MH64 ($V_H$=SEQ ID NO: 129; $V_L$=SEQ ID NO: 130); MH65 ($V_H$=SEQ ID NO: 131; $V_L$=SEQ ID NO: 132); MH66 ($V_H$=SEQ ID NO: 133; $V_L$=SEQ ID NO: 134); MH67 ($V_H$=SEQ ID NO: 135; $V_L$=SEQ ID NO: 136); MH68 ($V_H$=SEQ ID NO: 137; $V_L$=SEQ ID NO: 138); MH73 ($V_H$=SEQ ID NO: 147; $V_L$=SEQ ID NO: 148); MH74 ($V_H$=SEQ ID NO: 149; $V_L$=SEQ ID NO: 150) MH75 ($V_H$=SEQ ID NO: 151; $V_L$=SEQ ID NO: 152) MH76 ($V_H$=SEQ ID NO: 153; $V_L$=SEQ ID NO: 154); MH80 ($V_H$=SEQ ID NO: 161; $V_L$=SEQ ID NO: 162); MH82 ($V_H$=SEQ ID NO: 165; $V_L$=SEQ ID NO: 166); MH83 ($V_H$=SEQ ID NO: 187; $V_L$=SEQ ID NO: 188); and MH91 ($V_H$=SEQ ID NO: 183; $V_L$=SEQ ID NO: 184).

In certain embodiments, the variable region is be selected from the variable regions of: antibody MH4 ($V_H$=SEQ ID NO: 9; $V_L$=SEQ ID NO: 10); MH28 ($V_H$=SEQ ID NO: 57; $V_L$=SEQ ID NO: 58); MH58 ($V_H$=SEQ ID NO: 117; $V_L$=SEQ ID NO: 118); and MH91 ($V_H$=SEQ ID NO: 183; $V_L$=SEQ ID NO: 184).

The target antigen can be any *S. didolesgii* strain D8 cell surface antigen or intracellular antigen which becomes accessible to recognition on the cell surface during the bacterial life and death cycles. In some embodiments, the target antigen is one of: amino acid ABC transporter substrate-binding protein, PAAT family (Protein ID: R5Y4K6_9FIRM); elongation factor Tu (Protein ID:

R5YCH3_9FIRM); dTDP-glucose 4,6-dehydratase (Protein ID: R6DWD2_9FIRM); FG-GAP repeat domain-containing protein (plasmid) (Protein ID: A7B574_RUMGV); GTPases—translation elongation factors, partial (Protein ID: WP_009866873.1); putative DNA-binding protein (Protein ID: R5QFF1_9FIRM); short-chain dehydrogenase/reductase SDR (Protein ID: D4M4P2_9FIRM); transposase (Protein ID: R7CQ18_9FIRM); 3-phosphoshikimate 1-carboxyvinyltransferase (protein ID: R6U1K9_9CLOT); ABC transporter, substrate-binding protein, family 5 domain protein (Protein ID: A0A171JU57); MFS transporter (Protein ID: R5YDJ5_9FIRM); IgG-binding protein A (586027 M); and 4-hydroxybenzoate octaprenyltransferase (Protein ID: Q3SLJ4).

Use of a single antibody recognizing a single antigenic epitope is contemplated, as is the use of at least one antibody, where the antibodies can be directed to the same or different antigenic protein epitopes on one or more antigens.

Monoclonal antibodies incorporating the disclosed variable regions can be prepared using well-known preparation procedures, such as those disclosed, for example, in Harlow et al. (1988, In: Antibodies, A Laboratory Manual, Cold Spring Harbor, N.Y.) and in Tuszynski et al. (1988, Blood, 72:109-115). Quantities of the desired peptide may also be synthesized using chemical synthesis technology. Antibodies and fragments thereof described herein may be humanized using the methods described in, for example, Wright et al., and in the references cited therein, and in Gu et al. (1997, Thrombosis and Hematocyst 77:755-759), and other methods of humanizing antibodies known in the art.

An "antibody" (Ab) shall include, without limitation, an immunoglobulin which binds specifically to an antigen and comprises at least two heavy (H) chains and two light (L) chains interconnected by disulfide bonds, or an antigen-binding portion thereof. Each H chain comprises a heavy chain variable region (abbreviated herein as $V_H$) and a heavy chain constant region. The heavy chain constant region comprises three constant domains, $C_{H1}$, $C_{H2}$ and $C_{H3}$. Each light chain comprises a light chain variable region (abbreviated herein as $V_L$) and a light chain constant region. The light chain constant region comprises one constant domain, $C_L$. The $V_H$ and $V_L$ regions can be further subdivided into regions of hypervariability, termed complementarity determining regions (CDRs), interspersed with regions that are more conserved, termed framework regions (FR). Each $V_H$ and $V_L$ comprises three CDRs and four FRs, arranged from amino-terminus to carboxy-terminus in the following order: FR1, CDR1, FR2, CDR2, FR3, CDR3, FR4. The variable regions of the heavy and light chains contain a binding domain that interacts with an antigen.

An "antigen binding portion" of an Ab (also called an "antigen-binding fragment") or antigen binding portion thereof refers to one or more sequences of an Ab (full length or fragment of the full length antibody) that retain the ability to bind specifically to the antigen bound by the whole Ab. Examples of an antigen-binding fragment include Fab, $F(ab')_2$, scFv (single-chain variable fragment), Fab', dsFv, sc(Fv)2, and scFv-Fc.

Single chain antibodies (scFv) or Fv fragments and include the disclosed variable regions are also provided, with or without an interconnecting linker.

Functional equivalents of the antibodies of the described herein are also contemplated, and include fragments of antibodies that have the same, or substantially the same, binding characteristics to those of the describe variable regions. The antibody fragments contain all six complementarity determining regions (CDRs) of the variable regions, although fragments containing fewer than all of such regions, such as three, four or five complementarity determining regions, may also functional. The functional equivalents are members of the IgG immunoglobulin class and subclasses thereof, but may be or may combine with any one of the following immunoglobulin classes: IgM, IgA, IgD, or IgE, and subclasses thereof. Heavy chains of various subclasses, such as the IgG subclasses, are responsible for different effector functions and thus, by choosing the desired heavy chain constant region, hybrid antibodies with desired effector function are produced. Exemplary constant regions are gamma 1 (IgG1), gamma 2 (IgG2), gamma 3 (IgG3), and gamma 4 (IgG4). The light chain constant region can be of the kappa or lambda type.

Immunoglobulins can be monovalent, divalent or polyvalent. Monovalent immunoglobulins are dimers (HL) formed of a hybrid heavy chain associated through disulfide bridges with a hybrid light chain. Divalent immunoglobulins are tetramers (H.sub.2L.sub.2) formed of two dimers associated through at least one disulfide bridge.

Vaccines

As described herein, the term "vaccine" (also referred to as an immunogenic composition) refers to a substance or composition that induces an immune response upon inoculation into a subject. In certain embodiments, the vaccine induces an adaptive immune response. The vaccine can be used to induce a protective immune response against *S. didolesgii* strain D8, resulting in the depletion of *S. didolesgii* strain D8 and treating or preventing RA in a subject.

Vaccines of the disclosure induce an immune response to one or more *S. didolesgii* strain D8 antigens. The vaccine can include, for example, an antigen (e.g., a peptide or polypeptide), a nucleic acid encoding an antigen (e.g., an antigen expression vector), or a cell expressing or presenting an antigen or cellular component (e.g., a heat-inactivated cell of *S. didolesgii* strain D8, or a manufactured antigen presenting cell). The vaccine can encode all or part of any peptide target antigen described herein, or an immunologically functional equivalent thereof. In certain embodiments, the vaccine includes an additional immunostimulatory agent or nucleic acids encoding such an agent. Additional immunostimulatory agents include but are not limited to an additional antigen, an immunomodulator, an antigen presenting cell or an adjuvant.

Vaccines can further include additional components such as, for example, a lipid or liposome, or one or more adjuvants. A vaccine described herein and its various components can be prepared and/or administered by the methods described herein, or as would be known to those of skill in the art in light of the present disclosure.

A peptide vaccine can include, but is not limited to, a peptide mixed with adjuvant substances and a peptide which is introduced together with an APC. The most common cells used for the latter type of vaccine are bone marrow and peripheral blood derived dendritic cells, as these cells express costimulatory molecules that help activation of T cells. WO00/06723 discloses a cellular vaccine composition which includes an APC presenting tumor associated antigen peptides. Presenting the peptide can be effected by loading the APC with a polynucleotide (e.g., DNA, RNA) encoding the peptide or loading the APC with the peptide itself.

The vaccine can include one or more peptides, polypeptides, or fragments thereof, or nucleic acid molecules (e.g., DNA or RNA) encoding one or more peptides, polypeptides or fragments thereof, of *S. didolesgii* strain D8. Peptides or polypeptides of *S. didolesgii* strain D8 that may be used include, but are not limited to: amino acid ABC transporter substrate-binding protein, PAAT family (Protein ID: R5Y4K6_9FIRM); elongation factor Tu (Protein ID: R5YCH3_9FIRM); dTDP-glucose 4,6-dehydratase (Protein ID: R6DWD2_9FIRM); FG-GAP repeat domain-containing protein (plasmid) (Protein ID: A7B574_RUMGV); GTPases—translation elongation factors, partial (Protein ID: WP_009866873.1); putative DNA-binding protein (Protein ID: R5QFF1_9FIRM); short-chain dehydrogenase/reductase SDR (Protein ID: D4M4P2_9FIRM); transposase (Protein ID: R7CQ18_9FIRM); 3-phosphoshikimate 1-carboxyvinyltransferase (protein ID: R6U1K9_9CLOT); ABC transporter, substrate-binding protein, family 5 domain protein (Protein ID: A0A171JU57); MFS transporter (Protein ID: R5YDJ5_9FIRM); IgG-binding protein A (586027 M); and 4-hydroxybenzoate octaprenyltransferase (Protein ID: Q3SLJ4).

When a certain peptide or combination of peptides induce an anti-*S. didolesgii* strain D8 immune response upon inoculation into a subject, the peptide or combination of peptides are decided to have anti-*S. didolesgii* strain D8 immunity-inducing effect. The induction of the anti-*S. didolesgii* strain D8 immunity by a peptide or combination of peptides can be detected by observing in vivo or in vitro the response of the immune system in the host against the peptide.

The vaccine can include an inactivated or killed *S. didolesgii* strain D8 bacterium. Inactivated/killed generally refers to infectious agents (e.g., bacteria, viruses, other microorganisms or agents) that are not capable of reproducing or causing disease (i.e., avirulent). Inactivated bacterial preparations may be called bacterins. The inactivated/killed agents are able to stimulate an immune response when administered to a subject, in the context of a vaccine composition, for example. In contrast to inactivated vaccines, live vaccines and live attenuated vaccines, for example, are able to replicate and generally do so once they are administered to a subject.

The vaccine can include substantially less than all of a bacterium (i.e., a subunit vaccine. For example, subunit vaccines may contain single or a few recombinant protein antigens from a bacterium. Inactivated or killed vaccines generally include more of a bacterium, for example, than does a subunit vaccine.

Agents for inclusion in an inactivated or killed vaccine may be grown, purified or semi-purified, inactivated, and then formulated into a vaccine composition. Bacteria may be grown on cell free, serum-free, protein-free, synthetic medium and the like, using commonly known methods for growth of pure bacterial cultures. Often, bacteria are grown in liquid cultures. The bacteria may be purified, semi-purified, and/or concentrated. For example, bacteria grown in liquid culture may be subject to relatively low-speed centrifugation, the culture medium decanted, and the bacterial pellet re-suspended in buffer.

The bacteria may be killed or inactivated using a variety of methods. In one example, the bacteria may be treated with various chemicals for various periods of time to render the agents incapable of replication, but still retaining at least some ability to stimulate an immune response (i.e., immunogenicity) when administered to a subject.

An anti-*S. didolesgii* strain D8 response can be induced by administering a vaccine described herein, and the induction of an anti-*S. didolesgii* strain D8 response enables treatment and prevention of RA in a subject.

Antibiotics

Antibiotics capable of diminishing or eliminating a population of *S. didolesgii* strain D8 in a subject are provided. In some embodiments, the antibiotic is non-absorbable or poorly absorbable, resulting in the antibiotic to exert its effects primarily within the gastrointestinal tract. Non-absorbable and poorly absorbable antibiotics include but are not limited to norfloxacin, rifaximin, gentamicin, vancomycin, nystatin, neomycin, colistin, and kanamycin.

Antibiotics directed to *S. didolesgii* strain D8 can reduce the amount or activity of *S. didolesgii* strain D8 in a subject. Dosages for appropriate antibiotics can be determined by those skilled in the art, and will generally be comparable to standard dosages for each given antibiotic. In some embodiments, a compound or treatment method may include a single antibiotic, or a combination of two or more antibiotics.

*S. didolesgii* Strain D8 Inhibitors

In various embodiments, provided herein are inhibitors of *S. didolesgii* strain D8 activity. *S. didolesgii* strain D8 inhibitors can include, for example, a protein, a peptide, a peptidomimetic, an antibody, a ribozyme, a small molecule chemical compound, a nucleic acid molecule, a vector, an antisense nucleic acid molecule, a CRISPR-associated enzyme or guide RNA, and pre-biotics. In certain embodiments, these agents reduce the activity of *S. didolesgii* strain D8 in a subject.

The agents provided include inhibitors of *S. didolesgii* strain D8 proteins and/or genes, where the inhibitor reduces *S. didolesgii* strain D8 activity involved in inducing an inflammatory response in the host tissue of a subject. An inhibitor encompasses any chemical compound that decreases the amount or activity of *S. didolesgii* strain D8 associated with an inflammatory response.

In some embodiments, the *S. didolesgii* strain D8 inhibitor inhibits production of an indole by, for example, blocking or otherwise modifying an indole-related pathway. As used herein, the term "indole inhibitor" refers to inhibitors capable of inhibiting production of an indole by any means, including blocking or otherwise modifying an indole-related pathway, as well as inhibitors capable of blocking the function or activity of an indole-containing compound. "Indole-related pathway" refers to any of the pathways involved in producing an indole-containing compound or utilizes an indole-containing compound as an intermediary.

In some embodiments, the inhibitor can be a small molecule inhibitor. Small molecule inhibitors include tryptophanase inhibitors. Tryptophanase inhibitors include, for example, S-phenylbenzoquinone-L-tryptophan, alpha-amino-2-(9,10-anthraquinone)-propanoic acid, L-tryptophane-ethylester, N-acetyl-L-tryptophan.

In some embodiments, the inhibitor can be a nucleic acid inhibitor. The nucleic acid inhibitor can be an antisense molecule or aptamer which inhibits one or more *S. didolesgii* strain D8 proteins or genes, such as one or more components of an indole-related pathway. In some embodiments, the nucleic acid comprises a promoter/regulatory sequence such that the promoter/regulatory sequence is capable of directing expression of the nucleic acid or increasing or decreasing stability of the nucleic acid. Thus, also contemplated herein are expression vectors and methods for the introduction of exogenous DNA into cells with concomitant expression of the exogenous DNA in the cells such as those described, for example, in Sambrook et al. (2012, Molecular Cloning: A Laboratory Manual, Cold Spring Harbor Laboratory, New York), and in Ausubel et al. (1997, Current Protocols in Molecular Biology, John Wiley & Sons, New York).

siRNA can be used to inhibit one or more *S. didolesgii* strain D8 proteins or genes.

Vectors including an siRNA or antisense polynucleotide are provided. The vectors can encode a short hairpin RNA (shRNA) inhibitor directed against a target mRNA, thereby decreasing expression of the target. The encoded shRNA can be expressed by a cell, and then processed into siRNA (e.g., the cells can possess native enzymes (e.g., dicer) that cleave the shRNA to form siRNA).

The siRNA, shRNA, or antisense polynucleotide can be cloned into a number of types of vectors. For expression of the siRNA or antisense polynucleotide, at least one module in each promoter functions to position the start site for RNA synthesis.

Expression vectors to be introduced into a cell can also include a selectable marker gene or a reporter gene, or both, to facilitate identification and selection of expressing cells. Therefore, also provided are vectors including a nucleotide sequence contemplated herein. The choice of the vector will depend on the host cell in which it is to be subsequently introduced. In a particular embodiment, the vector is an expression vector. Suitable host cells include a wide variety of prokaryotic and eukaryotic host cells. In specific embodiments, the expression vector is selected from the group consisting of a viral vector, a bacterial vector and a mammalian cell vector. Prokaryote- and/or eukaryote-vector based systems can be employed for use with the present invention to produce polynucleotides, or their cognate polypeptides. Many such systems are commercially and widely available.

Antisense molecules and their use for inhibiting RNA molecules are well known. Antisense nucleic acids are DNA or RNA molecules that are complementary to at least a portion of a specific target mRNA molecule (Weintraub, 1990, Scientific American 262:40). In the cell, antisense nucleic acids hybridize to the corresponding mRNA, forming a double-stranded molecule thereby inhibiting the translation of genes.

Certain embodiments provide for inhibition of one or more genes of *S. didolesgii* strain D8 through use of a genome editing system. A series of programmable nuclease-based genome editing technologies have developed (see, for example, Hsu et al., Cell 157, Jun. 5, 2014 1262-1278), including, but not limited to, meganucleases, zinc finger nucleases (ZFNs), transcription activator-like effector-based nucleases (TALENs) and CRISPR-Cas systems (see e.g. Platt et al., Cell 159(2), 440-455 (2014); Shalem et al., Science 3 84-87 (2014); and Le Cong et al., Science 339, 819 (2013)) or alternative CRISPR systems. Genome editing systems have a wide variety of utilities including modifying (e.g., deleting, inserting, translocating, inactivating, activating, repressing, altering methylation, transferring specific moieties) a target polynucleotide in a multiplicity of cell types.

Certain embodiments provide a CRISPR-Cas system, where a guide RNA (gRNA) targeted to a target nucleic acid sequence, and a CRISPR-associated (Cas) peptide form a complex to induce mutations within the targeted nucleic acid sequence. A CRISPR complex contemplated herein provides an effective means for modifying a target nucleic acid sequence, such as that of a *S. didolesgii* strain D8 gene involved in an indole-related pathway. In some embodiments, the CRISPR-Cas is delivered via a phage that infect *S. didolesgii* strain D8 (see, for example, Fage et al., Current Opinion in Biotechnology, April 2021, 68:174-180, and Lam et al., bioRxiv 2020.07.09.193847; doi: //doi.org/10.1101/2020.07.09.193847). This technology can be adapted to reduce a population of *S. didolesgii* strain D8 in a subject or eliminate a population of *S. didolesgii* strain D8 in a subject.

In some embodiments, provided herein is a Cas peptide or Cas-derived peptide and a gRNA targeted to a *S. didolesgii* strain D8 gene, coding sequence, or regulatory sequence. In one embodiment, a nucleic acid molecule encoding a Cas peptide or Cas-derived peptide is provided. In one embodiment, the nucleic acid molecule encoding a gRNA targeted to an *Enterococcus* sp. or host gene, coding sequence, or regulatory sequence.

The target polynucleotide can be a DNA molecule. DNA molecules include, but are not limited to, genomic DNA molecules, extrachromosomal DNA molecules, conjugative plasmids and exogenous DNA molecules. In one embodiment, the target polynucleotide is an RNA molecule.

Inhibitors also include isolated peptide inhibitors that inhibit one or more *S. didolesgii* strain D8 proteins or genes.

Treatment Methods

Methods are provided that reduce a population of *S. didolesgii* strain D8 in a subject, eliminate a population of *S. didolesgii* strain D8 in a subject, inhibit an indole-containing compound produced by *S. didolesgii* strain D8, inhibit an indole-related pathway in *S. didolesgii* strain D8, inhibit or prevent an immune response by a subject to *S. didolesgii* strain D8; elicit a protective immune response in a subjected against infection by *S. didolesgii* strain D8, or any combination thereof. Such methods can be useful in, for example, preventing rheumatoid arthritis in subject, delaying onset of rheumatoid arthritis in a subject, treating rheumatoid arthritis in a subject, or ameliorating at least one symptom of rheumatoid arthritis in a subject.

The methods can be executed by administering to a subject an effective amount of a composition described herein.

The therapeutic agents and compositions described herein can be administered prophylactically or therapeutically to subjects at risk of (or susceptible to) developing RA, those presenting with preclinical RA, or those subjects diagnosed with RA. Novel methods for identifying such subjects are provided herein, and include detection of *S. didolesgii* strain D8 or antibodies against *S. didolesgii* strain D8 in a subject. In some embodiments, the treatment methods described can be applied to subjects identified as being at risk of developing RA, those having preclinical RA, and those having RA using standard clinical methods. Prophylactic administration occurs prior to the manifestation of overt clinical symptoms of RA, such that RA is prevented or alternatively delayed in its progression. Prevention can occur at primary, secondary and tertiary prevention levels. While primary prevention avoids the development of a disease, secondary and tertiary levels of prevention encompass activities aimed at preventing the progression of a disease and the emergence of symptoms as well as reducing the negative impact of an already established disease by restoring function and reducing disease-related complications.

Administration of the agents and compositions can be achieved in a number of ways using methods known in the art, including systemic administration (e.g. enteral or parenteral administration), intradermal delivery, intramuscular delivery, subcutaneous delivery, inhalation, and intranasal delivery.

The agents and compositions described herein can be administered to a subject alone, or in conjunction with one or more agents, such as those traditionally utilized in the treatment of RA. These agents include but are not limited to non-steroidal anti-inflammatory drugs, corticosteroids, disease-modifying antirheumatic drugs, and biologic response modifiers.

Examples of suitable non-steroidal anti-inflammatory drugs include: ibuprofen; naproxen sodium; celecoxib; diclofenac; fenoprofen; flurbiprofen; indomethacin; ketorolac; mefenamic acid; meloxicam; oxaprozin; piroxicam; and sulindac.

Examples of suitable corticosteroids include: prednisone; bethamethasone; and prednisolone; triamcinolone; methylprednisolone; and dexamethasone.

Examples of suitable disease-modifying antirheumatic drugs include: methotrexate; leflunomide; hydroxychloroquine; and sulfasalazine.

Examples of suitable biologic response modifiers include: abatacept and biosimilars thereof; adalimumab and biosimilars thereof; anakinra and biosimilars thereof; baricitinib; certolizumab and biosimilars thereof; etanercept and biosimilars thereof; golimumab and biosimilars thereof; infliximab and biosimilars thereof; rituximab and biosimilars thereof; sarilumab and biosimilars thereof; tocilizumab and biosimilars thereof; and tofacitinib.

The agents and compositions may be administered to a subject as frequently as several times daily, or it may be administered less frequently, such as once a day, once a week, once every two weeks, once a month, or even less frequently, such as once every several months or even once a year or less. The frequency of the dose will be readily determinable by the skilled artisan and will depend upon any number of factors, such as, but not limited to, the type and severity of the disease being treated.

In some embodiments, administration of an immunogenic composition or vaccine described herein can be performed by single administration or boosted by multiple administrations.

Methods of Detecting *S. didolesgii* Strain D8

Provided herein are methods for detecting the presence of *S. didolesgii* strain D8 in a biological sample obtained from a subject. Also provided are methods for detecting the presence of one or more antibodies against *S. didolesgii* strain D8 in a subject.

Direct sequence analysis can be used to detect a bacterial nucleic acid (e.g., a genome) of interest. A sample including DNA or RNA can be used, and PCR or other appropriate methods can be used to amplify all or a fragment of the nucleic acid, and/or its flanking sequences, if desired. The bacterial nucleic acid, or a fragment thereof, is determined, using standard methods. The presence of *S. didolesgii* strain D8 can detected utilizing a genomic approach, where bacterial genomic DNA isolated from a biological sample is analyzed to determine its genetic identity. The genomic approach can involve, for example, PCR analysis or whole genome sequencing (WGS). Where WGS sequencing is utilized, methods can include a PCR step or a multiple displacement amplification step.

Presence of *S. didolesgii* strain D8 can be detected by identifying the presence in the biological sample of *S. didolesgii* strain D8 genomic DNA. A contig representing the genomic sequence of *S. didolesgii* strain D8 is provided in SEQ ID NO: 2. An alignment of experimental sequences to SEQ ID NO: 2 can reveal the presence of *S. didolesgii* strain D8 in the sample. Those of skill in the art, having the benefit of this disclosure, including the accompanying sequence listing, will readily be able to identify experimental genomic sequences as belonging to *S. didolesgii* strain D8, if present in a sample. *S. didolesgii* strain D8 is also being maintained in the lab of inventor Kuhn. A sample of *S. didolesgii* strain D8 will deposited with a depository in accordance with the Budapest Treaty. The instant disclosure will be updated with details of the deposit once available. Those of skill in the art will be able to compare the deposited *S. didolesgii* strain D8 to bacteria—and their genomes—identified in biological samples.

In another embodiment, arrays of oligonucleotide probes that are complementary to target microbial nucleic acid sequences can be used to detect and identify microbial nucleic acids.

Biological samples can include, for example, fecal samples, rectal swabs, intestinal biopsies, along with samples from other mucosal or cutaneous sites.

Hybridization methods, such as Southern analysis, Northern analysis, or in situ hybridizations, can be used (see Current Protocols in Molecular Biology, Ausubel, F. et al., eds., John Wiley & Sons, including all supplements). For example, the presence of nucleic acid from a particular type of bacteria (e.g., *S. didolesgii* strain D8) can be determined by hybridization of nucleic acid to a nucleic acid probe. A "nucleic acid probe," as used herein, can be a DNA probe or an RNA probe. The nucleic acid probe can be, for example, a full-length nucleic acid molecule, or a portion thereof, such as an oligonucleotide of at least 15, 30, 50, 100, 250 or 500 nucleotides in length and sufficient to specifically hybridize under stringent conditions to appropriate target RNA or DNA. The hybridization sample is maintained under conditions which are sufficient to allow specific hybridization of the nucleic acid probe to RNA or DNA. Specific hybridization can be performed under high stringency conditions or moderate stringency conditions, as appropriate. In one embodiment, the hybridization conditions for specific hybridization are high stringency. More than one nucleic acid probe can also be used concurrently in this method. Specific hybridization of any one of the nucleic acid probes is indicative of the presence of the particular type of bacteria of interest, as described herein.

In some embodiments, methods of detecting *S. didolesgii* strain D8 in a biological sample include increasing the relative abundance of bacteria from Lachnospiraceae, Ruminococcaceae, or both Lachnospiraceae and Ruminococcaceae in a fraction of the biological sample. This involves selectively isolating bacteria from Lachnospiraceae, Ruminococcaceae, or both Lachnospiraceae and Ruminococcaceae, to the exclusion of other bacteria. This process results in a high proportion of Lachno/Rumino relative to other bacteria, making the detection of *S. didolesgii* strain D8 in the sample easier. The relative abundance can be increased by contacting the sample from the subjected with the variable region of one or more antibodies disclosed and described herein. For example, the enriched fraction can be contacted with an antibody, or antigen binding fragment thereof, chosen from MH1 ($V_H$=SEQ ID NO: 3; $V_L$=SEQ ID NO: 4); MH3 ($V_H$=SEQ ID NO: 7; $V_L$=SEQ ID NO: 8); MH4 ($V_H$=SEQ ID NO: 9; $V_L$=SEQ ID NO: 10); MH5 ($V_H$=SEQ ID NO: 11; $V_L$=SEQ ID NO: 12); MH6 ($V_H$=SEQ ID NO: 13; $V_L$=SEQ ID NO: 14); MH11 ($V_H$=SEQ ID NO: 23; $V_L$=SEQ ID NO: 24); MH12 ($V_H$=SEQ ID NO: 25; $V_L$=SEQ ID NO: 26); MH14 ($V_H$=SEQ ID NO: 29; $V_L$=SEQ ID NO: 30); MH15 ($V_H$=SEQ ID NO: 31; $V_L$=SEQ ID NO: 32); MH16 ($V_H$=SEQ ID NO: 33; $V_L$=SEQ ID NO: 34); MH17 ($V_H$=SEQ ID NO: 35; $V_L$=SEQ ID NO: 36); MH18 ($V_H$=SEQ ID NO: 37; $V_L$=SEQ ID NO: 38); MH20 ($V_H$=SEQ ID NO: 41; $V_L$=SEQ ID NO: 42); MH21 ($V_H$=SEQ ID NO: 43; $V_L$=SEQ ID NO: 44); MH22 ($V_H$=SEQ ID NO: 45; $V_L$=SEQ ID NO: 46); MH23 ($V_H$=SEQ ID NO: 47; $V_L$=SEQ ID NO: 48); MH24 ($V_H$=SEQ ID NO: 49; $V_L$=SEQ ID NO: 50); MH25 ($V_H$=SEQ ID NO: 51; $V_L$=SEQ ID NO: 52); MH27

($V_H$=SEQ ID NO: 55; $V_L$=SEQ ID NO: 56); MH28 ($V_H$=SEQ ID NO: 57; $V_L$=SEQ ID NO: 58); MH29 ($V_H$=SEQ ID NO: 59; $V_L$=SEQ ID NO: 60); MH30 ($V_H$=SEQ ID NO: 61; $V_L$=SEQ ID NO: 62); MH31 ($V_H$=SEQ ID NO: 63; $V_L$=SEQ ID NO: 64); MH32 ($V_H$=SEQ ID NO: 65; $V_L$=SEQ ID NO: 66); MH33 ($V_H$=SEQ ID NO: 67; $V_L$=SEQ ID NO: 68); MH34 ($V_H$=SEQ ID NO: 69; $V_L$=SEQ ID NO: 70); MH35 ($V_H$=SEQ ID NO: 71; $V_L$=SEQ ID NO: 72); MH38 ($V_H$=SEQ ID NO: 77; $V_L$=SEQ ID NO: 78); MH39 ($V_H$=SEQ ID NO: 79; $V_L$=SEQ ID NO: 80); MH40 ($V_H$=SEQ ID NO: 81; $V_L$=SEQ ID NO: 82); MH42 ($V_H$=SEQ ID NO: 85; $V_L$=SEQ ID NO: 86); MH45 ($V_H$=SEQ ID NO: 91; $V_L$=SEQ ID NO: 92); MH46 ($V_H$=SEQ ID NO: 93; $V_L$=SEQ ID NO: 94); MH48 ($V_H$=SEQ ID NO: 97; $V_L$=SEQ ID NO: 98), MH49 ($V_H$=SEQ ID NO: 99; $V_L$=SEQ ID NO: 100); MH50 ($V_H$=SEQ ID NO: 101; $V_L$=SEQ ID NO: 102); MH51 ($V_H$=SEQ ID NO: 103; $V_L$=SEQ ID NO: 104); MH55 ($V_H$=SEQ ID NO: 111; $V_L$=SEQ ID NO: 112); MH56 ($V_H$=SEQ ID NO: 113; $V_L$=SEQ ID NO: 114); MH57 ($V_H$=SEQ ID NO: 115; $V_L$=SEQ ID NO: 116); MH58 ($V_H$=SEQ ID NO: 117; $V_L$=SEQ ID NO: 118); MH59 ($V_H$=SEQ ID NO: 119; $V_L$=SEQ ID NO: 120); MH60 ($V_H$=SEQ ID NO: 121; $V_L$=SEQ ID NO: 122); MH62 ($V_H$=SEQ ID NO: 125; $V_L$=SEQ ID NO: 126); MH63 ($V_H$=SEQ ID NO: 127; $V_L$=SEQ ID NO: 128); MH64 ($V_H$=SEQ ID NO: 129; $V_L$=SEQ ID NO: 130); MH65 ($V_H$=SEQ ID NO: 131; $V_L$=SEQ ID NO: 132); MH66 ($V_H$=SEQ ID NO: 133; $V_L$=SEQ ID NO: 134); MH67 ($V_H$=SEQ ID NO: 135; $V_L$=SEQ ID NO: 136); MH68 ($V_H$=SEQ ID NO: 137; $V_L$=SEQ ID NO: 138); MH73 ($V_H$=SEQ ID NO: 147; $V_L$=SEQ ID NO: 148); MH74 ($V_H$=SEQ ID NO: 149; $V_L$=SEQ ID NO: 150) MH75 ($V_H$=SEQ ID NO: 151; $V_L$=SEQ ID NO: 152) MH76 ($V_H$=SEQ ID NO: 153; $V_L$=SEQ ID NO: 154); MH80 ($V_H$=SEQ ID NO: 161; $V_L$=SEQ ID NO: 162); MH82 ($V_H$=SEQ ID NO: 165; $V_L$=SEQ ID NO: 166); MH83 ($V_H$=SEQ ID NO: 187; $V_L$=SEQ ID NO: 188); and MH91 ($V_H$=SEQ ID NO: 183; $V_L$=SEQ ID NO: 184). In certain embodiments, the enriched fraction can be contacted with an antibody, or antigen-binding fragment thereof, chosen from MH4 ($V_H$=SEQ ID NO: 9; $V_L$=SEQ ID NO: 10); MH28 ($V_H$=SEQ ID NO: 57; $V_L$=SEQ ID NO: 58); MH58 ($V_H$=SEQ ID NO: 117; $V_L$=SEQ ID NO: 118); and MH91 ($V_H$=SEQ ID NO: 183; $V_L$=SEQ ID NO: 184).

The bacteria can then be released from the monoclonal antibodies to allow for further analysis.

In other embodiments, the presence of one or more antibodies against *S. didolesgii* strain D8 is detected in a serum or fecal sample of a subject. This can be done by contacting the serum or fecal sample from the subject with isolated bacteria of *S. didolesgii* strain D8, or one or more isolated antigens thereof. Binding of serum or fecal antibodies to the isolated *S. didolesgii* strain D8 or its isolated antigens can then be detected.

Also provided are methods for preparing a sample fraction for detection of *S. didolesgii* strain D8 in a subject. Such methods generally include contacting a sample (e.g., fecal sample, fecal swab, or intestinal biopsy) with one or more monoclonal antibodies or one or more monoclonal antibody fragments having a variable region as described herein. After contacting the sample with the one or more monoclonal antibodies or one or more monoclonal antibody fragments, the resulting fraction will include an increased relative abundance of bacteria from Lachnospiraceae, Ruminococcaceae, or both Lachnospiraceae and Ruminococcaceae in the sample fraction. Such methods can be set up similarly to a traditional immunoprecipitation assay, which will provide for the "pull down" of the target bacteria. After achieving the enriched sample fraction, the bacteria can be released from the one or more monoclonal antibodies or one or more antibody fragments.

Methods of Diagnosis

Various embodiments provide for methods of diagnosing a subject as having, or as being at risk for developing, rheumatoid arthritis. A subject can be diagnosed as having, or as being at risk for developing, rheumatoid arthritis by detecting the presence of *S. didolesgii* strain D8 or antibodies against *S. didolesgii* strain D8 in a subject. Presence of *S. didolesgii* strain D8 or antibodies against *S. didolesgii* strain D8 can be detected in accordance with the methods described herein.

In some embodiments methods for diagnosing a subject as having, or as being at risk for developing, rheumatoid arthritis further include effectuating a treatment regimen on a subject diagnosed as having, or at risk of having, RA. The method can include diagnosing a subject with RA or at risk of developing RA based upon the detection of *S. didolesgii* strain D8 or antibodies against *S. didolesgii* strain D8 in a subject, and administering a treatment regimen described herein to the subject to treat or otherwise prevent RA in the subject.

Kits

Also provided are kits useful in carrying out the methods of the disclosure. Such kits comprise components useful in any of the methods described herein, including for example, hybridization probes or primers (e.g., labeled probes or primers), reagents for detection of labeled molecules, means for amplification of nucleic acids, means for analyzing a nucleic acid sequence, antibodies, and instructional materials. For example, in one embodiment, the kit comprises components useful for analysis of a bacterial nucleic acid of interest present in a biological sample obtained from a subject. In one embodiment, the kit comprises components for detecting one or more of the bacterial nucleic acids of interest present in a biological sample derived from a subject.

EXAMPLES

The materials, methods, and embodiments described herein are further defined in the following Examples. Certain embodiments are defined in the Examples herein. It should be understood that these Examples, while indicating certain embodiments, are given by way of illustration only. From the disclosure herein and these Examples, one skilled in the art can ascertain the essential characteristics of this invention, and without departing from the spirit and scope thereof, can make various changes and modifications of the invention to adapt it to various usages and conditions.

Experimental Example 1

Plasmablasts are a subset of circulating B cells, that are circulating components of ongoing local immune responses and could link immune responses at the mucosa with the joint. Having previously identified in individuals at risk for RA a population of circulating plasmablasts that belong to dual IgA/IgG clonal families, the following studies were undertaken prepare monoclonal antibodies from plasmablasts to study and identify mucosal and systemic targets of the antibodies.

Plasmablast monoclonal antibodies (mAb) were derived from flow sorting circulating plasmablasts from 2 individuals positive for antibodies against cyclic citrullinated peptide (CPP+) and diagnosed with rheumatoid arthritis (RA) less than 1 year prior to blood draw, and from 4 asymptomatic individuals who were CPP+ or RF+ (rheumatoid factor) and thus at risk for future RA onset. Variable light and heavy chain sequences from dual IgG and IgA clonal families identified in the plasmablasts were sequenced, cloned into a mouse IgG2a backbone, and expressed. A total of 94 mAbs were expressed (M1-M94).

The mAbs were utilized in assays to detect antigen reactivity. The mAbs were applied to a synovial antigen array representing a range of citrullinated and non-citrullinated antigens known to be relevant to RA. The mAbs targeted several citrullinated autoantigens, validating their identity as autoantibodies. The heatmap of FIG. 1A summarizes the relative reactivity between mAb and antigen, from no reactivity (blue) to high reactivity (red). The mAbs appearing in the heatmap of FIG. 1A, from top to bottom, are anti-IL8 as an assay control, plasmablast-derived antibodies MH1 through MH94, assay control F57m, and assay control B29m.

Figure 1B:
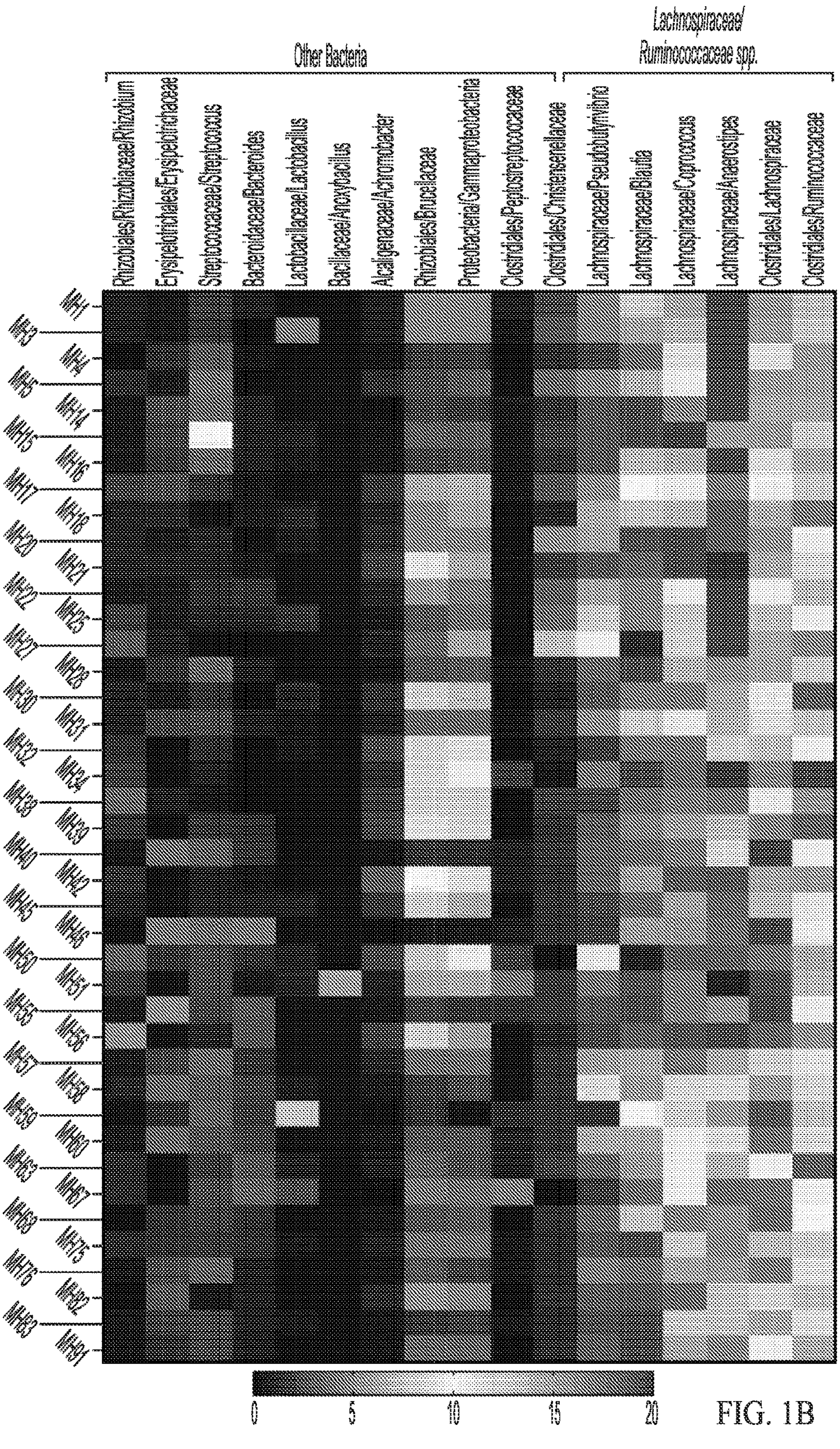
FIG. 1B is a heatmap representing relative reactivity abundance of bacterial taxa identified following flow cytometry utilizing binding by select mAbs from FIG. 1A.
Figure 1C:
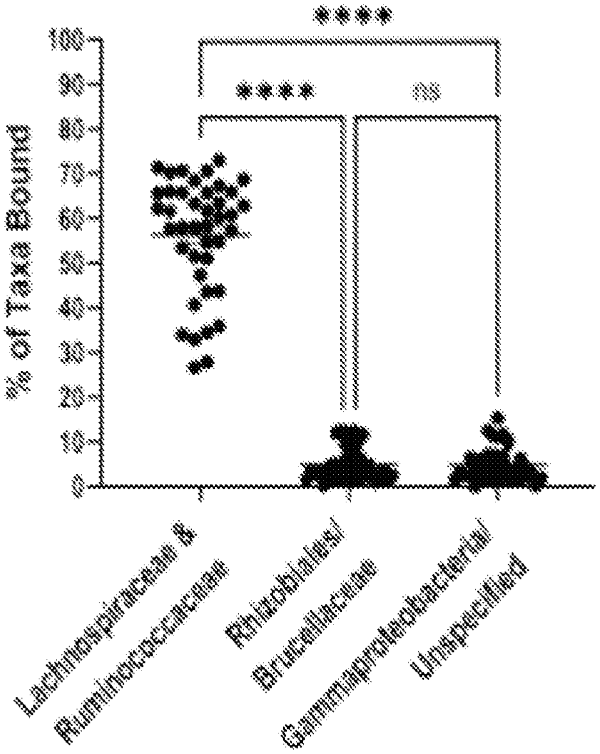
FIG. 1C depicts data of the three most bound taxa from the bound fraction of each plasmablast mAb, represented out of the total bacteria bound by each mAb. ****=P<0.0001 and ns=not significant.

To test whether any plasmablast mAbs target intestinal bacteria and to define such targets, the following study was performed. Fecal samples from 20 individuals (healthy control n=5, at-risk for future RA n=8, and classified RA m=5) were pooled, and contacted with the mAbs to test reactivity. The pooled sample approach resulted in a broadly representative commensal intestinal bacteria pool, and limited internal biases and variability. Antibody-labeled bacteria were flow sorted using a PE-labeled anti-murine IgG2a Fc antibody. DNA was harvested from sorted bacteria, the V3V4 16s rRNA regions were amplified and sequenced, and the sequences were aligned to determine bacterial taxa. The heatmap of FIG. 1B summarizes the relative abundance of taxa within the mAb-bound fraction, from no taxa (blue) to high abundance (red). The mAbs bound to many bacterial antigens, particularly in the closely related families Lachnospiraceae and Ruminococcaceae. Indeed, >50% of the total bacteria bound by all of the bacteria-binding mAbs combined were from families Lachnospiraceae and Ruminococcaceae. See, FIG. 1C. The mAbs appearing in the heatmap of FIG. 1B, from top to bottom, are plasmablast-derived antibodies MH1, MH3, MH4, MH5, MH14, MH15, MH16, MH17, MH18, MH20, MH21, MH22, MH25, MH27, MH28, MH30, MH31, MH32, MH34, MH38, MH39, MH40, MH42, MH45, MH46, MH50, MH51, MH55, MH56, MH57, MH58, MH59, MH60, MH63, MH67, MH68, MH75, MH76, MH82, MH83, and MH91.

The following plasmablast-derived mAbs reacted with bacteria in the pooled fecal sample: MH1, MH3, MH4, MH5, MH6, MH11, MH12, MH14, MH15, MH16, MH17, MH18, MH20, MH21, MH22, MH23, MH24, MH25, MH27, MH28, MH29, MH30, MH31, MH32, MH33, MH34, MH35, MH38, MH39, MH40, MH42, MH45, MH46, MH48, MH49, MH50, MH51, MH55, MH56, MH57, MH58, MH59, MH60, MH62, MH63, MH64, MH65, MH66, MH67, MH68, MH73, MH74, MH75, MH76, MH80, MH82, MH83, and MH91.

Table 1 summarizes the data of FIGS. 1A and 1B, demonstrating mAbs derived from circulating plasmablasts in individuals at-risk for developing RA target both citrullinated autoantigens and bacterial antigens at a high frequency. The table provides the number of mAbs studied, how many bound synovial antigens (>100 relative units by microarray), and how many bound bacteria (>2 standard deviations above background binding of a primary against *Borrelia burgdorferi*).

TABLE 1

| | # mAbs generated | % synovial antigen reactive | % bacteria reactive |
|---|---|---|---|
| 4 at-risk individuals | 78 | 100 | 69.2 |
| 2 early RA individuals | 16 | 100 | 25 |
| TOTAL | 94 | 100 | 62.7 |

Experimental Example 2

Figure 2A:
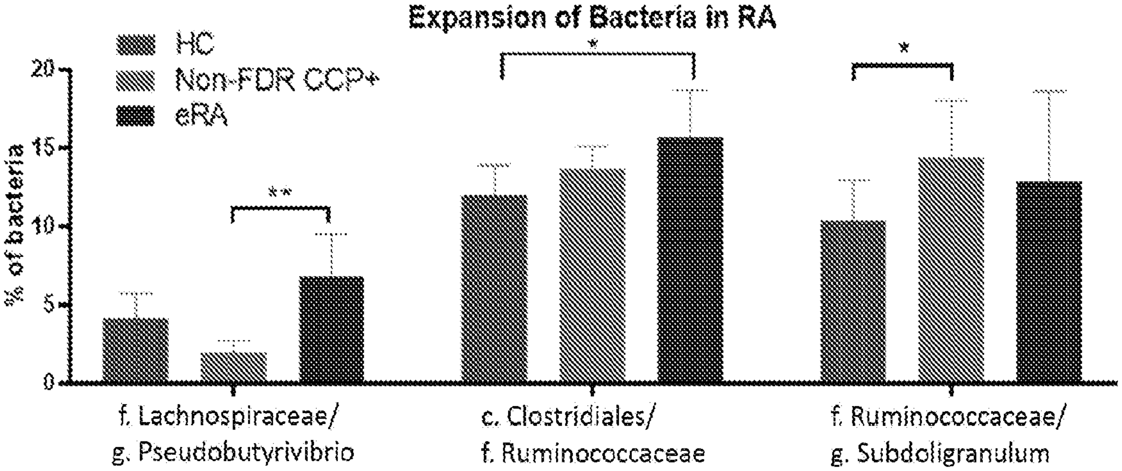
FIG. 2A is a bar chart illustrating an observed expansion of bacteria in RA. HC=healthy controls; Non-FDR (CCP+) =at risk for RA as defined as being asymptomatic but serum CPP+ and without a first-degree relative (FDR) with RA; eRA=early RA (<1 year from diagnosis). *=P<0.05; **=P<0.01 with FDR<0.1.
Figure 2B:
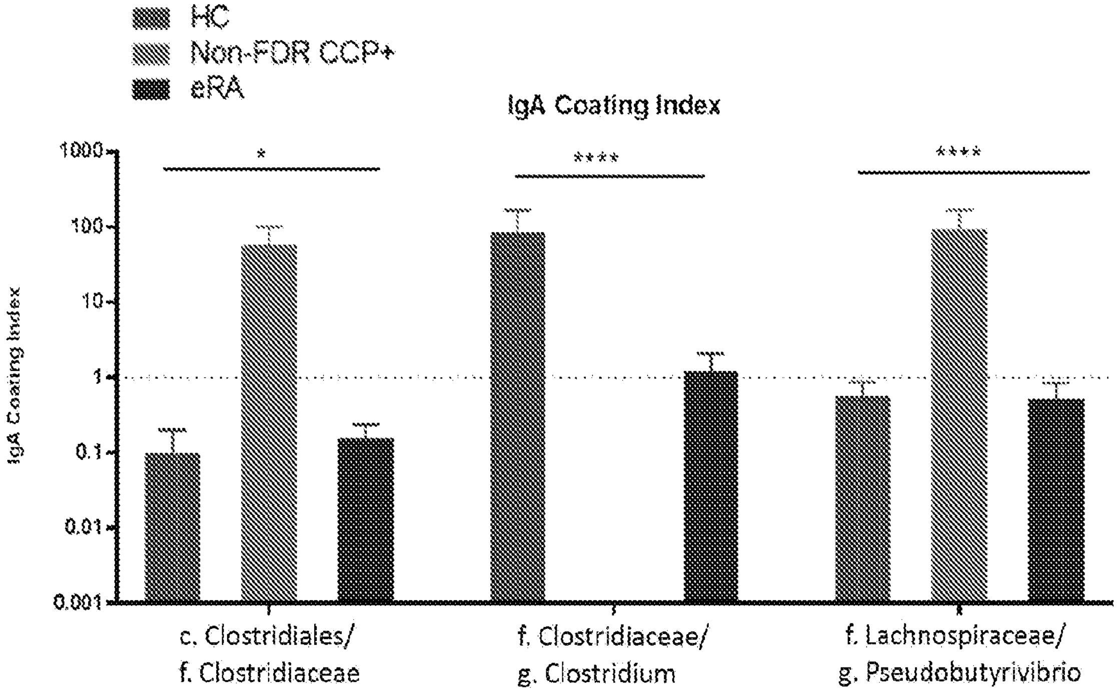
FIG. 2B is a bar chart illustrating the IgA coating index of various bacteria. HC=healthy controls; Non-FDR (CCP+) =at risk for RA as defined as being asymptomatic but serum CPP+ and without a first degree relative (FDR) with RA; eRA=early RA (<1 year from diagnosis). *=P<0.05; ****=P<0.0001 and FDR<0.1.

Taxa within class Clostridiales and families Lachnospiraceae and Ruminococcaceae in the feces of individuals at risk for RA and with early RA were examined. FIGS. 2A and 2B summarize the results from healthy controls (HC, N=16), individuals at-risk for RA defined as being asymptomatic but serum CCP+ and without a first degree relative (FDR) with RA (Non-FDR CCP+, N=12), and individuals with early RA (eRA) as defined as being <1 year from diagnosis (N=13). Fecal bacteria from these individuals underwent sequencing of the V3V4 region of bacterial 16S rRNA.

As depicted in FIG. 2A, statistically significant changes, as determined by Wilcoxon rank tests, were observed in the total relative abundance of taxa identified by class (c), family (f), or genus (g) within each group (*=P<0.05, and **=P<0.01 with FDR<0.1).

Endogenously IgA-coated bacteria were sorted by flow cytometry using a PE-labeled anti-human IgA antibody. Bacterial DNA was extracted, amplified, and sequenced using the V3V4 region of bacterial 16S rRNA. The IgA coating index was calculated as the % abundance in the IgA+ fraction divided by the % abundance in the IgA- fraction. Results summarizing the IgA coating index of taxa identified by class (c), family (f), or genus (g) are depicted in FIG. 2B. Statistically significant changes were determined by Wilcoxon rank test (*=P<0.05 and ****=P<0.0001 and FDR<0.1).

Taken together, these results indicate that bacteria of class Clostridiales, including its families Lachnospiraceae and Ruminococcaceae, are expanded in the fecal microbiome of individuals at risk for and with RA, and are preferentially targeted by endogenous fecal IgA.

Experimental Example 3

To investigate immune responses to Lachnospiraceae and Ruminococcaceae in RA, primary bacterial isolates were established from an at-risk individual with >40% abundance of of families Lachnospiraceae (Lachno) and Ruminococcaceae (Rumino) in their feces. Feces from the at-risk individual was homogenized in mega media that supports anaerobic growth. The homogenate was serially diluted to an estimated one cell per well in a 96-well plate, and was cultured under anaerobic conditions. Plates were incubated at 37° C. in an anaerobic chamber for 4 days when growth was observed. Wells were screened by PCR for amplification of 16S rRNA specific to Lachno/Rumino families. Those that amplified by PCR were then subcloned by serial dilution and again identified by PCR to ensure single organisms within the culture.

Table 2 summarizes number of bacterial strains isolated via serial dilution of feces from the single individual at risk for RA.

TABLE 2

| | Number of isolates |
|---|---|
| Lachno/Rumino amplification by PCR | 7 (14%) |
| No Lachno/Rumino amplification by PCR | 43 (86%) |
| Total | 50 |

As summarized in Table 2, a total of 50 isolates were established and seven were identified as Lachnospiraceae/Ruminococcaceae by qPCR (termed isolates 1-7). Five of the seven were confirmed as pure isolates by 16S rRNA sequencing (isolates 1, 3-5, and 7). The five isolates then underwent whole genome sequencing. The whole genome sequences were assembled, scaffolded, and cleaned using Abyss. The scaffolded sequences were input into the Biobakery Workflow and categorized as unidentified species within Ruminococcaceae *Subdoligranulum*, which the inventors designated as didolesgii.

Experimental Example 4 mAbs identified in Experimental Example 1 as having dual binding to synovial antigens and bacteria in the families Lachnospiraceae and Ruminococcaceae were mixed in excess with isolated strains identified as belonging to families Lachno/Rumino (0.5 μg IgG against $5\times10^{6}$ bacteria). The percentage of bacteria bound was then measured by flow cytometry. mAbs that did not bind bacteria were used as negative controls.

Figure 3A:
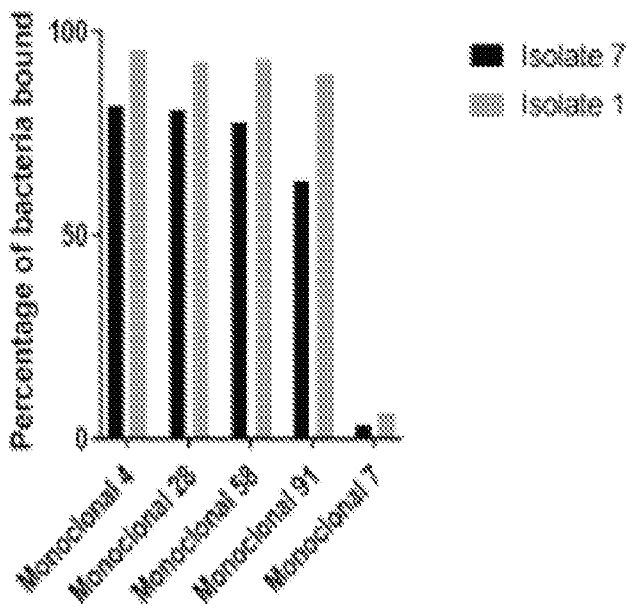
FIG. 3A is a bar chart illustrating the percentage of $5\times10^6$ bacteria of Isolate 1 (*Subdoligranulum didolesgii* strain H3) or Isolate 7 (*Subdoligranulum didolesgii* strain D8) bound by (0.5 microgram) representative mAbs from FIG. 1A.

FIG. 3A depicts the percentage of bacterial isolate bound (y-axis) by the mAb (x-axis) for two of the strains isolated from the single individual at risk for RA in Experimental Example 3: Isolate 1 (also referred to herein as Strain 1, Isolate H3, Strain H3, and *Subdoligranulum didolesgii* strain H3), and Isolate 7 (also referred to herein as Strain 7, Isolate D8, Strain D8, and *Subdoligranulum didolesgii* strain D8). Representative results using mAbs MH4, MH28, MH58, and MH91 are depicted. They were also matched against a control mAb (number 7) that was previously found to not bind bacteria.

Figure 3B:
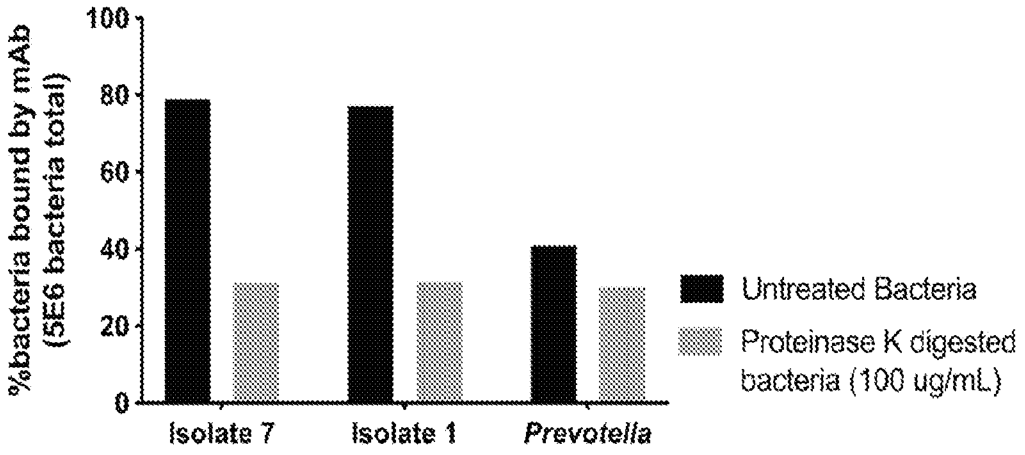
FIG. 3B is a bar chart illustrating the percentage of $5\times10^6$ bacteria of Isolate 7 (*Subdoligranulum didolesgii* strain D8), Isolate 1 (*Subdoligranulum didolesgii* strain H3), and a control bacteria (*Prevotella copri*) bound by representative mAb MH91, wherein bacteria are untreated or treated with proteinase K.

To test whether the mAbs target the bacteria in a protein-dependent manner, Isolates 1, 7, and *Prevotella copri* (control) were treated with 100 μg/ml proteinase K and washed prior to mixing with mAbs. The ability to then bind the bacteria was then measured by flow cytometry. FIG. 3B depicts representative results using mAb MH91, indicating the percent of total bacteria bound by the antibody for Isolates 1 and 7, and *Prevotella copri*, a bacterial species previously associated with RA. The data indicate that certain antibodies derived from circulating plasmablasts in individuals at risk for developing RA target isolated strains from families Lachno/Rumino in a protein-dependent manner.

Experimental Example 5

Serum from patients with RA or healthy controls (HC) was mixed with $5\times10^{6}$ of either Isolate 1 or Isolate 2 to determine whether patients with RA have elevated levels of antibodies to either isolate. Serum dilution was optimized by creating a dilution curve and was set at 1:60. Serum bound to bacteria was stained with anti-human IgG and anti-human IgA PE, as well as an anti-nucleic acid stain (Syto9 Green) to detect bacteria. Flow cytometric analysis were preformed to determine binding to the target bacterial strains.

Figure 4A:
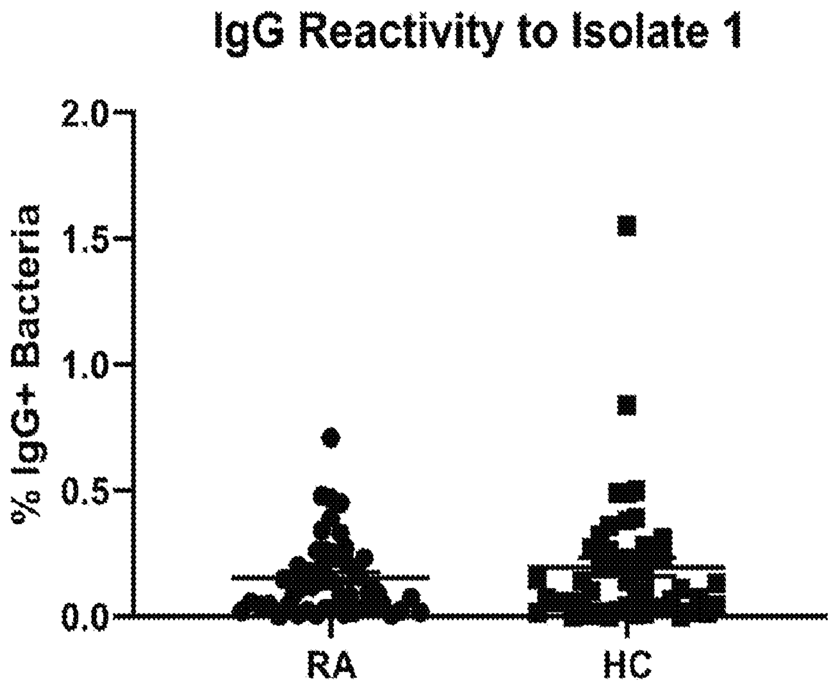
FIG. 4A is a dot plot illustrating the percent of bacteria of Isolate 1 (*Subdoligranulum didolesgii* strain H3) bound by serum IgG from patients with RA or healthy control (HC).
Figure 4B:
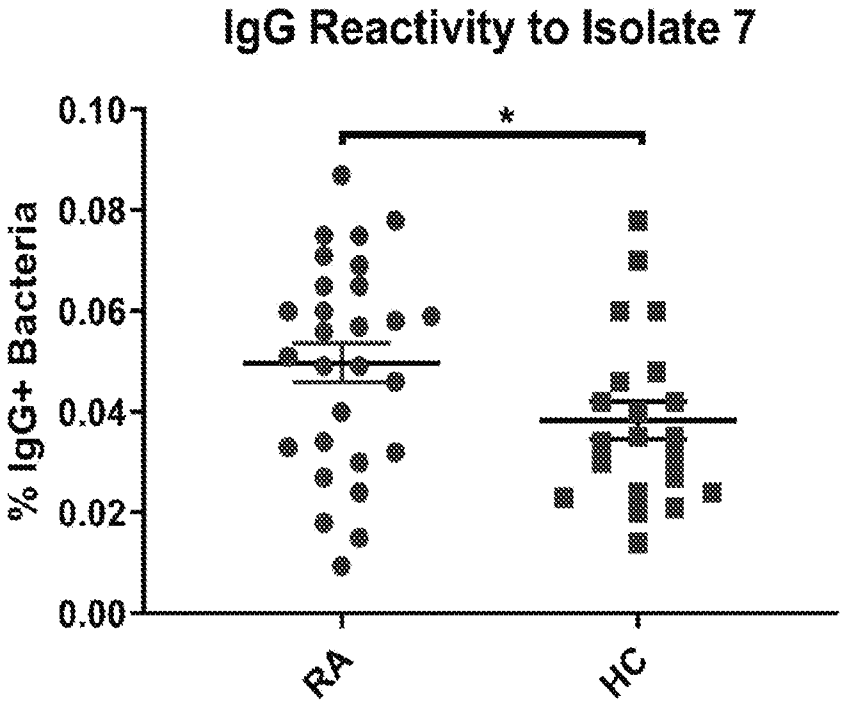
FIG. 4B is a dot plot illustrating the percent of bacteria of Isolate 7 (*Subdoligranulum didolesgii* strain D8) bound by serum IgG from patients with RA or healthy control (HC). *=P<0.05.

FIGS. 4A and 4B depict serum reactivity with Isolate 1 and Isolate 7, respectively. The percent of bacteria bound by serum IgG is shown for each individual, with the bars representing the mean±SEM for the group. *=P>0.05 by unpaired T-test. The results clearly indicate that serum from patients with RA have elevated levels of specific antibodies targeting Isolate 7, but not Isolate 1.

Figure 4C:
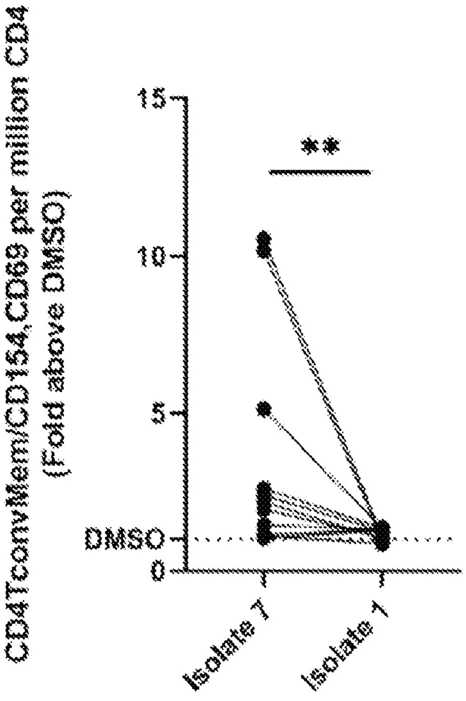
FIG. 4C depicts data from exposing Isolate 1 or 7 to isolated human peripheral blood mononuclear cells (PBMCs) from RA cases (n=11). PBMC were stimulated 14 hours in 37° C. incubator in the presence of either 0.1% DMSO, 50 ng/mL isolate 7 or 50 ng/mL isolate 1. **=P<0.01.
Figure 4D:
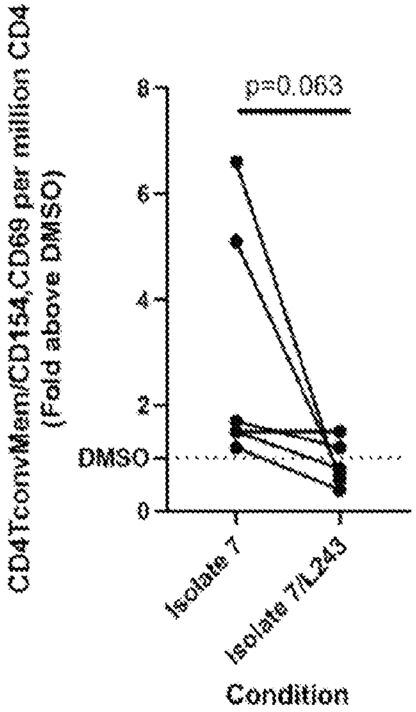
FIG. 4D depicts data from exposing Isolate 7 to isolated human peripheral blood mononuclear cells (PBMCs) from RA cases (n=11), rested in either anti-HLADR (clone L243) or anti-HLADQ (clone SVPL3) at 20 ug/mL, or equal volume PBS, 30 minutes prior to stimulation and Isolate 7.

To further support the immunologic relevance of the *Subdoligranulum* isolates, the inventors assessed if the bacteria were recognized by circulating T cells from individuals with RA. In brief, PBMCs from 11 individuals with RA were stimulated for 14 hours with 50 ng/ml oxygen-killed *Subdoligranulum* isolate 1 or isolate 7. Compared to isolate 1, isolate 7 significantly activated CD4+ T cells in the PBMCs as measured by surface CD69 and CD154 expression (FIG. 4C). T cell activation was MHC class II dependent, since blocking with anti-HLADR4 abrogated CD69 and CD154 expression (FIG. 4D).

Together, these findings support the hypothesis that the *Subdoligranulum* isolate 7 is immunologically relevant and strain variations may be of importance to understanding the pathogenesis of RA.

Experimental Example 6

In view of the results of Experimental Examples 4 and 5 involving Isolates 1 and 7, the inventors investigated whether either of these isolates on their own were capable of inducing arthritis. Male and female 6 to 8-week-old germ-free DBA/1 mice housed in sterile vinyl isolators were orally gavaged at day 0 with either sterile PBS, $10^{7}$ CFU *Prevotella copri*, a bacterial species previously associated with RA, $5\times10^{6}$ CFU Isolate 1, or $5\times10^{6}$ CFU Isolate 7.

Figure 5A:
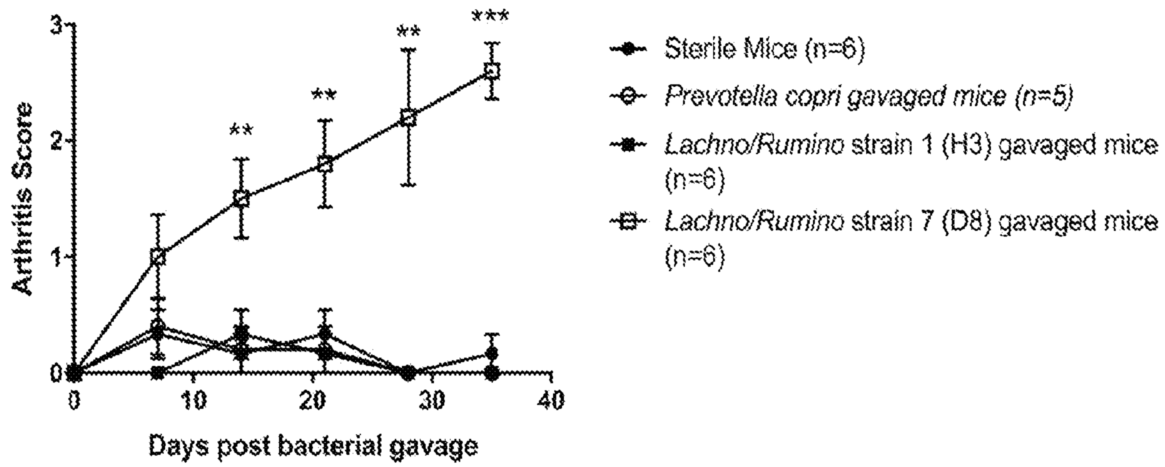
FIG. 5A is a line graph depicting arthritis scores for mice subjected to the indicated treatment over the course of 35 days. =P<0.01 and *=P<0.001.

Mice were scored by an observer blinded to the treatment group for signs of joint swelling and assessed a score of severity based on 0=now swelling, 1=1 digit swollen, 2=2 digits swollen, 3=3 digits swollen, and 4=entire paw swollen with ankylosis. The score for all four paws was summed for the animal's arthritis score. The results are summarized in FIG. 5A. Data are the mean arthritis scores in the indicated treatment group±SEM. Statistical significance was determined by unpaired t-tests (=P<0.01 and *=P<0.001).

Figure 5B:
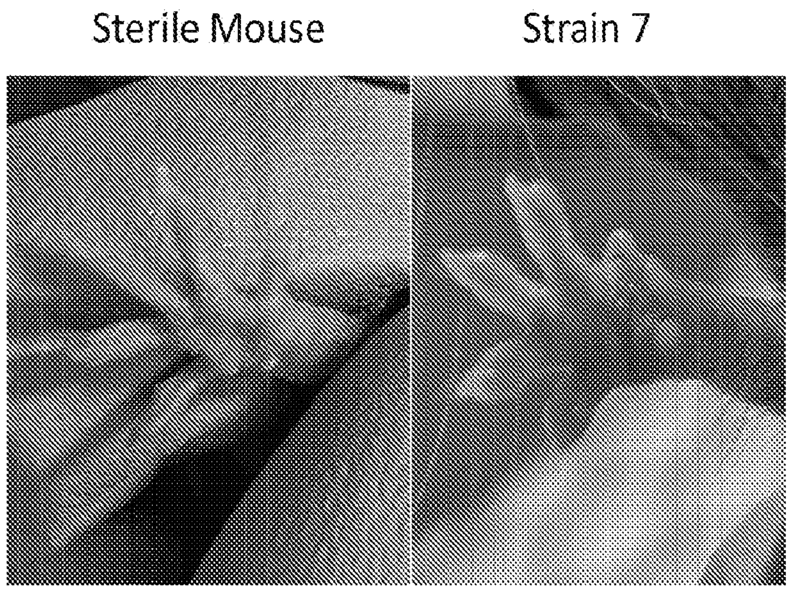
FIG. 5B presents two photographs of the forepaw of a mouse gavaged with sterile PBS ("Sterile mouse"; (left) and of a germ-free mouse mono-colonized with Isolate 7 (*Subdoligranulum didolesgii* strain D8) ("Strain 7"; right).

FIG. 5B depicts representative photographs of a forepaw of a mouse gavaged with sterile PBS (left) and that of a germ-free mouse mono-colonized with Isolate 7, in which swelling of digits and the wrist is clearly visible.

Figure 5C:
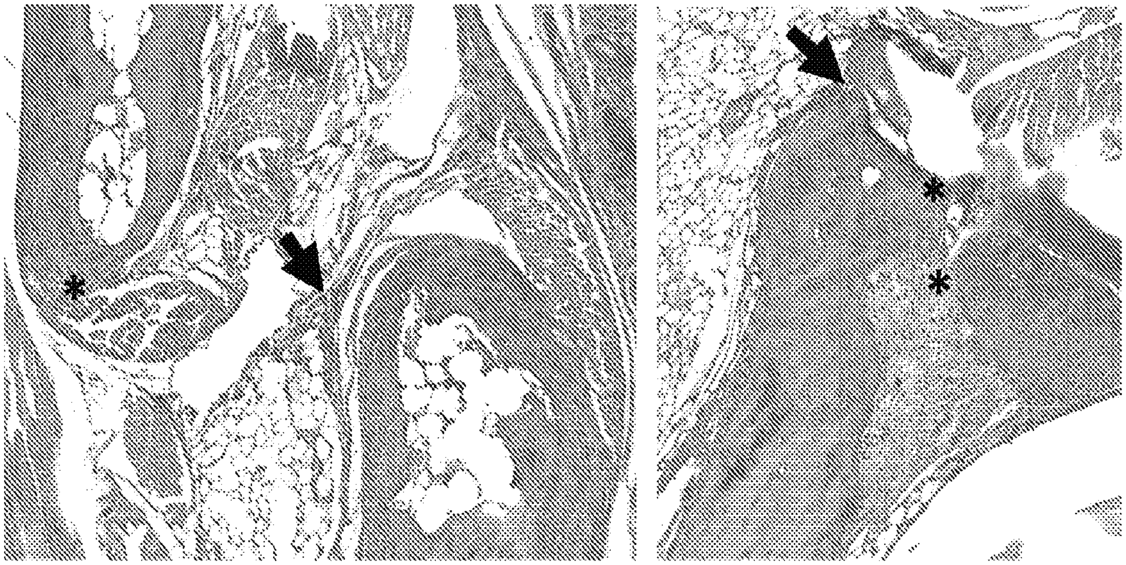
FIG. 5C presents two histological micrographs of mouse paws harvested 35 days following colonization with Isolate 7 (*Subdoligranulum didolesgii* strain D8). Images are displayed at 10× magnification.
Figure 5D:
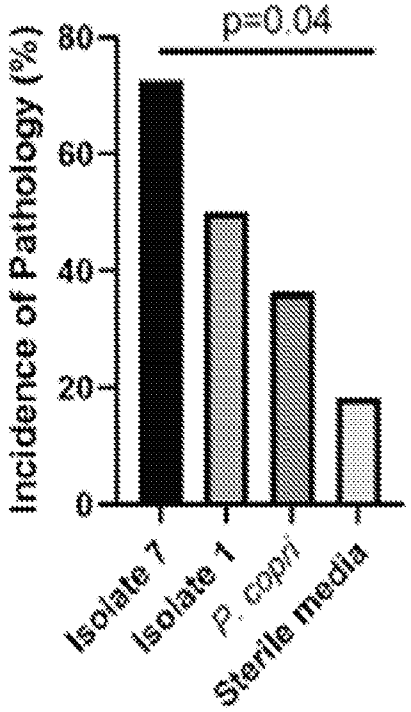
FIG. 5D is a graph showing incidence of pathology among all monocolonized mice. Fisher's exact test was performed, p=0.04.
Figure 5E:
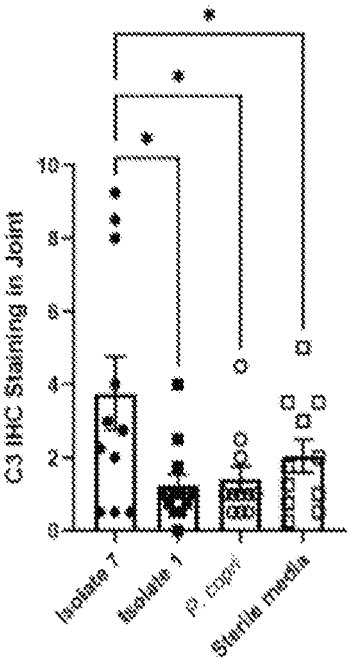
FIG. 5E is a graph of IHC data against the C3 component of the complement cascade. Scoring classification for C3 staining intensity for all mice is displayed. (n=12 isolate 1 gavaged, n=11 isolate 7 gavaged, n=11 *P. copri* gavaged, and n=11 sterile media gavaged, across two experiments).

35 days following colonization, mice were euthanized and paws harvested and stored in 10% formalin for histological analysis. The paws were decalcified with EDTA and sectioned. Hematoxylin and Eosin staining was performed and paw pathology was assessed by a pathologist in a blinded fashion. Evaluation of pathology demonstrated a range of synovitis, osteomyelitis, vasculitis, and soft tissue inflammation, all mild in severity. Representative sections from mice mono-colonized with Isolate 7 are depicted in the micrographs of FIG. 5C, demonstrating areas of synovial (arrows) and cartilage/bone destruction from inflammation (asterisks) due to Isolate 7. Micrographs are presented at 10× magnification. Mice colonized with isolate 7 had the highest incidence of pathology compared to the other treatment groups. See FIG. 5D. Immunohistochemistry (IHC) against the C3 component of the complement cascade was performed on the decalcified paw sections. The data demonstrated marked deposition both in the joint space and intradermally. See FIG. 5E.

In order to understand the systemic immune response following mono-colonization with isolate 1, isolate 7, or *P. copri*, or given sterile media, serum from mice was collected on days 14 and 35 after gavage. The total serum IgA was significantly increased in isolate 7 mono-colonized mice at day 14 as compared to the other groups (FIG. 5F), but this normalized by day 35 and was not observed for total serum IgG.

Figures 5F, 5G:
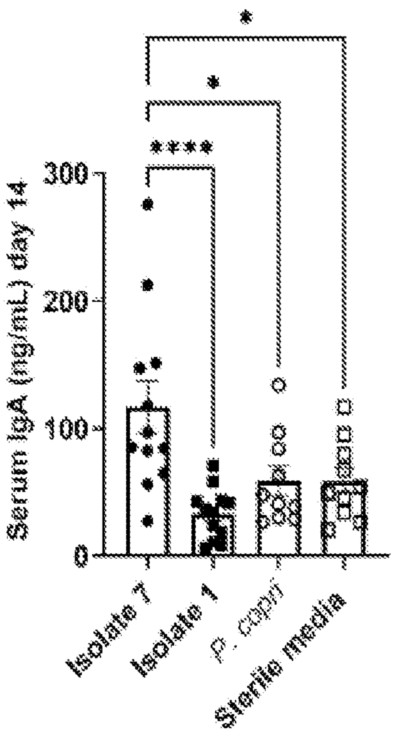
FIG. 5F is a graph of the total serum IgA at 14 days after gavage as determined by ELISA (n=12 isolate 7 gavaged, n=12 isolate 1 gavaged, n=10 *P. copri* gavaged, and n=10 sterile media gavaged).
FIG. 5G is a summary of the statistical test results for target autoantigens. Sera was analyzed on a planar array containing ~350 citrullinated and native peptides for autoantigens relevant in RA. An cutoff for reactivity was established and the proportion of murine samples meeting or exceeding this threshold for 11 target antigens at each timepoint is displayed.

The serum was evaluated for specific antibody reactivity through binding to a planar array containing ~350 RA-relevant autoantigenic targets. Interestingly, Isolate 7 gavaged mice developed and maintained serum autoantibodies against RA-relevant autoantigens at higher proportions at day 14 after bacterial gavage ($P<0.05$ by Kruskal-Wallis) than mice in the other treatment groups. Furthermore, isolate 7 mono-colonized mice developed numerous specific autoantibodies targeting RA-relevant antigens such as fibromodulin at greater titers in comparison to the control groups (FIG. 5G). These data indicate that mono-colonization with isolate 7 allows for the establishment of long-lived RA-relevant autoantibodies in circulation.

Figure 5H:
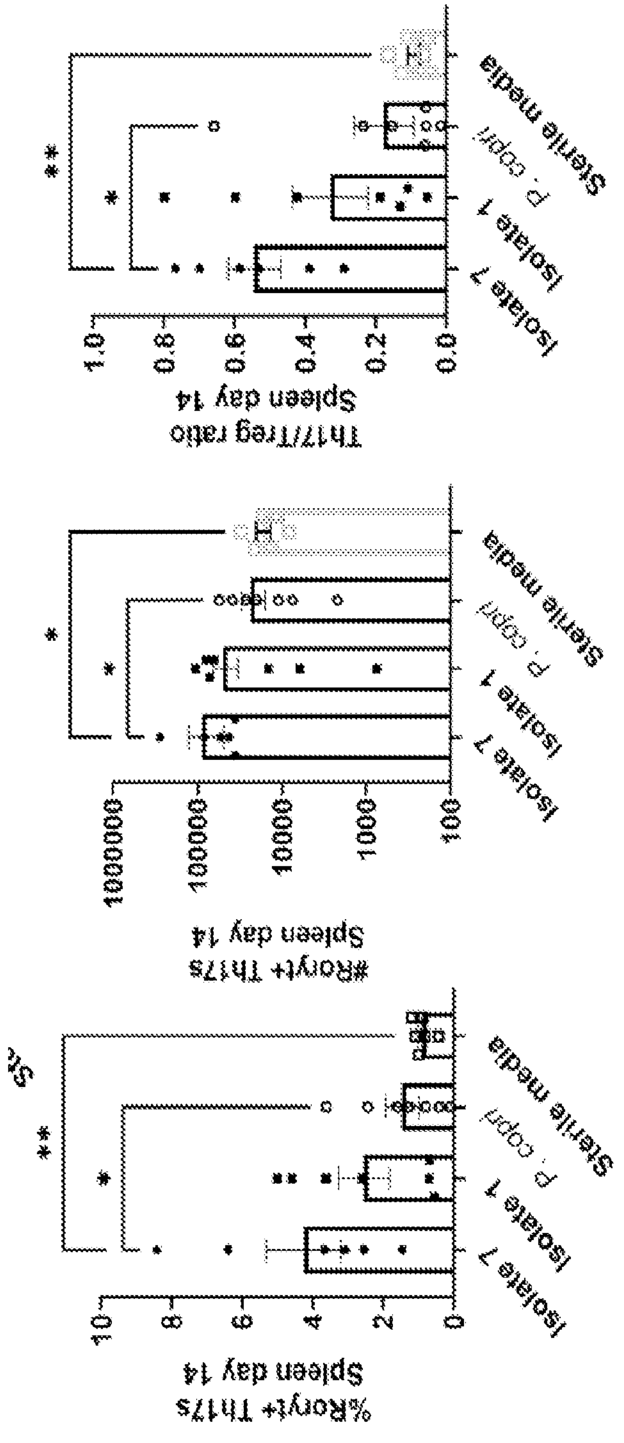
FIG. 5H depicts the percentage and absolute number of Rorγt+ Th17 cells as well as the Th17 to Treg ratio in spleens were collected from mice at 35 days post gavage. CD4+ T cell populations were analyzed by flow cytometry (n=7 isolate 7 gavaged, n=7 isolate 1 gavaged, n=6 *P. copri* gavaged, and n=8 sterile media gavaged).

Given the presence of CD4+ T cell reactivity to isolate 7 in patients with RA, splenic T cell populations were evaluated at days 14 and 35 in mice mono-colonized with isolate 1, isolate 7, or *P. copri*, or gavaged with sterile media. Th17 and Treg populations were focused on due to the role of intestinal microbiota in their development, and on Tfh because of the observed changes herein in autoantibodies. At day 14, splenic Th17 cells were significantly increased in percentage, absolute number, and Th17/Treg ratio in isolate 7 mono-colonized mice compared to *P. copri* and sterile media gavaged mice (FIG. 5H). However, significant differences in Treg or Tfh subsets was not observed. By day 35, the expansion of Th17 cells remained in isolate 7 mono-colonized mice compared to sterile media gavaged mice. These data are consistent with others' findings of Th17 expansion aiding in the development of autoantibody mediated arthritis in mice and in the evolution of human RA.

Because mono-colonization with Isolate 1 and 7 had such diverging effects, any similarities between the two isolates was examined. DNA was extracted from cultured Isolate 1 and Isolate 7. An Illumina NGS platform was employed, yielding short DNA sequences that were assembled into contigs and a genome scaffold using the Assembly By Short Sequences (ABySS) parallelized sequence assembler. Contigs were also filtered for and removed of any contaminant DNA. Strain identity was first established using Metagenomic Phylogenetic Analysis (MetaPhlAn 2.0) and was then confirmed through NCBI Blast of the scaffolded reads. The reference genome for family Ruminococcaceae genus *Subdoligranulum* used by MetaPhlAn 2.0 and to establish sequence identity was species 4_3_54A2FAA. Percent identity was determined by NCBI Blast, aligning each genomic scaffold with either the reference genome or other strain genome to get an overall percent homology.

Table 3 summarizes the percent identity of Isolates 1 and 7 relative to the reference OTU, as well as each other. Both Isolate 1 and Isolate 7 were determined to be novel strains of a novel species, and were named *Subdoligranulum didolesgii* strain H3 and *Subdoligranulum didolesgii* strain D8, respectively.

TABLE 3

| | OTU identification | Percent identity between isolate and reference OTU | Percent identity between Isolate 1 and Isolate 2 | Novel strain name |
|---|---|---|---|---|
| Isolate 1 | Family Ruminococcaceae, Genus *Subdoligranulum* unidentified species | 69.37% (80808/116485 bp) | 99.4% (2380873/2393298 bp) | *Subdoligranulum didolesgii* strain H3 |
| Isolate 7 | Family Ruminococcaceae, Genus *Subdoligranulum* unidentified species | 20.02% (25420/126994 bp) | | *Subdoligranulum didolesgii* strain D8 |

Figure 6:
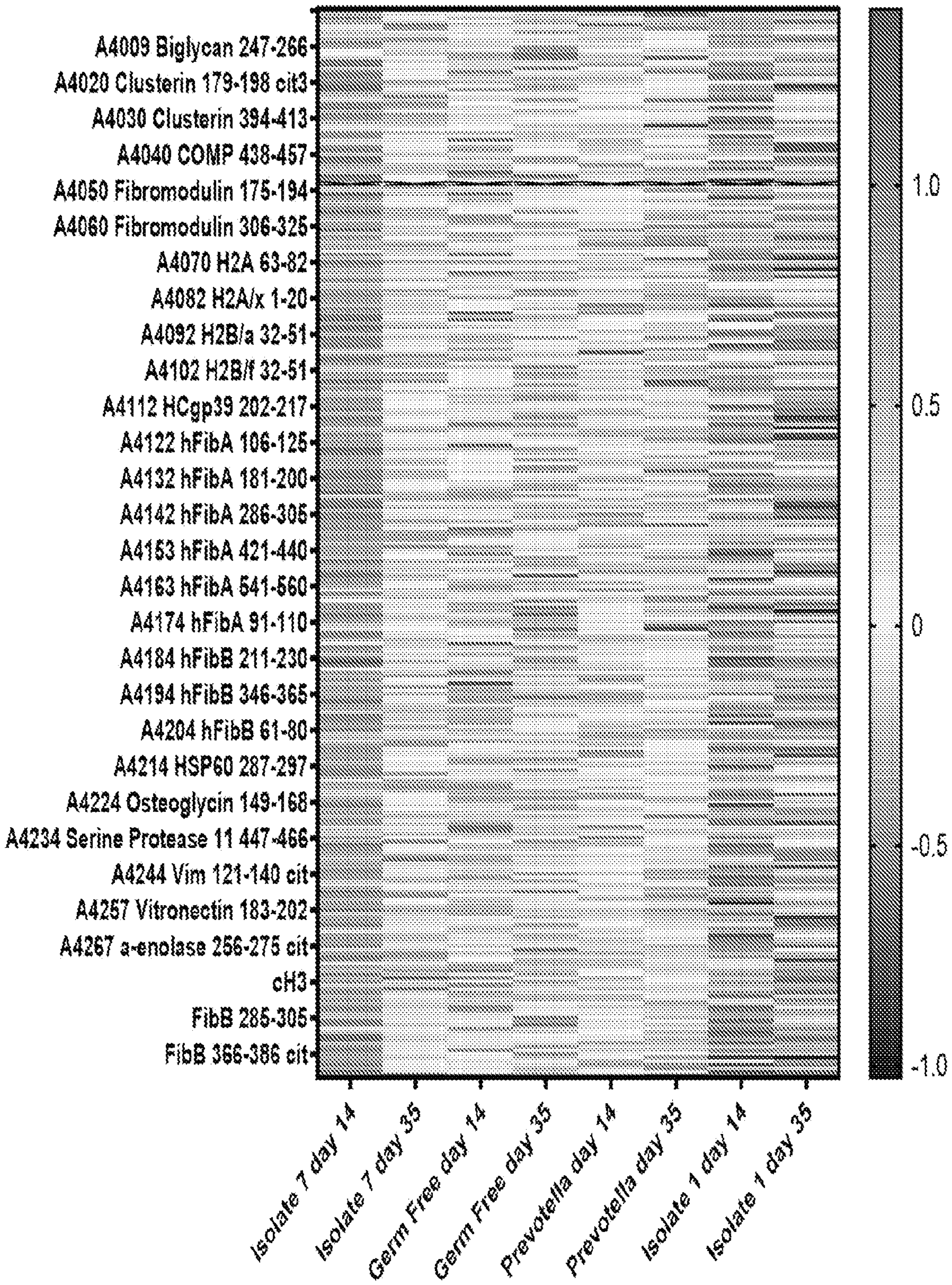
FIG. 6 is a heatmap representing binding of serum from germ-free DBA/1 mice gavaged with either sterile PBS, Isolate 1 (*Subdoligranulum didolesgii* strain H3), or Isolate 7 (*Subdoligranulum didolesgii* strain D8) with antigens of a murine synovial antigen protein array containing both citrullinated and non-citrullinated peptides and proteins.

Serum from germ-free DBA/1 mice mono-colonized with either sterile PBS (n=6) or $10^7$ CFU *Prevotella copri* (N=6), Isolate 1 (N-6), or Isolate 7 (n=6) were tested for antibodies targeting synovial antigens. Serum from days 14 and 35 from each group were applied to a murine synovial antigen protein array that contains both citrullinated and uncitrullinated peptides and proteins. FIG. 6 depicts a heatmap representing the z-score of relative reactivity from −1 (blue) to 1.5 (red) between serum (x-axis) and antigen (y-axis). Colonization with Isolate 7 caused the development of antibodies that bind synovial antigen, while Isolate 1 largely failed to do so.

Experimental Example 7

Figure 7A:
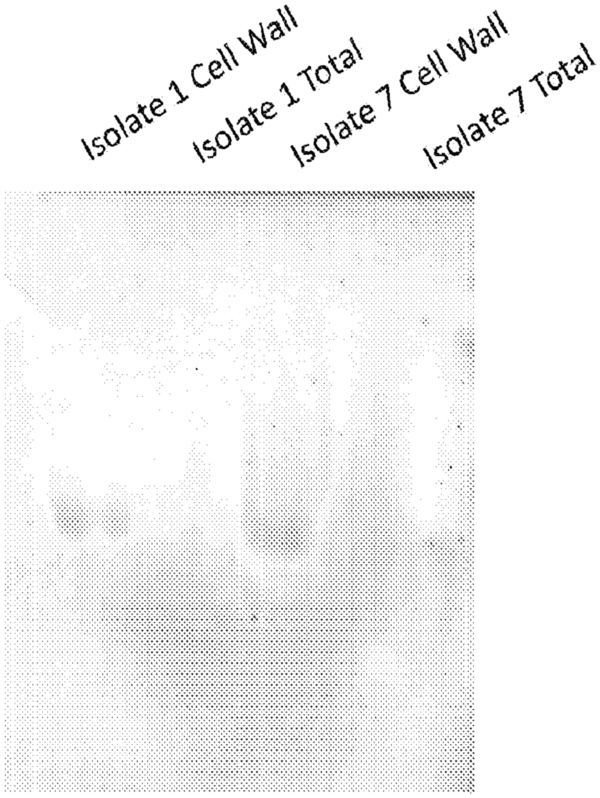
FIG. 7A is a photograph of a 10% native gel on which solubilized protein fractions (cell wall or total cell) from Isolate 1 (*Subdoligranulum didolesgii* strain H3) and Isolate 7 (*Subdoligranulum didolesgii* strain D8) were loaded and blotted against mAb MH91.

Protein fractionation was performed for Isolates 1 and 7 in which total protein was extracted using B-PER Protein Extraction reagent. The cell wall-specific protein fraction was isolated and solubilized through mutanolysin digest. The solubilized proteins were run on 10% native gels and were blotted against MH91, known to bind to the bacterial isolates. A representative native gel is depicted in the photograph of FIG. 7A.

Figure 7B:
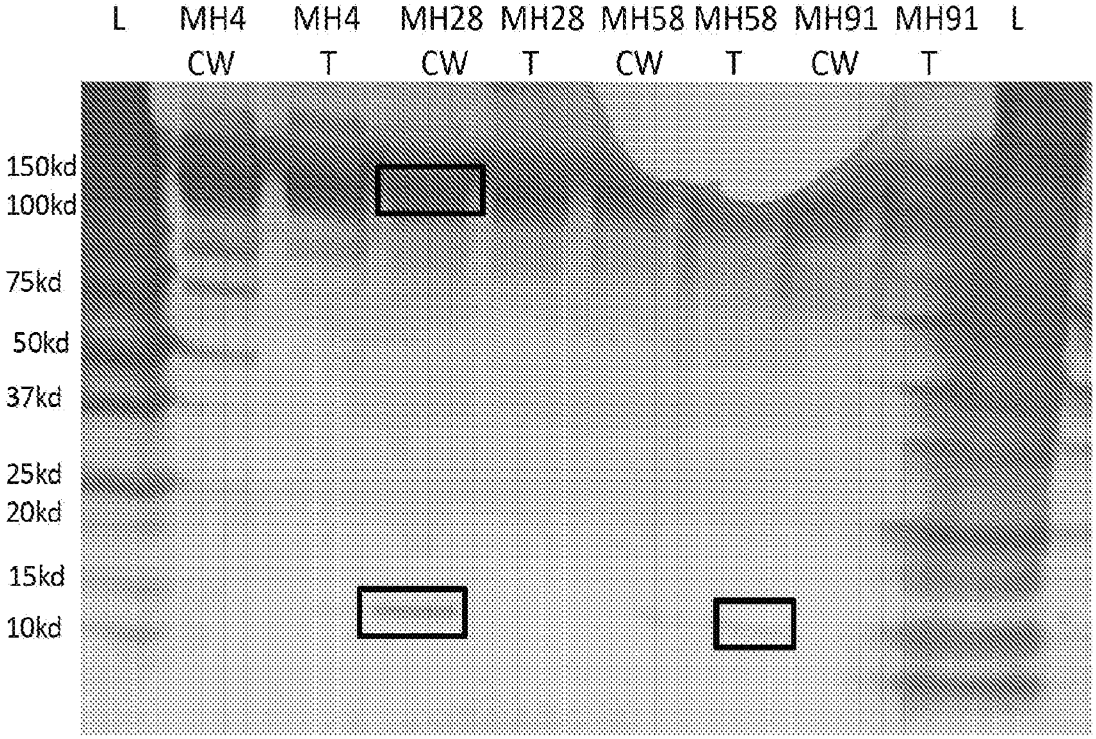
FIG. 7B is a photograph of a 10% SDS PAGE gel, depicting immunoprecipitation of proteins of Isolate 7 (*Subdoligranulum didolesgii* strain D8) using the indicated mAbs. CW=cell wall; T=total.

Four representative monoclonal antibodies identified in Experimental Examples 1 and 4 as capable of binding to Isolates 1 and 7 as well as synovial antigens (i.e., MH4, MH28, MH58, and MH91) were utilized to immunoprecipitate target proteins using the Invitrogen immunoprecipitation with Protein A protocol. These mAbs were exposed to the same two protein fractions described above, referring to FIG. 7A, and immunoprecipitated proteins were uncoupled from the antibodies and run on a 10% SDS PAGE gel prior to silver staining. FIG. 7B depicts a representative SDS PAGE gel.

The immunoprecipitated bands were excised and trypsin digested, and then MALDI-TOF was preformed to generate a list of component peptides. From here, protein identification from the component peptide library was performed using the MS-Homology tool available through Protein Prospector. Each peptide library was matched against 4 different databases to identify proteins of high likelihood across multiple databases. To verify these results utilizing a second method, each de novo peptide was run through a peptide BLAST search on NCBI to determine high-likelihood protein candidates. High-likelihood candidates were screened for evidence of protein generation by Ruminococcaceae species, and then the genome sequences were searched for evidence of the gene controlling each protein's production using the GeneWise Pairwise Sequence Alignment tool through EMBL-EMI. From these methods, several high-likelihood protein targets were identified. Protein targets are listed in Table 4.

TABLE 4

| Protein Name | Protein ID |
|---|---|
| Amino acid ABC transporter substrate-binding protein, PAAT family | R5Y4K6_9FIRM |
| Elongation factor Tu | R5YCH3_9FIRM |
| dTDP-glucose 4,6-dehydratase | R6DWD2_9FIRM |
| FG-GAP repeat domain-containing protein (plasmid) | A7B574_RUMGV |
| GTPases - translation elongation factors, partial | WP_009866873.1 |
| Putative DNA-binding protein | R5QFF1_9FIRM |
| Short-chain dehydrogenase/reductase SDR | D4M4P2_9FIRM |
| Transposase | R7CQ18_9FIRM |
| 3-phosphoshikimate 1-carboxyvinyltransferase | R6U1K9_9CLOT |
| ABC transporter, substrate-binding protein, family 5 domain protein | A0A171JU57 |
| MFS transporter | R5YDJ5_9FIRM |
| IgG-binding protein A | 586027 M |
| 4-hydroxybenzoate octaprenyltransferase | Q3SLJ4 |

Experimental Example 8

Cecal contents from germ-free DBA/1 mice mono-colonized with sterile PBS or $10^7$ CFU *Prevotella copri*, Isolate 1, or Isolate 7 were evaluated for >190 metabolites using LC-MS.

Figure 8A:
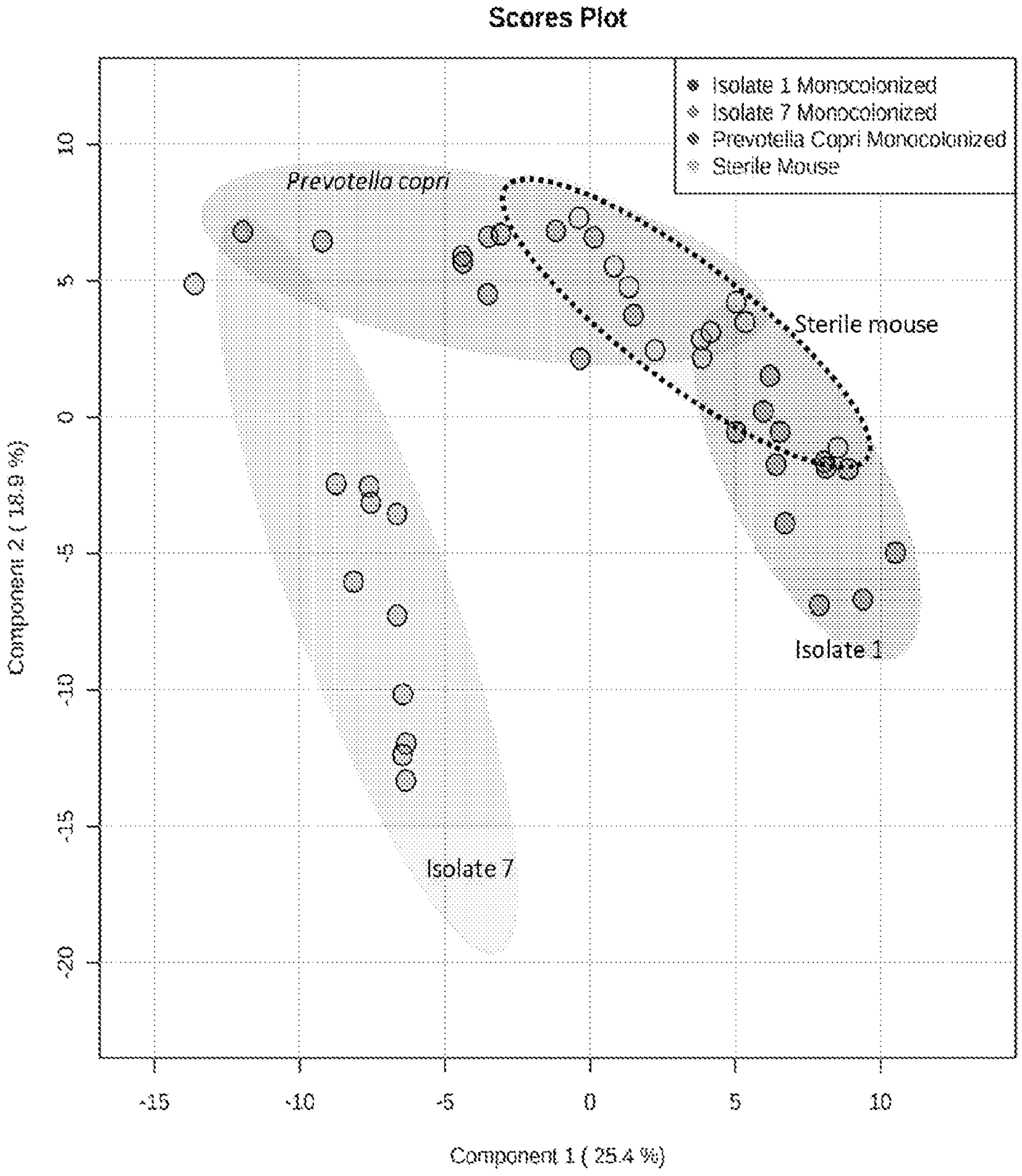
FIG. 8A is a principle components analysis plot depicting metabolic profiles for Isolate 1 (*Subdoligranulum didolesgii* strain H3), Isolate 7 (*Subdoligranulum didolesgii* strain D8), and *Prevotella copri* mono-colonized mice, and sterile mice.

The data presented in FIG. 8A provide a comparison of the treatment groups, and demonstrate separation of metabolic profiles between Isolate 7 (green) and the control groups (isolate 1=red, *P. copri*=blue, and sterile mice=cyan).

Figure 8B:
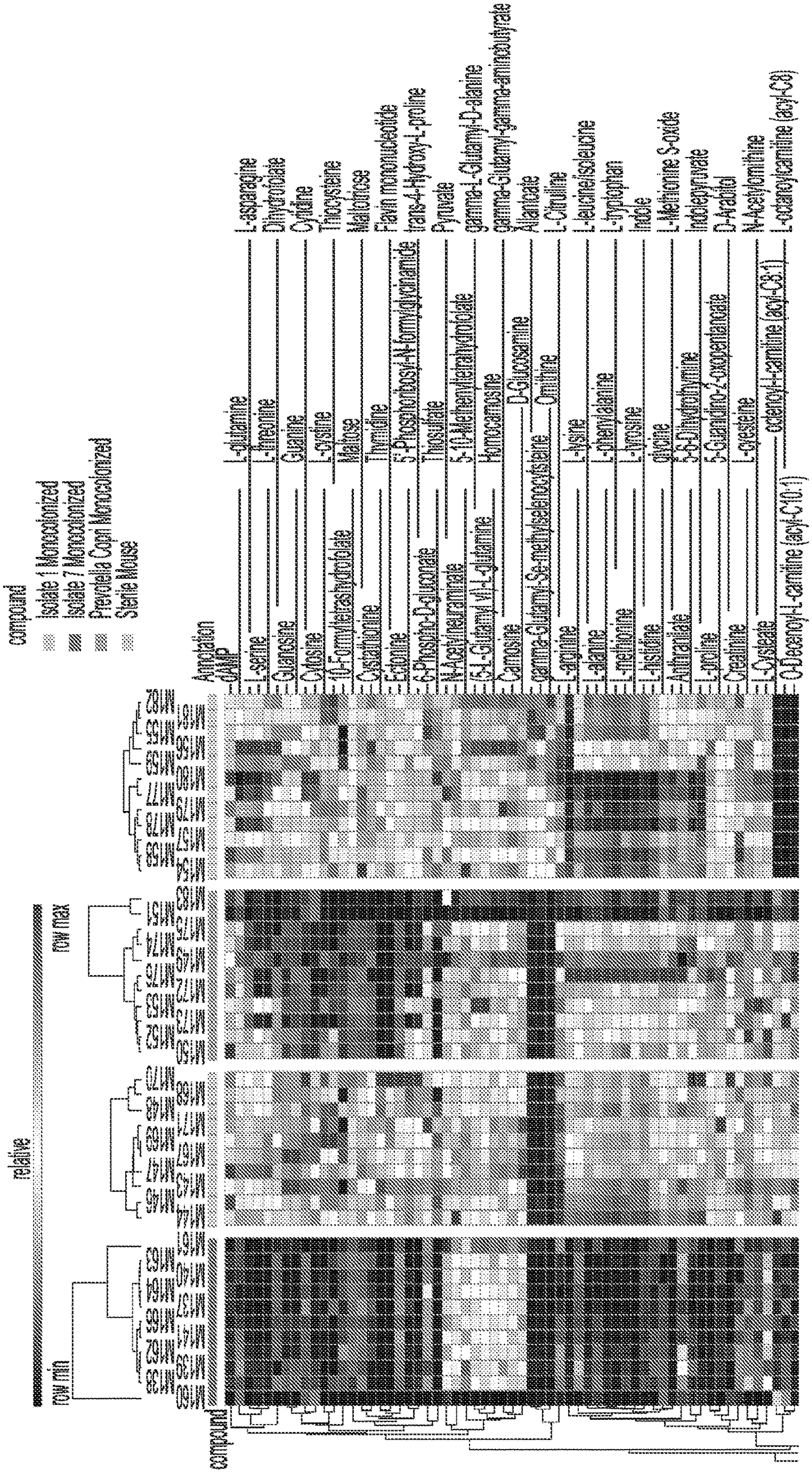
FIG. 8B is a heatmap representing relative metabolite abundance, where columns are individual mice grouped by treatment, and rows are specific metabolites.
Figure 8B:
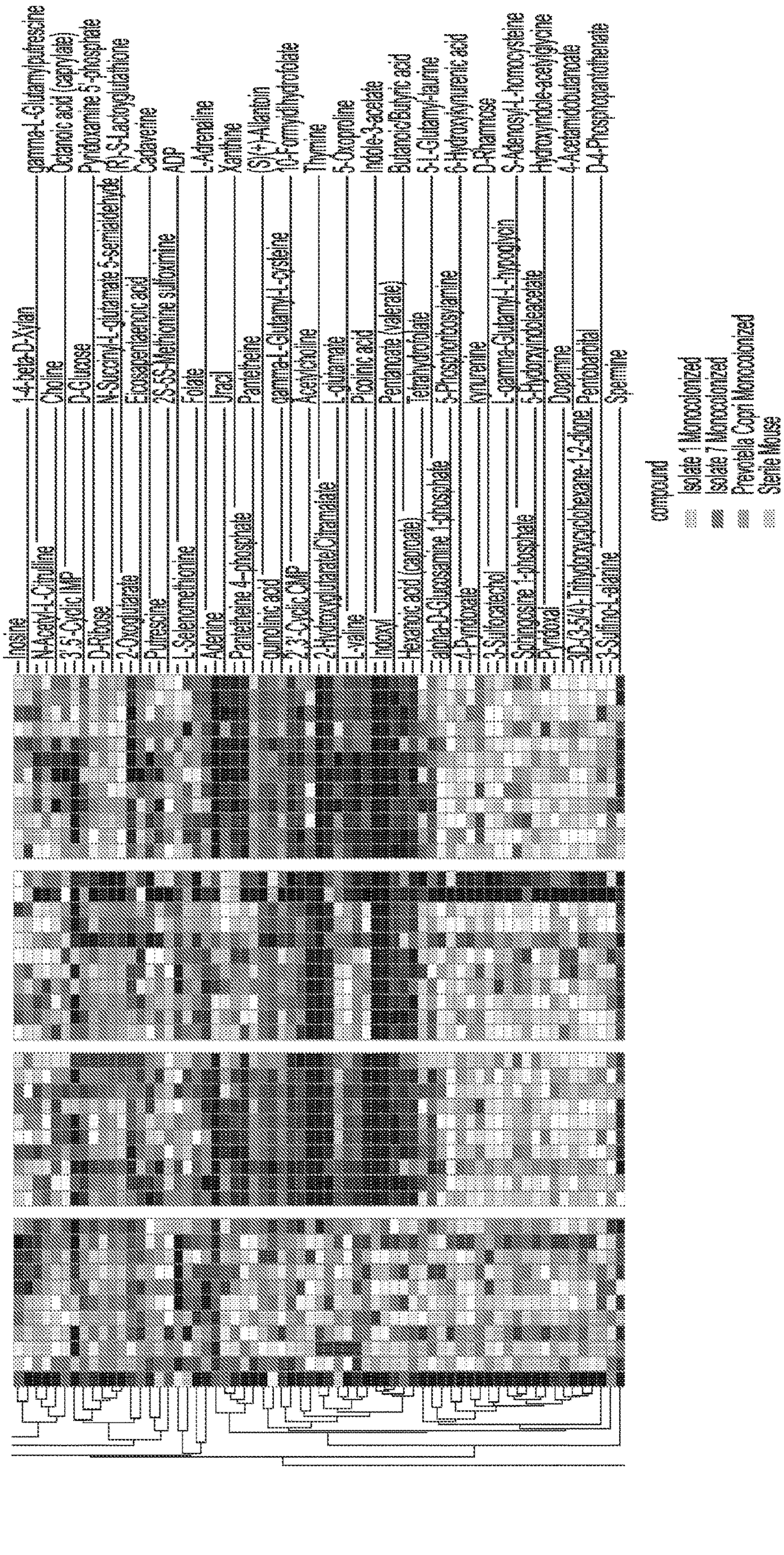
Figure 8B:
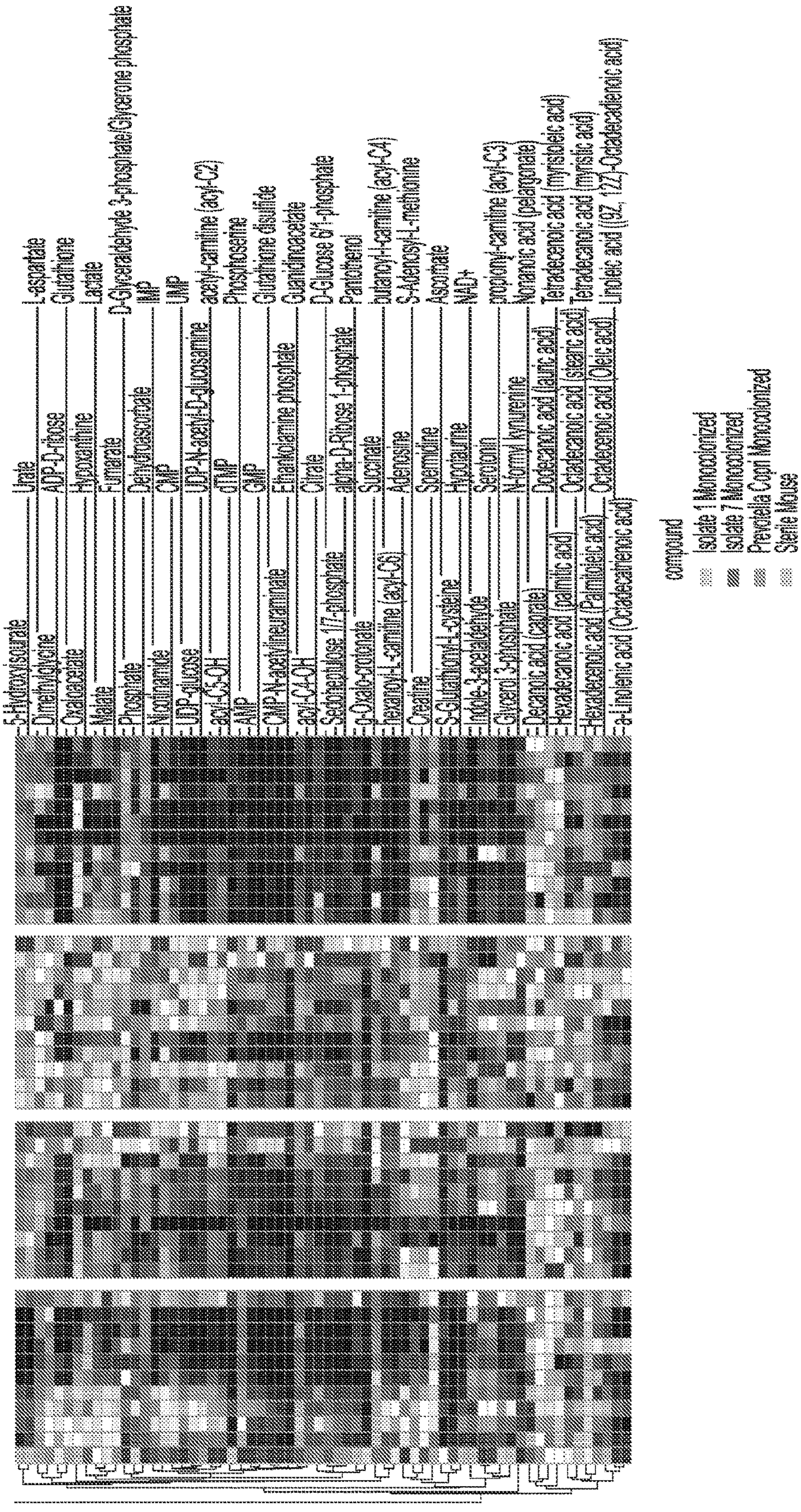

FIG. 8B depicts a heatmap representing relative metabolite abundance from low (blue) to high (red). Columns are individual mice grouped by treatment and rows are specific metabolites. As depicted, the mice mono-colonized with Isolate 7 develop a unique cecal metabolome, characterized by increased indole derivatives.

Figure 8C:
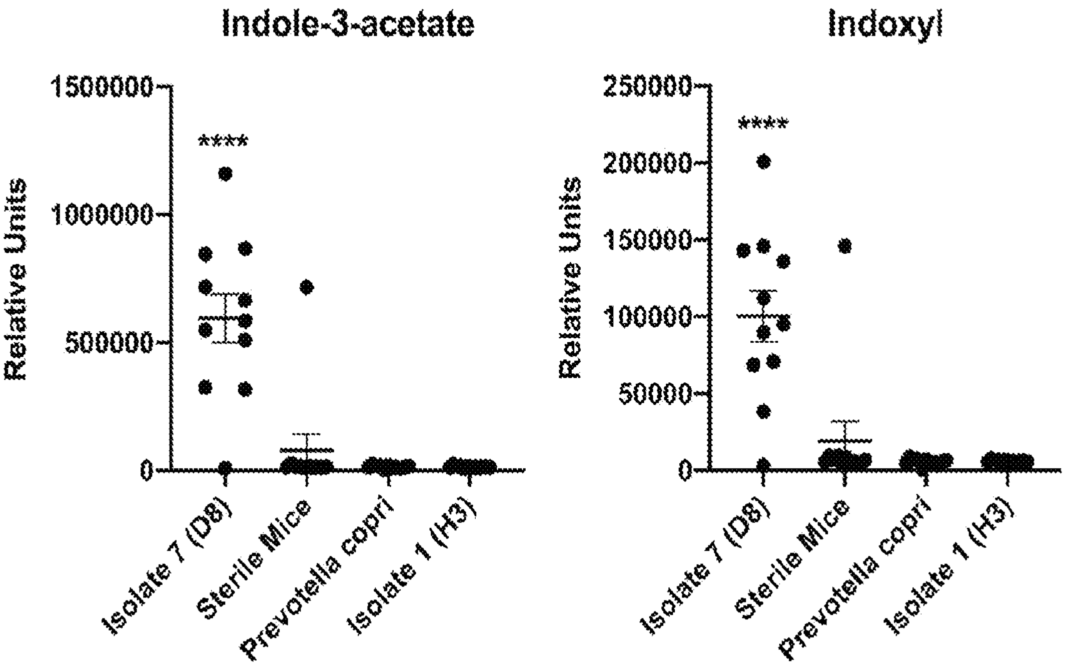
FIG. 8C is a dot plot illustrating relative units of metabolites in the tryptophan-indole pathway (indole-3-acetate), and indoxyl. ****=P<0.0001.

As indicated by the data summarized in FIG. 8C, two bacteria-specific metabolites in the tryptophan-indole pathway—indole-3-acetate and indoxyl—were significantly elevated in the ceca of germ free mice mono-colonized with isolate 7 compared to the other 3 groups. The relative value of each metabolite for each mouse is shown, with bars as mean±SEM (****=P<0.0001 by ANOVA).

Experimental Example 9

Figure 9A:
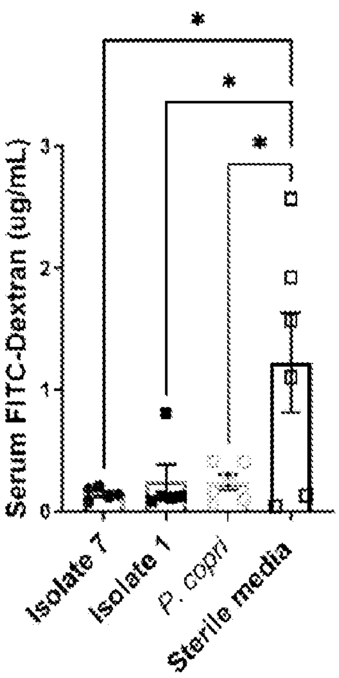
FIGS. 9A-9D (MS 5A) depict data indicated that *Subdoligranulum* strain 7 causes development of isolated lymphoid follicles in gut characterized by increased mucosal IgA and Th17 skewing in mucosal lymphoid tissues.
Figure 9B:
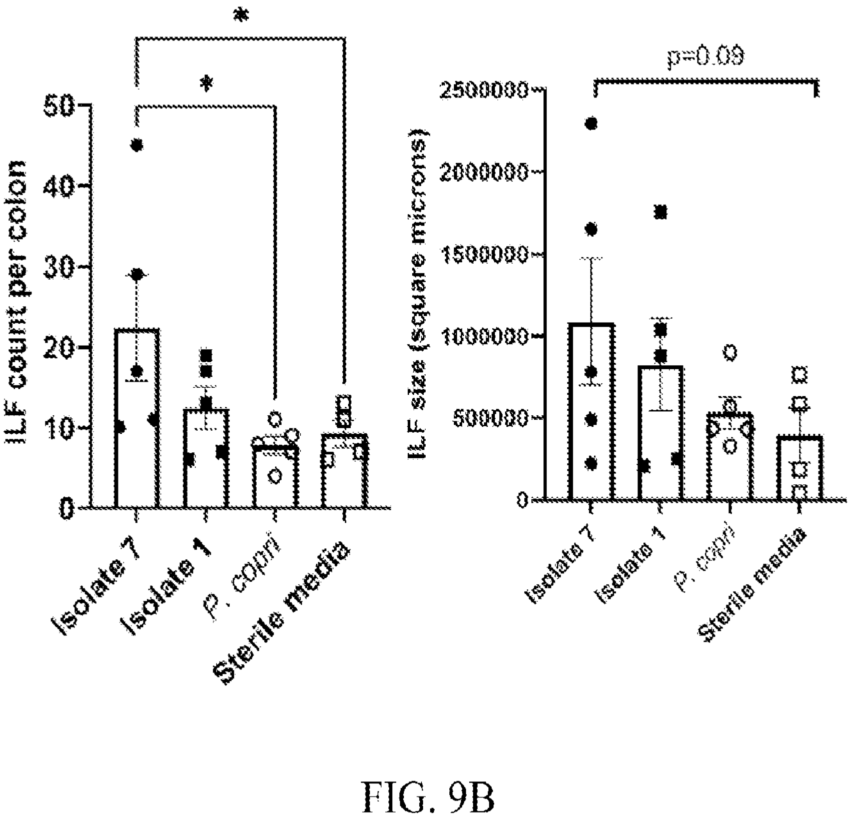
Figure 9C:
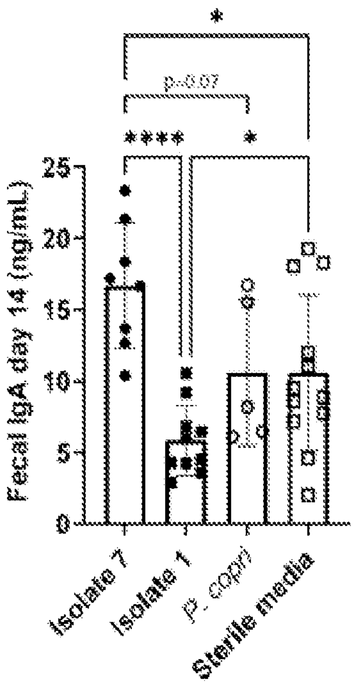
Figure 9D:
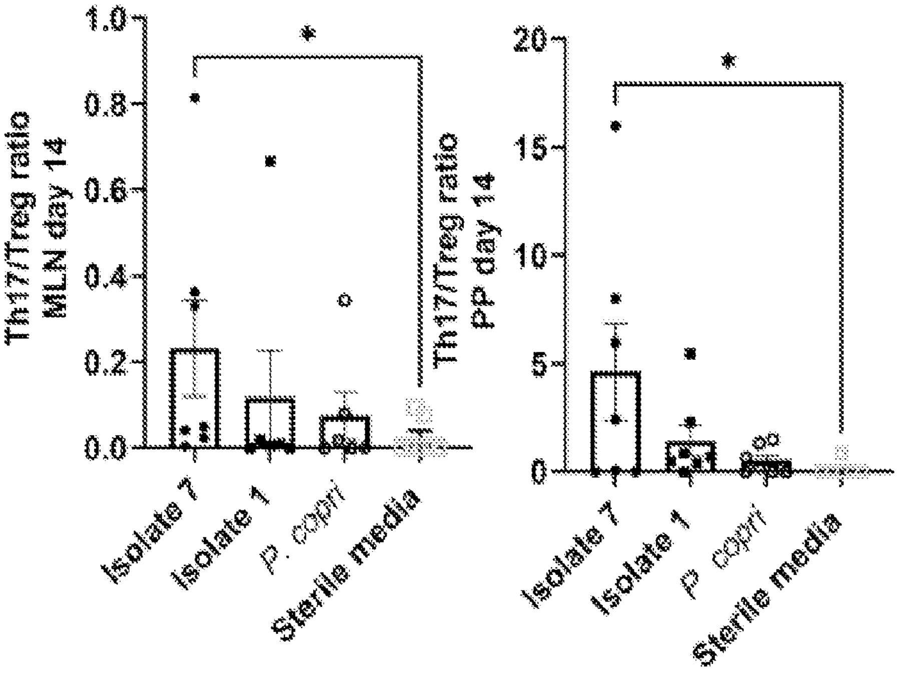

The effects of *Subdoligranulum* isolate 7 on intestinal mucosal immunity was investigated as follows. To determine if isolate 7 relative to isolate 1, *P. copri*, or sterile media affected intestinal permeability, FITC-dextran was administered orally to mice four hours prior to euthanasia, at which time sera was collected and the levels of FITC-dextran measured. All three mono-colonizations resulted in improved barrier compared to sterile media gavaged mice (FIG. 9A), indicating that the two *Subdoligranulum* isolates, as well as *P. copri*, were capable of at least partially restoring the barrier defect of germ free mice. Examination of the intestinal histology of mice from the four treatment groups revealed an increased number and of isolated lymphoid follicles (ILFs) in isolate 7 colonized mice as compared to *P. copri* and isolate 1 colonized mice, and a trend towards increased ILF size in isolate 7 gavaged mice (p=0.09 compared to sterile media gavaged mice) (FIG. 9B), without change of colonic crypt depth or small intestinal villus morphology among isolate 7 gavaged mice. Interestingly, there is an increase in villus width and crypt depth among isolate 1 gavaged mice which could suggest an mild injurious intestinal effect among mice gavaged with this strain. The ILFs in isolate 7 colonized mice were larger and more numerous as compared with other groups, and more closely resembled classical mature ILF morphology (FIG. 9B), suggesting increased mucosal IgA generation. Indeed, luminal IgA secretion was significantly increased in isolate 7 colonized mice as compared to the other treatment groups (FIG. 9C), although similar to the serum, this difference resolved by day 35. There was no significant difference in fecal IgG among groups. In associated mucosal lymphoid tissues mesenteric lymph nodes (MLNs) and Peyer's patches (PPs), the ratio of Th17/Treg T cell subsets increased significantly in the isolate 7 mono-colonized mice compared to sterile media gavaged mice at day 14 following gavage (FIG. 9D), although the percentages and absolute numbers were not significantly different. Collectively, these observations suggest that *Subdoligranulum* isolate 7 stimulates a robust intestinal immune response characterized by the formation of ILFs functioning to secrete IgA.

Experimental Example 10

Figure 10A:
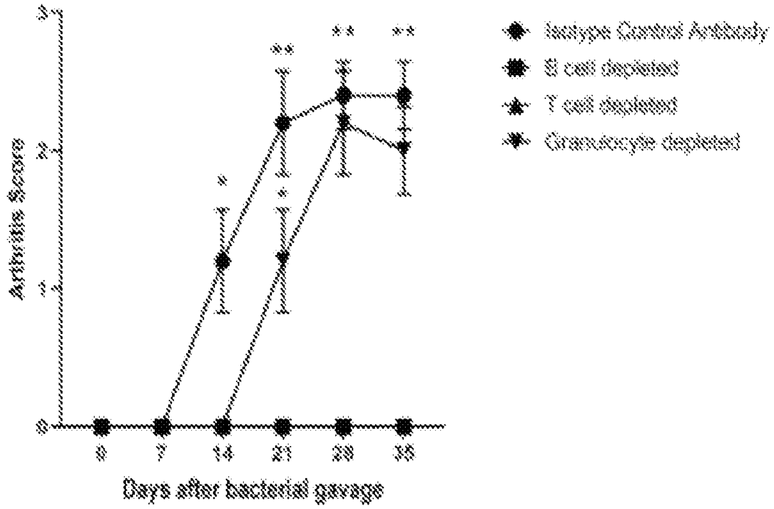
FIG. 10A-10G depict data from mice selectively deleted of their B cell, CD4+ T cell, or Neutrophil compartments (through IP administration of a depleting antibody) and monocolonized with isolate 7 forty-eight (48) hours after depletion of the targeted cell compartment.
Figure 10B:
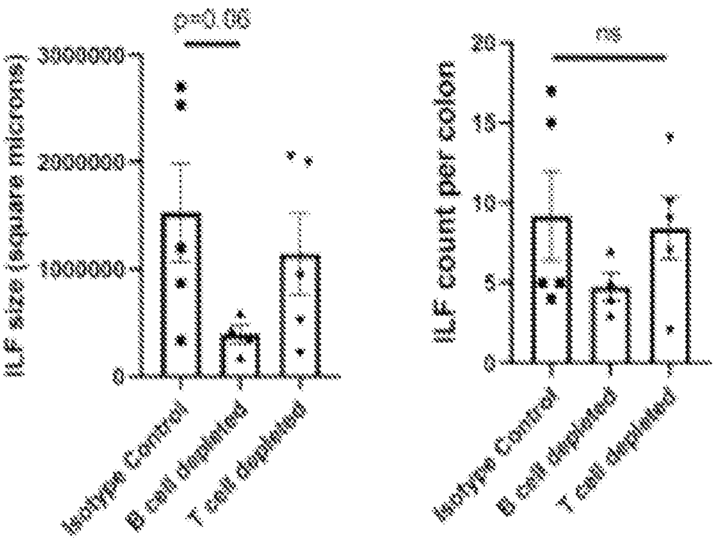
Figure 10C:
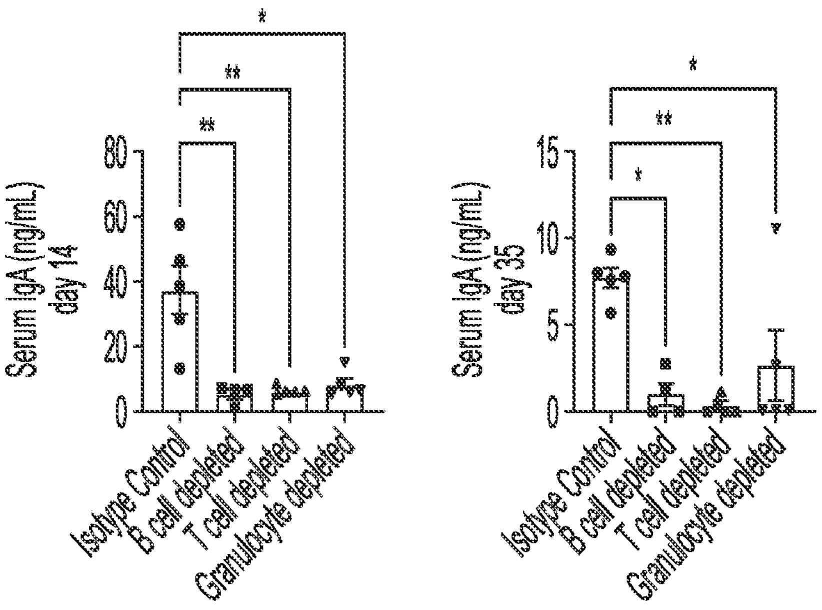
Figure 10D:
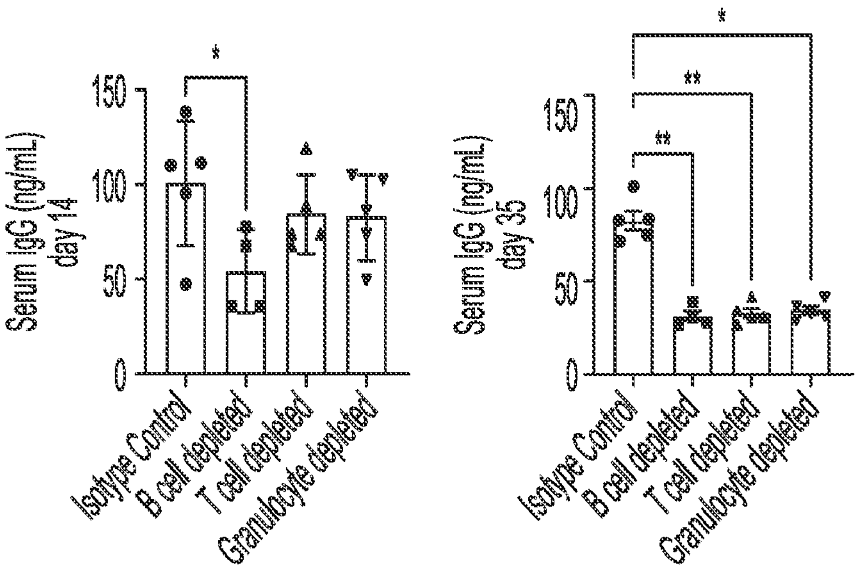
Figure 10E:
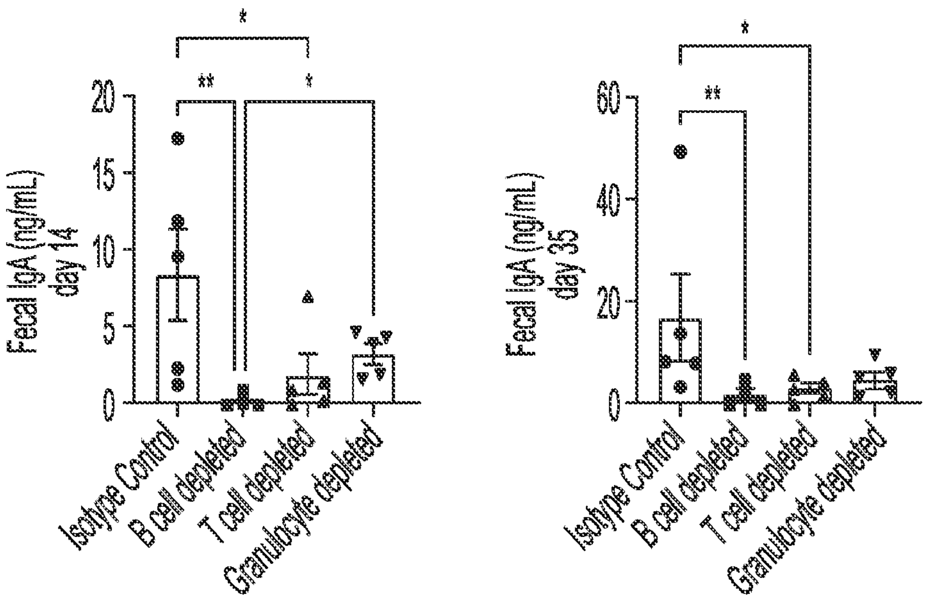
Figure 10F:
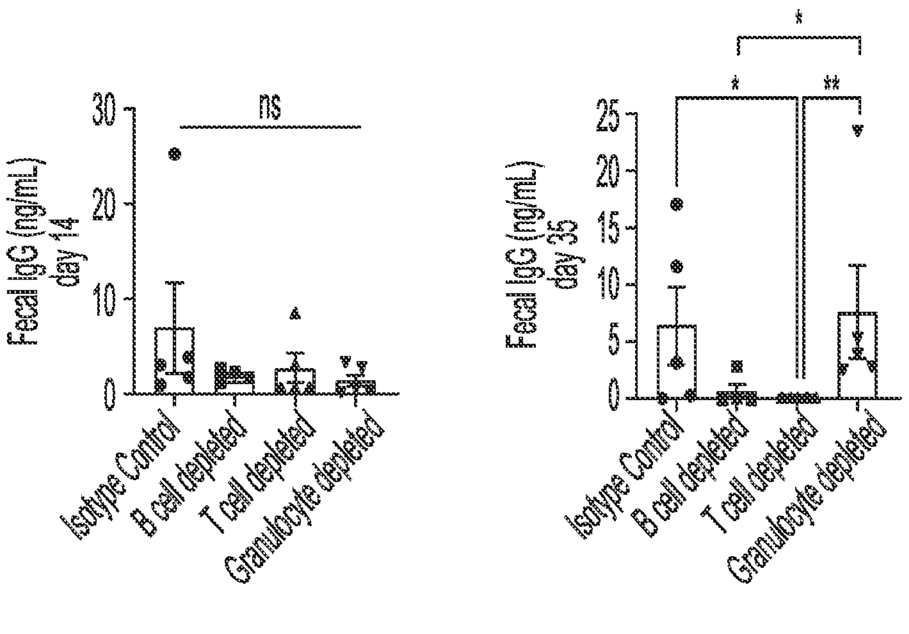

Joint Swelling in *Subdoligranulum* Isolate 7 Colonized Mice is Dependent on T and B Cells but not Granulocytes To determine if the observed paw swelling was truly mediated by adaptive immunity, B cells, T cells, or granulocytes were selectively depleted by using depleting mAbs two days prior to mono-colonizing mice with isolate 7. The mice that were depleted of T or B cells did not develop swelling, while control antibody treated mice did (FIG. 10A), indicating that adaptive immunity is required for the development of paw swelling. Though mice depleted of granulocytes developed paw swelling equal to treatment with control antibody, the onset of swelling was delayed by about one week (FIG. 10A), suggesting that while granulocytes aid in the phenotype, they are not essential. ILFs were not reduced in size or number in the T cell depleted mice, though they are reduced in size in the B cell depleted mice (p=0.06, FIG. 10B). In addition to reduced paw swelling and intestinal ILF formation, circulating and fecal IgA was decreased in the B and T cell depleted mice at days 14 and 35 after bacterial gavage, and circulating and fecal IgG was decreased at day 35 after bacterial gavage (FIG. 10C-10F). These data suggest a T cell dependent antibody response that occurs in response to this bacterial gavage. Interestingly, circulating IgG and IgA is also depleted in the granulocyte depleted mice, suggesting that granulocyte-dependent Ig synthesis at the mucosal surface that then spreads systemically may be important in this model of disease.

Figure 10G:
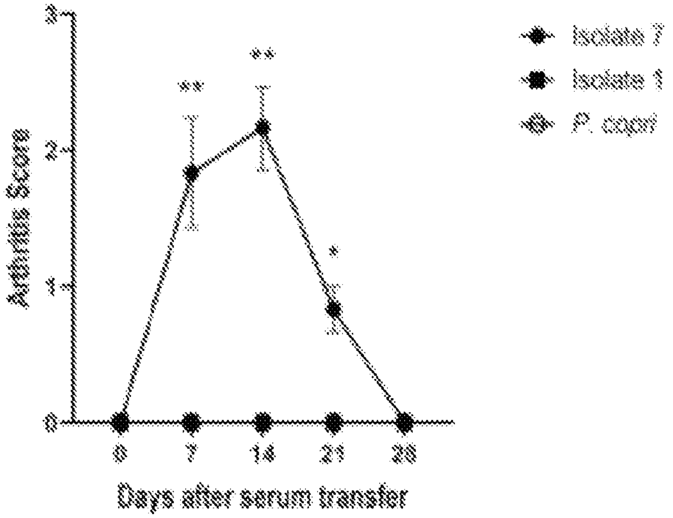

Since the isolate 7 colonized mice develop serum autoantibodies to RA-relevant antigens, the serum antibodies were assayed to determine if they were pathogenic. Serum was collected from mice 35 days after colonization with isolate 1, isolate 7, or *P. copri* mono-colonized mice and pooled by colonization group. Intraperitoneal injection of serum from isolate 7-colonized mice into healthy germ-free DBA/1 mice resulted in paw swelling observed within days and, similar to other serum transfer studies, resolves by 28 days following transfer, whereas sera from isolate 1 and *P. copri* colonized mice were unable to stimulate this phenotype (FIG. 10G). Taken together, these findings support a potential mechanism for *Subdoligranulum* isolate 7 inciting B cell autoimmunity through a local intestinal to systemic immune response.

SEQUENCE LISTING (194 sequences)

SEQ ID NO: 1 - DNA, 2507387 bp, Subdoligranulum sp.
  misc_feature (1)..(2507387): Subdoligranulum didolesgii strain H3
tgcgaagtacgccgcgtaaggcgcgcagtcgcggaaaacttgtaattagaaaggtttataacaaactattctaaatatattcacgctttgcgtgagatggtagttcacctaacgaggcagacgacttctgccctaccgatgttcactataaacactgtatatacggaaataattgaaaatgaaacaataaagtgcatagaaaagttgaggtatataataaaccaaggcgacgatcggtagccgaactgagaggttgatcggccacattgggactgagacacggcccagactcctacgggaggcagcagtgggggatcttgcgcaatgggggaaaccctgacgcagcaacgccgcgtgaaggaagaaggccttcgggttgtaaacttctttaagtgtggaagataatgacggttgtaggtttattaatacaaagtgatttgtatcacacacactttaaaaaagtgtggtcacagccctccgaagcttgctaaatcacattttttataagaaatttttaggaattaatatcttcaaaacagtattttttggtgaacatcggtagggtgtgcgtaagcacaccgcgttaggtgagcaaccatctcacgcgaagcgcgaacatacttataacatttgacataatccttttataaaatctattccgagactgcgcgtctaaagaagcttgcaaatcacatttttaaataattatttaatatacgatgtttataatgaataccgtcagggttgtgaccacatttgtatataatttttatttatttttattatacataattttaatttttctgtccgttttaacctttccatagccggctcgttgaaactgagaaaactaatgtacaaaataaaaactgatgaagcagttaaacgcttcatcagtttttttatagttatttatttgattctaaagcctggtcaagccaaaacattccaatatcaaaagctttatataatccgtcgcgctctgcctggcgaatcagctttgaagcttttccctcgttggtcttaagctctattataacccttttggatattgataagtccatcaagtcctcgctgtcttcaagacggaaggtaactatatatggttcatcaggattgccgtagtatatctcgttgcctactctgacaagtttcttgcctttgtaatcaagatattcgttgccggtttcctgaaccttcttttttgttgttttctttttaggctttacatccgtctttttctcttcattttctttattggtagcagctgccattaacataacctacctttctatattttgatctcttccggggcctacaccgatagaagtaatcttacagcctattaattcttcaactctaagaatatacttctttgcggcttcaggcaatttgtcaaactctttaatattgctgatgtcctctttccagccatccatttcctcatatacaggcttgcactctgcaagctcttcaagagttggagggaagtctttggttatttcaccgtttttgtcatacgcaacacaaagtttgattttgtcaagaccgccgagagggtcaattttattaaatacaattgaggtcagcgagcttgtgcgaaccgcatacctggctataacagcgtcaaaccatcctgtgcggcgcggacgtccggttgttgttccaaactcaaatcccttttgtcttatagcttcgcctaccgcatcgtcaagctctgtcggaaacggtccgtttcctacccttgttgtgtagccttttagtattccgatacactcgtctatagctttcgggccgataccgctgccgacgcatacgccgccggaaatcggatgtgatgaagtgacatagggatatgttccgatatcaatgtcaagaagtataccctgagcgccttcaaacaatacttctttgtcgctttcaacagcttcataaagtattggtatagtatcgcatacataaccgcggagcctgtcagcatactcgttatattcgtttataatagcgtctgcgtcaagaggtgttcccccataaacgagctctatcatcttgttttttatagccagattttctctaaccttttcactgaatttttctttgtcaataaggtcgctcatacggataccgcatctttcggctttatccatataacatggtccgataccctttttggtggtgccaatatcgcctttaccgcgggcaatctctgacaaaccgtcaagttcaatatgatacggcatgataacatgagccctggaatctatcattaggtttttggtgctgattcctttagactcaaacccgtcaatctcctcaagcaaaaccttagggtcaacaacgacgccgcatccgataatattaagagtatccggataaagtattcctgacggcataacatgaagcttatatgtaacatcgtcaacctttaacgtatgacccgcattgttgccgcctgaagttctgacaacgacgtcagcctttccggccagtatatcaattgtctttcccttgccttcgtctccccattgggcaccaatcacgacttttgttggcataataatcactccttgaataattaagggctgagagatggagaataaaaatccggctctttgctcttatttagtaaaactgttgctgagtaagcacacaaagatataataacagaaagtgtcaataaatgcaagttttatttttcaaacagtttatttataagtgtgtacccgttttcattaaatataccggtctttttggcttcttcttcagtatatcttgaacatccgctgtcgataatcttatttttgctggaatacaaaagataaggaataggctctgaagaatgcgttctggtggcaagaggcgtagggtggtcaggcataacaaggatagaaaaatcttcgccgctgttaaccaaataatccaaaacaggcgcgactatcttttggtcaataagttcaatagctttaaccttgttttctatctcatgacggtgtccggcttcatcaggagcttcaagatgaatatacacgaaatcattatcgcctttaagggcgttaattgcggcttctgctttgccgtcaaagtttgtgtttacatttcctgttgcgccttcaacctctaaaacgtcaagtccggcacagtaacctatacccttaataaggtcaaccgccgagactaccgcgccttttattccaaatctttccttgtatgtgtcaaggtttggcttggttccgtttccccatatccaaatggagtttgcagggtgcaatcctcttgcttctctttctttattaatagggtggtcttttaaaatatcataactttttttcattaaattaagtatggtctcatcctttggcagatattcaccgattacccggtcggatatgtcatgcggtggggtaaggctgaaattattctctttattgtgccaaaccatcaggtgcctgtaactgaatccgccgaaaaactcgtattcgtcacagccaagtttttcattgacgtattttataagctctcgggcttcatcagtagaaatttcgtctgagctgtagtcaaccattactttatcttcgtaattctccgcgtccgataatgtaacaagattggttctgaatgtggtatcagtgagttcaagcggaacgttcatagatacagcctccagcggagaacgccctgtatagtatttttgagggtcgtatccaaatactgctagattcgcaacatcgcttccgggaggaagattactcgggaccgttttaaccataccgacttcgctgtgccttgcaaggctatcgatagtaggtttatttgcagtttcaagcggcgtctgtccgttaagctccttaacaggtgtgtcagccgctccgtctgccaaaacaacaacatatttcattttatcacctcatatatttatcgtttaaacaacattttatttttaattgccgccctgggataaccaaagcgatactaaataattataccgctagccgtttgttatgtcaagggcaaagcccggagacagactgatattaaaaatacaaagcgtccgaagtttataatccggacgctttaaattttaattaggagaaaatcaaatacagtattgtaaattaacaaataattctaattataaatcaataaataattctagcggctgccgccgtttattctttttagttcactaaccaaatattcgtatcggctcattgttttttggatatcatatatacatacgtctattagtttgtcttcacaaataaaatcaaagttgttctgacagcgtctaaaatcgtccaaagcgtcgagagcttcagccctaagtcttgaatacgccgcctgctcatgttttaaaatttttttgtcgggcttgactttaaccgagctgtttgcttttaccattccgtttgcggttacggctgctgtttttgcgtggctcatatttatattttcctccttacatagttgtttaatctagttttcccgaaacgccaaacttttataaaatatttttatattgttcataaattatttagacatttatgaaaacttgtgctataatattgaaataaagtaaaagtatttatactataaattttatagatacttaaaatttgattagaattaaatgcggaggtgtttgttatggaaagtaaacccaaaattttaatagtagacgatgaggaaaacatatgtgagcttgtgcgtctatatatcgaaaaggaaggctttgacgccattatagccaatgacggacaagaagccgtggcgaaatttaataaggagaaaccggatttaattcttctcgatattatgctgccaataaaggatggctggcaggtatgccgtgaaatcagagcgcagagtaaggttccgataattatgcttactgccaaaggcgagacttttgataaggtcttgggtctcgaacttggcgcggatgattatgtggtcaagccttttgagccgaaggagcttatagccagaataagagcggttctcagaagaagcgcagactcagttgatgagaaagcggacgaggacgagctgagttttgacggtttgaaaataaaccagtctacttatgaagtttatatcgacgacaaaaaggttgagatgccgcctaaggagtttgaacttttatattttctcgctaaaaataccaataaggtattcacaagggaccagctcctcgacgagatatggggctatgagttctttggggattccagaacagttgatgttcatataaagcgtatcagggagaaacttgagggtgaaaacagaacctgggcgctgaaaacggtttggggagtaggatataaatttgaggtgagctaattgtttggcaaaactatattttcaagagtattgttcacaaatttatctacggttcttatcggaataatcattttggcgtcgcttcaaatggttctgatgagcaactatatttcaaaacaaaacgagagcacactcgccaaaaatgctgaatcgatagtgagtttaataaacaacggcatatcgcaggagaatctgaactcggttttaaatggtttttccaggagcagcagcagtcatattataatcacggacgttgacggcagggtgatagttaacactactgaaagcggttactgggcgaacgagtcaagagaatcattagagctagatcatctgcgtgaggtattgtccggcaagcgtgtaaccgttgtaggaaccatgaacggcgctttcaatgaaacgatgttcaccctggaagttcctgttataagaggagaaaacaaagcggtttatggcgctgtgctggtaagcacgccgataccgcaaaggaggagcatgctttttgagctgtttaaaatccttttattttcggctattgtggttatagtggtttcgtttattctttcttatatgctttccaggattttggctaacccaataaaaagagtcagtaagagcgccagcgactttgccggcggtgatttaacatcacgagttgctatagacagggtggacgagaacgtgacggagataacagaacttgctgacgcgttcaataacatggctgacgaacttgaaaagtctgaggatataagaatgagttttatttccgatgtttctcatgaactcagaacccctatgacaaccataggcggatttattgacggtattttagacgatactataccgcctgagaagcagaaggagtatttgagcattgtcaaagatgaggtgacgaggctgtccagactggttaatactttcttggatataacaagaatgcagtcggataaggtgaatatcgtaaaatcagattttgatataaatgaggttatccgccttattataatcggtctcggtcctaaaatagataagaaaaacttaaatattgatttggtttttgataatgatgtttgttatgtccgagccgacgctgataagataaaaatggttataacaaatcttatagataacgcaataaagttcacttatgaccgtggaacaataacaataaccacatgtcctaaaggcagcgaagtgtttatatcagttcataataccggtgtgggaataccagaagaacagcaaaaaattatatttgaaagattatacaaggtggataagtccagaagtataaacaaagagggcaccggcataggtctttatattgtaaagagtatgctcggcgcccacggcaaggatataaaggtaaagagtgttgaaggcgagtatgcagagttcagtttttgccttgacaggggaaaaccaactgtcaaaggaggagtaaaaccgatactgcctgacaataagataaaataaaaataagccggacaatatgtccggcttttattttatataaaaattaaaatcgataaaaacttgcaagtctggctgacagtaatgtccgaatgagacgtccgacagaggcgtctgaccgagaagcttgagcgaggcgcctgaccaaggtgactgacagagatgtttgcatgaggttcctgaccgaggtgaccgacaaagatgtttgcataaggttcctgacagaactgtttgacctagctgtttgactgaaattattaactgaaatgtctgagcaatagaagtatataattaattatccaaacagcaaacactaaattacataaccagtcctccgtcaacatgtatgatagttccggttgtaaatgtcgaatcatcagaggcaagatatacataggcgccggcaagctcgttcggttccgccgcccgtccgagaggtgtaatccggcgcataccttccatcatttggtcgtttaccgaatgggctaccatatcggttaataccacgccaggcgctactgcgttaacccggatattatactgaccgagttctttggcgcatgatttggttagaccgtttatgccaaattttgaggatgagtaagctgtctgcatcttgccgccgtaactgccgaccatagaactggtgtttatgatactgccgccgccgtgctctttcataacagcggcaacttctcttatgcacttgaacggacctgataggtttatccttataaccgaatcaaaatcttcatctgacatttcaaatatatgttttgctgaggtcacccctgcgttattcaccaatatatctattttgtcccactgtgctaaaacggttttaaccatttcagctatagaatcactgctggaaatatcaacgcctacaggaatcagttccgcttccgggaatgattcttttagtttatcaactgctttttgtgcagaagatacccggcttccgcacaccgcaactttggctccctctctcacgaaagcctctgcaacggcaaaacctatacctcttgacgcccctgttataatagctgttttatctttaagtttcattttaataatctcctttttaatatattttaattattatttaacaatgataataaacttcaaaaattttttccgtaagtaatttatataaactttttatacatttaaaataatagcaaacttaacgtttattgcaaacagtttaattgatttgaattaaaataatatgtctggaaacagtgtaaaaattaaattttatttaaaatattttcttatatatgaggtttttagtaaacatcgcaaggatgtggtcacagttgcatcacggtgatgcttactacaccgcattttatataacttttaaatattttcttatatgcggagttttttagtgaacatcggaaggacgcgcttgcgcgtctcgttaggtgagcagacatctcacgcgtagcgttgtatgtgatattatggtgatataactataacacaatttatgagttttccgtattctttttttctatttgtaacacatctattgtaatcctacatcaaatagattattggacataattgtttattgattttaatgcaaactgagtgtataatggtatttgaattgaataagaataaaaaatttttttgaaagcaggatgtttatatggtcaatgctgataacaatctttacaatgagtttttggaaattgttgaggatttgatttatacacccgagtttagaaaattagacgagtgcagtcatcattacggcgtgagcaggatgcagcactgtataaatgtagcatattatagttttgttgtttgcaagaagttaaagcttgattacgttgccgctgccagggcaggattgcttcatgatttgttttactacgattggcaggggtcagggctaggagttgcaaagcatgcgtttctgcactccagtatcgctcttgaaaatgctgagcagttaacagaattatcaccgcttgaacgtgatataattaaaaatcacatgtggctgtgcggcaagatgtggccccgtcacagagagagttatattgtttcggtagctgacaaggtttgcgcagtatgggaagccggatatggagttaagtgcaaggtagcctgcgttatggctgagtaaggaatatggttaaggaagatttaaatcaaaagagacatgaaattcagaaagaagaacttgagatttataacttaaatgaaaagatagttgataaaatgtcgggctcggattctgaaaaagttaaaaagaaatttttggtttaccaaatattattttgtctgatggcaattttcagctttttgatattaataaatcagtttcttggaaatataagttacataaagcagccagtgtggctgataattgaagcggctttatggctgatttttctcgctgattatattgttcggctggcggtttccgatgacaaaaagcagttttttacacggaatatattagattttttggctgttctgcctttgcccgggtttagagtttttaggatttttactctgttcaggatgatgtttgccgtgaaaagggtgcttagagcagtacacatagttatgaattcaaacggatttttatatcttttaggggcagttgtggtgtggatgctgataggctccgcatttttgtatcattttgaaaacggtataacgatgaattcatactttgacgcgttatggtgcagtattgtgacggtatgtactgtcggatacggcgacgtggcgcccataactgcaggaggaagagttgttgcagtgctgttgatgatgacaggtataggaagtataggaatggtgaccagcaacattacagcatattttgttgtcagggcaaagaaacgccgtgtagtgattgacaaaaatcaaattttagatttaagcatggtatcaaaggaaaaatatgaaaagattgccgattacgcaaaatatgttctgcagcaggataataaagatatagattagaaaaatataaaattaagttatgagaggagaaaaacttatgaaaaagttaatggcaatagtgctgacaggagttttagcggtgagcgttttggctgcctgtggaaacacggataaggataatgctgaaccaaccaaagcgcctgtatcaaactctgtaaaatctgaagaggataaggcaactgcaaagcccgacactgataagaaaacagattcagacaaggacagcagttcggaggaaggaaatacttccggtgacaaagatgatgttaaggcaaaagccggagacaaagaagatgcggacgcaacagccccccctaaacttcagacagcagatgaagccgctaacgacactactactattgataaagagatagcggatattgaacagctgattattgacggaaactatgacgacgcgttaatgcagattaaggctcttaacacaaaaaatctaactgacgcggaaaaagagaaagttcaggagtattacgagaaaatagaagattatatttcaaacggacttactgactagcaataaccaatgaggctgtaaaaaattataatccagccgtaatatagaataataaatcataaaaagaccattgtattagactataacaagcctcttacaatggtttttttgtaaggatttttatagcgcaattttaattataaacacaattggatttctataaaaagaataaaatatttaaaacattaagtttaagatttaggtagaaatttttatttaaattttaaaatagtttttggttgtaactttttattactagaacttttttaggttgtttttaataagaatatgtgaatgctgcaataaattggatagaaattttaaagtcataatatgataaaaaaatatttaaattatagaaaaatgcggttttgcaagcgtaggtaggtgcgattgtacccccgccttacaggagtgtgttatacaaactgccttgttttcattaactgaaaagtcaataaaagactagacaaaaatttataggtgtttcttggtgaacatcggcagggtgtgcgtaagcacacctcgttaggtgagctgtcatttcacgcgtagcgtgaacatacttataacaagtttgtcgtaatcctttttaataataaattttaaaatttctattcaatttatttcagactatccaaacatgattggatttctgaaaaaggaaagaaaatttataacactggatttcagatttaagcaagatatttagtttattatgttttaaatagaaattgttgggtatactctgattgttaattgaattattattagttatatttattctgtaaataaaataaattcataacaaaaattcagctgaaatatttctatttggctaattaagactaaagaaagaatgtatatgtataataagtatatcatacgtatgtataattaaaaatttgtaactaaatttagcgtaaaatagaatatatttaaattattaagtgatagtattttttgtcgaaattgattttttgggaaatttataaaattttccttgacaagtaacaatggttgtgatacaatctgtacataggtcatgattctcatcctgtgaatcaatgacagaaattttaggaggtattgtaatatgacaggaaaagttaaatggtttaatgcagaaaaaggattcggtttcatcgaaggcgaagacggaaaggacgtattcgttcatttctctgctataactatggatggttacaaaacacttgatgaaggtgttgcagttgagtttgacgttatcgaaggtgctaaaggtccgcaggctgttgacgtaaagcttgcgtagtcttttaatatattttgattgactgaaagattaactaagaaattatagctgctcctgccggggcggctattttttaagatttaaaacaaatgataaagtaaaataaattatagttggaggaatacttatggacaagctgattaaagcgattactaaagatggctttctaagagtacacgcggttgaaactactgaaactgttaacgcagctcaaaaatttcacacgctttccccggtctgctgtgccgctcttggcaggctgatgactgccgggctgatgatgggcgccatgcttaaaggaaaagaaccgtcgctgaccctgcaggttaaaggtgacggcccaatcggaatgatggcgtctgtatctgattctatgggcaatgtgaaaggttactgtgctaatccggttgtggatatttctttgagagaagacggaaagctggatgttggagctgctgttgggcaggggatgcttggggttataaaggatctcaaaatgagagagccgtatattggtcaggttccactccaaaccggagaaatcggggacgatattgctttttattatatgcagtcggagcagactccgagcgttgttgctcttggggtgcttgtggatcgtgattattccgtaaagtgcgccggagggtatattattcaggtgatgccggaatgtgatgacgcgacgcttacaaaacttgaaaattctattcaggggcttatgtctgtaaccgaaatgctggataagggtatgagcgtcgaagaaatgctgaaatatgttatgcttgggtttgatattgagatattggaaaccatggatgttgggtataagtgcgattgttcaaaagagagaatggaaagggcgattgtttctttgggcaaaggtcagattcagagtataattgatgagaccggtgaggctgaaatatgctgtcatttctgcgatagacggtacacattcggagaagaggatttgaaaaaatttcttgaaacggctaaataaatataccttaaatcatttgacaatgaaaaatccttgtgctataatttacctattaatatatgtgaatatatttgcaaatataattttaggaggtttttgaaatgggtatttcagagaagtttacattaaaagataaagttgctctggttacaggcgcttcttatggtattggctatgctattgccagcggatttgccgatatgggcgctaagattgttttctgtgatattaagcaggagttcgtggacaagggtctcgctgcatatagtgccgacgggattgacgctaagggttacgtttgcgacgtaactgacgaagctgctgttcaggaaatggtaaagaaaattgaagcagaagttggcgttattgatattcttgttaataatgctggtataatcaagcgtatccctatgtgcgatatgacagctgaggagttcagacaggttattgatgttgaccttaacgctcctttcattgtgtcaaaggctgttattccaagcatgattaaaaagggtgccggtaagattatcaatatctgttctatgatgagtgagctcggccgtgaaactgtatcagcttatgctgctgctaagggcggacttaagatgcttaccagaaacatttgttcagagtacggcgagtacaatatccagtgtaatggtattgggcccggatatattgctacacctcagactgctccgcttagagagaagcagccggacggttcaagacatccgtttgaccaattcattatctctaagacgcctgctgctcgttggggaaatcctgaagaccttcagggacctgccgctttcttggctagtgaagcttcagattttgttaacggacatattctttatgttgacggcggtatcttggcttacatcggcaaacagccgtaaaccgaaatttgaatattttttgagagacgtttatcgtctctctttttttatgtatggtaatatttcgtttgaaaataaagattgttaaaaaaatatttatttatctaatataaaaataaaaatttgaactcgactgatattataaaatgctgtatactaaaactcatagtgtgtatttttgaaattatgacggaggattgttttatgtttgtgggaaaattaaaaagacgtattgtgaaatcagttcttggattacttgccattatctgtgtggtgtcagttatggcaatgtctgttactgtttcagctgaggagaatttattggcgtttcccggcgctgtaggcggaggaaagtataccacaggagccagaggagatagcaatatttcagtataccatgttacaaatttgaataagagcggagcaggttcatttgctgacgctgtttcacagtcaggcagaattattgtttttgatgtcagcggaacgattgaaatcagcggaacgctgaaaattaagaaaagcaatctaactattttaggtcaaacagcgcccggagacggtgtgactatttcaggcggggatttacttcttgacagtggagttgaaaacgtaattataagatatctgcgcgttcgccctactgataaaaacggcggcgaacctgatggtctaggcggaagatataataaaaatataatctttgaccactgcagtctttcatggtcggttgacgagcttattactttatacgccggttcaaccgaggacacaaagaatcagacaggaagaaatattacagttcagaatattatagcttctgaaagcctggctatgtcaagccacgttaaaggcaaacatggatacggcggtatcatcggcggaacgaactatacattttataataacttaatggctcatcacgacagccgttcaccaaggttggacagagagctggggtctactgatattgccaataatataatttataactggggacagacaaattcactttatggagcggaatcatactctatacataataaaacgcaaacgccttcaaatgtaaatatagtcagcaattattatatgtatggaccgagtactaagagcaatctgagaacacgaatttttgacgtttctaatgacgcaaaggttaagccgtactctaatttttatgttaacggcaactatgttttcggaagccagcttgtgacagcagataataaaaaaggtttgaataatagttcgcttgcaactgtattagaatcaccggttgatatgggcgaatattctgtgccttactcaacttctgaggaagcatatgataagattttatctgacgcaggagcttctctgccaaaaagagacgctattgatgcaagaattgttgacgatgttaagcatcagacaggaagaattattaataatgcggatgagatagccgggttgataccgacagaagaaattcacagaacttttgagatacctgaggactggaaagctgaaaacaatatgggcagcgcttctgaaaccgatatagtggaaaatggggaatataagggatatacctggatagaagcatatgtaaatgactggacagccaaagcttctaagcctgctaatcctgagattgtcgttatgtcgccggctattgcgtctgtaaataagacggttaatgggcttactgtaaataatggaaattggactgttgttaaggatactgaaaccgttaattatcatgcggcagctacgccggttcaggggactgaaataacaaaatttgaactttacgataaaaatcaattgctgaaaacttataactcggctgaaattaatgatgatatatctttagagccgggtgtacatcacttgaccagccgtgcttataattctaatggagaaaagacacagagcacaacagctatagtatatgttgtcggaacagccgaacccggaagcttttcatatacgcagataggaaagaactgttctttcaataatctagccagcgcaactatggataataacggtgtttatactatttcgggttccgggcagataactacaaacagctcggataagtgcgcatatatgtataaagaagtcaagggagattttgatattattgtcaaagtaaaggagatacctaagtttgaaaataaacaggtttcgggaattatgcttcgtgagagtttggagccaaactccaggatgcttatgctggctgatggttgggaaaagtacggagaaaatgtaagtgtatttgtcagaaacaaagccggaagttcatcaaccagaagttatttcaaaaatgcttccggaagcgaacttgtaaacggtgataagtacgataccggtgcagccgagtatcacctgcctaagtatttgagaatgaaacgaagcggtgataaacttacaatgtcggtttcggacagcggaatagactttactgataatccgcggcagcctatgagttttacaattgacggtctatctgatactgtttatttaggaattgcgaatgattccactcagggaacaagtgttaaggaatattactcaatggcaaaatatagtgatatttctattaacggcgtcagcgatgttcagagtcaggagtctaaggttcctttccttgatgaagagtttgatttagatacttggtatggcgaatatgtttttaacgatgataaaaggtcagaaccaatatcaggaaacagcggttaccttttgtcaacttggtcaaacgccaacaggaattttactgctcagtcaaaaggtatagtaaccgcgtcatttgacttcttagaatatggagataacaataaaataggcagcgctgaatttattttgagaggaacaaatgcggataatgaacttaaagagatgataaaagttatagctgagagagaccaaacatttaaaataggcgataaatctatcggtgatttagttcttgatatggatgtttggtataatgtcagcattgaattgaatttctttaccgggaaggcaaaggtttctgtatatccttatacggagtatgacagcacagaaggaaaatatattctatctgaaaatggggctgaggccgagactgattttgataaatcttatttattgagaggaatacgctttgttagaaacggcggaacaatgaagtattatgataatgtttccgtcagcgctgaaaggaatgaatcgtacgttaaagagaataatggcaaaatggatgtatttgctatggaagatgcaaaaatgtatgtggcttggtatgataaggatggagttttgataaatgctgagacttatgatatacctcagaataaggaaatggagtttgacttgccaaaattgactaacggtgtttcagagaaagcggaagttttcctttggaataataatcaggagccgttatgtgagcagttgactgtagagtaagtaatataatatttatagaattgaagtgctgataatgaaaactaagttaaaaatttgtgctgctgcactgctggcgtcggttgcgataggcgcaacagtatatgctgctaatttgacaaagaaaatagacgtcctttatgatgatataagaatatcgtcaaataatattgagtttatgccggttgatgagcagggcagtcaggtggaaccttttatttatgagggaaccacatatctgccggttcgcgctgtttcggaagctttaggtaaaaatgtttcatgggacagtgagacaaaaactgttatggtaactgataatgaagatattgaatattctaaaatagcaatcagaaacttttttaaattgttttctgaaaaacggtatgatgaaatgaaaaattttacttcaggctcagttgccggatatgagttttcagaaggagttttcggaatgaaggaagcttctttggacggtataatttatgcaggaaataaagaacttgaaaatgaaaataaatttgcttttatttgtcattttaatatgacgcctgctgagaaatcagtatatggcagcagtgaaagggaaatcggattttttgtagaggtattaaaagacagagatgaatataaaataaatgatttttataccggtctgtaatttagaaagatataataaacaaagccgcgcggataagtttcgtgcggtttttttaatattttttgtttaaattattgagtattataagaaaagcgtacgtttaacaaatttaatacaggcgatgataatttattattgttatcgtgtccgtactgcagtttagttaatatatagttggtaatcaaaatttattcgaaccgattaatatgctgcagtctgtatcacagaataacatattttattatattgaatattaatgtttcttaaatcgttacaaatgaatcagaccattatttaaaattgcatagtataatcaagataaaacactaatatcttgatttattaatattttaataccaaacttaattattaatttatattttgaatttaagtaagattgttcaataataaatgaatcgaattttatataatacagggagccatttcttgtaaatattcttgttatattttcttttgcttgcattgtcaactaatagcaaatttatggttgacaataattcttgagtatgttataatttggaaaacatttaaggaggaagtaatatgaaaagtaacacattaactattagaaaaatgacgttttgcgcaatatttacagcgctgattgcggtaggagcttttataaaaattccggtgccgccaataccgtttacacttcaaacaatgttcgtagttcttgccggactaatgcttggcgggaatatgggcggcatcagtgctttgttatatatgattttaggtcttataggaatcccgatttttaccggtggcggtggaataggttatgttcttaaacctacgtttggctacataattggattttgtgttggcgcatatgcaattggaaaaatcagttataaaaatggtaagctgggcggatatgccagaatgttctgcggagttttagccggattgggaattatatatggctttggtataatctactattactttataacaaattttgttacttcaagttatccgggcttttggtttatgatactgcattgtttccttatgacaattcccggtgatttaattacttgtgctttagcttgtttgctggcaaagagagtgcatccggttaccggcagatacatatataaaaatgcttaacttaaaaattatcacaattaaataaaactaaggcttgtggaatataacccatgagccattttttaataattaaaaagcatataaaaatttatttattagaccgataaaatatacgttttttcggaagttttacaagtaaaaaaatggtagctataaattttttctttaatttttttattgtgattttacacagaaaatttgtcaattttttggttattttaacataagttaaaaaattatgtagaatgttaaaattttatcagtctgactcttgacattaaaaaatatcatgatattattatatttggatttcactggttgtttgaaatatattattaaattatatttttgatacaaactgtgaatgtaaaacatagaaaataactgaaaaacaattacttattataaagacattttaggaggtataatatgtctaacacaaaagagtgcgataagttcctttcacaagagtatttggaaaagatggacgcttattggcgcgcaacaaactatttggccgcaggtcagctttatcttcttgataaccctcttctccgcgagccgcttacaatggaacacataaagaaaaaaatagtaggtcactggggtactgttccgggtcaaaactttgtttatactcatttaaaccgagttattaaaaagtatgatcttgatatgatttatatttcaggacctggacacggcggtaactttatggttgccaatacatatcttgaaggttcttacagcgaaatttatccaaatatcagccgtgatactgaaggaatgcagaaattgtttaaacagttctctttcccgggcggtatatccagccatgttgctcctgaaactcctggatcaatcaatgagggcggagagcttggatattcactggctcatagctttggagctgtttttgataatcctgatttaattaccgcttgtgtagttggagacggtgaggccgaaacaggacctttggcaactgcatggcagtcaaataagttcttgaatcctgttacagacggtgcagttctgcctattatgcaccttaacggatataagatcagcaacccgactattttctcacgtatttcacatgaggaaatacaaaagttcttcgaaggctgcggttggaaaccgatttttgttgagggcgacgacccgatgacaatgcacaagcttatggctgaggctcttgattctgcaattgaagagataaaagaaatacaaaagaatgcaagagaaaataatgacagcacgcgtccgatttggcctatgatagttcttagaactcctaagggctggactggaccgaaagaggttgacggacagaagattgaaggttcgttccgtgcgcatcaggttccaatcactatggagaaacctgaacatcttgatcttcttaaagaatggcttctcagctataagccggaagaactctttgatgaaaacggacgtcttatacccgaactagaggaacttactccggacggtgacagacgtatgggagcaaacccgcatgctaacggcggtttattgctgcgtgaccttcgtatgcctgatttcagagaatatgcttttgatgttccaaaaccgggcgctgtagaagctcaggatatgatagaactcggaaagtttgttcgtgatatatttaaactcaatgaagatagtaaaaacttccgtatttttggccctgatgaaacaatgtcaaaccgtcttggcgctgtgtttgaggagacgaaccgtgactggaatgctgaaaagctggaatctgacgagttcctggcaagcaacggaagagttatggactcaatgctcagcgagcacatgtgcgaaggctggcttgaaggatatttgctcaccggacgtcatggattctttgcaagctatgaggcgtttataagaatagtcgattcgatgttctcacagcacgctaaatggctcaaggttacatctgagcttccgtggagacagaagattgcgtctcttaactatatcttgtcatcaaacgtttggcagcaggatcacaatggatttactcatcaggatccgggatttttggaccatgttacgaataaaaaggctgatgttgtacgcatgtatctcccgccggatacaaactgcttactttcatgttttgaccactgtatcagaagccgtaattatgtaaacgttatggtaacgtcaaagcatcctcgtccgcagtggctcactatggaccaggctgttaagcattgtacacagggtatcggtatttgggactgggcaagcaacgagcagggggacgaacctgacgttgttatcgcatgctgtggtgatacaccgactttggaagctttagccgcagtaacaatactccgtgagaatatgccggaaataaagattagatttattaatgttgttgacttgatgaagcttcagtcacatgataaacatcctcacggattgacagatacagagtttgatacattgtttacaaaggataaaccgataatattcgctttccatggatatccgactcttatccatgagctgctttatcatcgccgcaaccgtgacttatatgtttgcggatatcaggaggaaggaacaatcacaactccgtttgatatgcgcgttcaaaatgaaatcgacagattccatttggttcagcaggtaatttatcatctgcctcagcttggcaacagaggagcttacttggttcagaagatgaatgataaaattgttgaacacaagcagtacattgcagaatacggtgaagatttaccggaaatcagagactggaaatggtctgaataaaatttataagttgaaataaaggctggatattccggcctttatttttttgtaatcggaaataactctggcagcatatttgaagcttaatgagttttacaattataagaagataagttacttgtaagtataaaatattaagattattttgatgtttgaaaatattttgttttaagttattgaatttatagtataaatcaagtatactcatatcaagggaggaaaaatagatgacggacaataattttaagataaatattacttctgaaaaaggcgttaatattcaacccaacatgtatggattattttttgaagatattaactatgcggcagacggcggaatatatgccgaaatgatagaaaaccgttcttttgaacagataatgcacaacgactgtgatggaggtacaaaggaaacttatagaagcccaggatatgcctggagcgctgtcgacggcgttatgcattacaagacagagaatgggttaaatgaaataaaccctcattaccttgagttttccggacgcaagtttaagaataaggcctatgaaggtatgtatgttgaagccggaaaaagttataaagtatcattctacgccaaagcagacacatataatggaacggtatctgcttcggcggtaaataatggaattgttgctttcagtggaataatagcagagaacgtcacaggtgaatggaagaagtacgaatcaatattgactgcggaagtcagtatacgatacggtgactttgtgatttctttagaagatgtcggaacggtttgctttgacatgatttctgtaatcccttgtgacgctgtgtgcggagtgttcaggcgtgacctggcggaaatgcttaaagagatgaagccggggtttctcaggtttccaggaggctgtgttatagagggatgggatattgaaaatcggtatcaatggaaacatacagtaggtcctgctcaggagcgaactcaaaattggaataggtgggctgtatctaaacggccaaaatatttagattataatcaaacatatggtcttggattttatgaatattttctgctgtgtgagtatcttgagtgcgaccctttgcctgttttaaatgttgggctttcgtgtcaatatcagggaaaagaaacggttccggtttatgctgaggattctgagaaagatataggtgtggagataaacggtgttatatacacaacagaattttaccagtatatacaagacgctcttgaccttattgagttttgcaacggcgatgaaagcacgctatggggcggattgcgaagttcaatgggacacattgaaccgtttaaccttacattgctgggtgtgggaaatgaacagtgggaagctgacgggaatcagtggtatgagagatatgaggagtttgagaaagttatacattccgtgtatccggatataaaaattatatcaagtgcaggaccaagcccggatggagataattttgacagcgcatggaaacgtataaaaatgaatatggctgaaaataccggattcacatatgcggttgacgaacacttttacaaacccggggaatggtttttaaataatgatttaagatacgatggttatgataggtcaataaaagtttttgccggagagtatgcggcaaagcaagatgggaacacactatattctgctgtgacggaagcggcgtttatgacaggtctggagagaaatgcagacgttgtatatatggcaagctatgcgccgctgttttgccgcataaattatatgcagtgggaaacaaatatgatttggtttaatgacatgacttgttatggaacccccaattattatgttcaaagcatgtatatgaacaacagcggagattatactttgaaatacagtataaccggcagtaatgataaaaattatttatctgtatgttatgataaaaatagtaatgatataatagtaaaaattgcaaatccggctgaaagggatattagtgtggttttggatttaagttctttcaccgaaactacagaatttgaaaactacgctcatattgaaattctcaccggagaaagcgtcggttccgaaaactcaattgataatccccaaaatatagctccaaagcgttcagaaataatattgaatgataatataaaaattccatctttgtcatttgcagtaatacgaatacatattttaaatcaatatttataataaaaagttttttaactgtttcgttttatgctgaaaagataataaaaattttagactgaaaaaatatggatgttttaagattaaaatattctacaggtgttttatcaacgtatagagaattgaattatgaaaaatctgaatattctataacttttaataaaataatttatttgatttctgattaatatgtatattagatttaatcagtgcgtgttcagacgagagctcacctaacgcggcgcgttttacgcgccctgccgaagttcactgatgcaatatttaaatagtaaataaagtcacaggtttataattaaaaatattttttatactaatttaaatttgttgtacaaataatgatttgattctgtgacttttaactgaaatatgtaccggttatgtatattgcattatatataactagtataaaattgtaatatgtatttataaagtttgaccgcattatgagtatcccaaataatgacattattagtaatgataaaatgagctgatttgtataatacccatcttataggttggagaatagttacagcttagttaaagtttctaaaataatgacattaattaattcaatcataaagttatagcaatttaatttgaaagccatatataataggtttaataaattattgagtatatataaaataaggagaaaataaaatgcttaaagttaaaaaagctgttagagaagagattttcggtgatgaccgtgagtttgacagcccgcatgcgccgacggtactgccgcttaaaaataatgatgtgcttgcggcgtggtttggaggcaggtttgaaaaggacccggatactgctatttggactgcaaagagattaaacggcgtgtggcagaaacctaaaaagactgtggatgttatgaatattgctgcttggaatcctgtgctttttagactcaataatgatagaattattttatattttaaattaggctctgaaataccaaaatggcacactgaatacgtatattcagatgatgagggcaagacttggagcagcccgaaagaactcgtaaaaggagatataggcggacgaggtcctgttaaaaataagcctatatatttgtcagataacaagactattcttgcgcctgcttcgcttgagggggattcttggaactcgtttgcagacatttcggatgataatggtgaaacatgggaaaagagtgagtttgtccctatccgcagaataaatccaaatgagcggagaattcgtgacagggtatataacaagactttttgttttggaaaaggtattattcagccaaccatttgggaagatgacgaaaatattgtacatatgctctttaggagcacaagttcaaggatttttaaaagcgattcgtatgatatggggagaacatggaacttagcttatgacacggggcttcctaacaacaatagcggtattgacgctgttaaacttccgaatggaactttagttcttgcatataaccctagggaaaatataccgggaatgacaaaaggcgcaagaacgcctattatattatcatattcagacgataacggaagcagctggaaagaactttatattcttgaaaattgcgacggtgcatttgcgtatccgtcaattgtttgcgatggaaatgataaaatctatgttgtatatagtgaaaaccgggagaagattattttttggaatattgaatacgaagagacagtcaactaatcggaggcagctatgaaaaaggttgattttgataatgaatttaaaaatcccggttcagagtatcgttcaattccattctgggcttggaatgatgagcttgatactgatgaaatcagaagacagatacgtgaaatgaagtcctgcggtataggcggattttttattcattcgcgggacggtttggagactgaatatttaagcgataagtggtttgaatgtgtgtctgcagctgttgatgaggcaaaaaagaatggtatgttttcatggctttacgatgaagacagatggccgtcaggaacctgcggcggaagtataactgcaacggataaaaacggctgtaaggggcttacgcttgaagtatgtttttctgttcctgagaagatagaaggaaatgtactcgtattatataaagcagaagttcatgaaatggaaatttacagtcttgaaagaatatgtaatgctgacggcttaatacttagtgataaagaggctttgctgattgcgagacttgaagtcagcggaaagtctgaatggttcaacaactccgctcctcctgataacttgagttttgatacagtaagtgattttataaacaatacacataagatatataaaaaggcggtaggcagtgaatttggaaagacaattcccggaatatttacagatgagcccagcctcgctgacaggcacgcatcgtttaatccaaatcgaagctggataccgtggactgaggaatttgagaaatacttttttgaaaaacgcggttatgatgttttagatatgataccatacttttattttaatggtgaaaagagtgcaaagataagacatgattactggcgaacggtctcggaacggtttaaggaagcctattcggttcagattggagattggtgcagagaaaataatctattattcaccggtcattttttgcaggaggataagatgggattatcctgccgtgtgaatggttctgtcatgccccattatgctgctgaggatattcaggcgattgacatgctcactgaacgtacagaggagtatataacggttaagcagtgttcaagcgtctctaatcagctggggcgcggggcagtgctatcggaaatgtatggatgtaccggctgggatttcagttttgagggacagaaatgggtaggagactggcagtatgcgcttggagttaatcagaggtgtcagcacttggcgctttattcgcttagaggctgccgcaagcgggattatccgccgagtataaactgtaacaccagctggtggaaggaatataaaacggtagaggattattttgctcgtctgtcatatatgttaagatgcggagagccgataagaacggttctggttgttcatccaatgacaacggtgtggagccggctgggatgcagtccttatggcaatccaaagaggaatcaggagcgtgatatacctaagcttaatgaactcggagatacctttaattcaatcgtaaaaaatctttgtaaaaagcattatgaatgtgacctcggtgatgaggttataataagcgaatacggaagctgcagcgatgataaatttgttattgggaaatgtgagtacaatactgtgataatgccgttttgcgaaaacttgctttcagaaacttatacgaaagttatggagtttatggaaaacggcggaactgtgcttggacttgctccgtttccgagattaattgagggagaagtatctgaaaaattatctttgcttataaatcatcataattttgtgaaactgttttcagaaaatgagcttattaattatttggataaaaatgttaaacgcgaagtttcaataatttatgagaatgataaagaggaagaaaatattttatatcagctgagatatgacggaaacggatatatcctctttttatctaataatgacagggaaagcgctcatgaggtcaatataaagttagatgttttagagaacttggaacagaataatttatatgtatattctttaaatcttttaacaggaactttaacgtcctgtgatttcaaatatgcaaaaggcagggtatgttttgatgaatatatgcaaggctgccaaagctcaatgttttatattaccaataaatatgttgaatgcggcagcagagatgttcagatatggaatgcagaagacaaccggattaaaactgaagaaattccagtcgaatatatcgcatatgaagccgatacaaaaaatattttagctcttgatatgtgcagatattgtatggatgaaaagtggtcggaaaacatagaggtttggaaagcacaaaaagaaatcagagagaatcttgaaatgcgccaaatttatcataatggacttgagcaaagataccgctgggtaaacacgcgtcataaaaacgatggaaaagatgtttggctggaatttgagtttaaatctttaaccggcgtggatgatgcagagttggttattgaaagaccggaatgctttaaaattgaactggacggaaaaataattgataataattcggtcggctgttttttggataaatcttttaaatgtattcagcttccgaaaataactgaaggcgttcataaactgagactgcaatgtaattacacaaacgatatggagctggagtgctgttatatattaggcgattttggggtaagcgcaaaccgtgaaatcattaaaaagccggaatctattagtttgggcgatataacggggcagggatattttcattattgcggaggtatagcgtataagtttaaatgctgtttgcccgaattgcccaataaagaaatatatttaatctcaaaggattttgacggagtatcttcgtcagctgtgataaacggcagggagattaaaattccgtggaaagaagccgggactgtggctgtcggaaagtttttacatgagggagaaaatgagatagttataaacgtgtacggaagtcctaggaatatgctgggaccattgcatataacaaataagcctttggttaccaaagacagttgtttctgccctttaggtgataactactcgccgaattataatgtggtaagcgtaggattaatgaaaccgctgagattgatttattttaaagattagtttctttgatgtgatcccaaaaagttagactatatagcgcagcagtttgatgactgctgcgttttttatgctgctttagcttagtgcctgtgcaattctttgacaggcttcctttatttgagctgtggataatcttccggtaccaagtaaaaatgtgcgttttggaatcagaggcgacggcagaatgctgtattctttaatagacatgatttttactccggccgcactgattttgctttttatttcagaggatgacatgtcaagattaaaggttacgattacgtttgtgctgtctgaatttggggatattgttatttttttgcctaacgattcgataagttcacgttttaatagttcgcgcttgtctcggtatacccgtcgcatggttttataatgcttagtatagtatcccttttcaataaattcagccaaagcgtattggtctgtttttgacgcaaaagaagaataaaacttgtgtttttttctccattttgaaagcagttcgtccggcagtatcatatatgcggttttcaaaccgggacacagcgctctggaaaatgtgtttaaaaaaatcacctttccgtttttatccatgctgtagagagtgtcagatgaatcccacgtgagttcggaatcatagctatcctctattatatatctgccgggagattcagacgcccatttaagcaaatccattttaagctcttcgctcattttataacaggtcggataatggcagtggggcatacaataaaatatactgcaatttgatttatataaatcgtctatatttaatcctgacatagatataggtatattaataacgtccgtgccgctgtcagtgaaggcgcagtacgagcgtgaaaatcccgggacctccattccaattttcccaaaatctatcagaacatcggcaagctgcgtcaacagatactccgagcctgcacctatgattatctgacgcggagaacatttaatatcgcggaaggaatataagtattttgcgacagcggcgcgcagagaatgttcgccgttcttttcgggatgattaaaaatgtcaattccgtcattatagacaatattgcggacaattttagcataactgctgcgtttgaaataagtaatatcaacagcgttaggcgtaaaaacataggtttcgcctgcgtcaatatcccatggaatatcctcaaactcaccggagttaaatgagacaaaatgccctttttttggtattgaaattatatatcctgtgtctgccagcatattatatgcttcattgacggtgttttgtgatacagagagctgcttggctaatatacgtcttgccggaagtttaaatttgtcaggcagaaaaccatcggaaatatctcttactatagcgtcataaagctggatatacaggggctttgacaatgatttgtccaaagaaatatttttcattcagaatcccccaataaaatatatttatacttaaatttattatatcattacaattgatttttgacaatactttggtactgtaaaaaatataaactctggtactgtaatttgttattgttttttgttatatttaaacaaagagaaaaaacaactttaaggagggttaattatgatgaaaaaacagtttaaaagactggcaagtcttgctgcggctgtgactgtttttgccgggatgtttaccggtattacagtaaacgcaaaatcggaaaccgtcagcacagcggagacaagcaatctgtttgattcagaaaacgttatgtggacagaccaaaaaataattgatggattttgggaaatggatccagatgtaagtaacaaaactaaaacagatattcaaaatccgtatggtaacagcggcgacatgtatgacgcacatgcgtattatgaatttttgtggacgcacggttatccaataggaaacggacgtatggcggctatggttatgggtgcgattgacaaagaggttatccagattaatgaggataccatttggaatggttcgccatatgttggcgaggacggcaaatcaaccgccggaagtgtaaaggatacatggaagtattacagaggcgccaaagcggacggcacgcctgccgccttcggtgaggagggcgaccaggttctcacgggcgatgaggagttccgtcagaaattccctgcatttgcacataagactattacaaatatggcgcttaatatagataacagcgatacacaggaagctgtttcaaacagacttgaccttgcaaatcttacaaatgacaacttcctcggaaatccaataaaacagagagcatattcagaatttgttgagcttttcttggactttaatcaggagagcggaaaagcgtcaaattatactaaacgtcttgatatgagcaatgcggttgcgactgttgagtatgattatgagggaactcactacacgagagagagttttgcgagttatccggatcaggcaattgtgacaaaagtaaagtcggaaggcggaaatttagacttttcggcacagcttcacacttggctgaaaggaggacagcaatttgagaaaatttccgataatgagattaagataattgccagaccggcaaacttatcagagagtaatggtttggggaatatgtcgaaaattgtgggcgaggcaagaatgtatattgacgcaggaagcggggcgaaactcagcgtttctgatgattgttcaaccataaacgtcagcggcggcaatgaggccgttatctacatagtaagcgcttctaactacgttgattacttaactcttgatgacagtaagcctgctcgtgactgtgataaatatatttcaaagataaaaaacaagtcatatgaggaaattaaagaggcgcatattgctgattacaaagaactttacgagcgttctgagcttactcttggaaacagtgacggcacggacgaaagcggtactacgacagagaaacgtgtgcgtaaggatgttaaaggcaaatccggttatgaaatcggggcaggtaataagcttgaagctaaaacccctgttgattcaacttataatgacggtgataataagctggttacaatgatgtttaactacggaaagtatcttatgatttccggctcacgtcccggagatactgagaacgatattcctataagccagccgcttaatctgaccggtaagtggaatggaacaaacaatccgtcatgggcaggaaaatatacaattaatattaatactgaaatgaattattggccgtcacagccgcttaacctttctgaatgcgtatttccgctaacagaaatgcttcagcagttggccgaaaacggaagcataacagcagattatcagtatggtataaagaatcacagaaatgacgataagtatgttcccggcgacccgtgggtaatgcacaataatacagacctttggcgcggcacacagtttgttgataattccgacgtgctttggcctatgggcggagcatggcttatggactgcgtttggaagtattatcagtataatcttgatgagcagtatcttgcggaattattcccgattatgcgcggccttgcagacttttatactcagttcctggttgttgacccagtgaccggttatcttataactgctgcttcatcatcacctgagcagggaagtgttcagccgggttcagcaatagatacacagcttataagaaacctatatgatatggttctgaaatccgcacagatacttggcaaggagaccgaggaagctgagcttattgcaaaaatcaaagagcaaatgcctgaaaacggttatttctcatatgagcagggtaaacttgcaccggatattatcgaaaccgataagagccatagcggctatgggcttatcagagaatgggtcagaggagacgttaaatttgacttctcaacggcagattcaagcaataagttatggacctatacatacccatttgtaacaggcaacgctgatgaagacacgacaaaggagagcagggctaaatataagtccggtatgtatagaaagcatactgctgcgaatggctcagagtgcggacataggcacacatctcatctttgggaactgttcccgggaacacatataaacgcttacagcaccgacaagcatgaacaggaaatttacaaagcgttccgtcagagcgttcttgcaagaggcgccggcagcggacagggctggggcgttgcgtggagagttgcgctgagcgcaagagcgcacgacccggcgacagctgatacgcgtattgaacagcttatcagaacaagagtttcgccaaatctgtttgaccagcatcctaacttccagattgacggaaactatggtcttacagcaggcataaccgaaatgcttgtacagaagcagggagattcggttgagttcctgccggcaatttccgataaatggcagagcggaagcttcagcggatttaaaataattggtaatattgaagccggagcagactggaaagaaggaagccttactaaggcaacattaaaggccgcaaacagcggaatattaaaagcacgcaacagctcgcttgataaaaatgcggttgttgttgacagcaagtataacaaggtgccgttcacaactgaagaggacggaactgttatagcatttgacgctgcggcaggagagacatattcaatttatcctgctgattatgtacagaccacaggcgagagcacatgggaaaagtatggtgcggaaatttcatcaaattccagctgggcaattaaaaacaagtccggcatcgctccgaaatattattcagataacttgtatattggaaatttggccaatgataattcttatatcggttttgctgttaaagactgtgatgtgcaaaatttaaaaacattaggtgttaagatagcgctttattcctcgatgattgacaattcagaggtttcagttagagttggctcttcaagcggtaccgaaattgcgcacaaggtgtttgacactgcgaccggaggaaataagagctttgcatggatagacataccgctcaatgaggatgttgaccgttctctgcttgaaggcaaaaaaacgttgtgcttcttatttaagactgatttaaaaaatgatggtacaaataataagtatattgccaatgttgagggtgtttcgggtaccgtattggtagagaccggagagaagcagtatataaacttaaaacataatggagacgattattatacaactcttcttctcaatggaacctatacggctactatttcaaacgatgcaccggacggcactttgattattgcaaaatatcgcggtgacgaacttatagacacagtaacacaagagataaattccgaaaacagaagcgctgaaatgaatatttcagatatagaaagcggaataacgatgaaagtaatgtattgggacagcacggacggtatgcagccgctgtcaatgatgcgaatattagaaacgtccggcacttcggtgccggacgttccaacacctgaaccaactgaccctcctgttcctacaaaggaccctgtgccatctatgaccccaattccgtcgcctacagcaacgcctgcattgccggaagtgacaactgagcctacatctactcctgctcaagagagcggaactgtatttactgttgacaaaagcggtgagacggatatttcaaagaatcaatacaagactattcgcgaggcgcttgcctcagcggcagaaaaaagcccgtcaaatgaaagcgaacgtataacaatagaggtagtaccgggcacgtaccgggaacaactagtagttaatacaccgtatattactataaagaaaaaacccggtactgacggagaagtgctttgcacctggtattacggaaccggaacaatgtataaaaactgcggaagcgacggtttttacaaagagggatctttgggagaaacggcgaatgtcgcaaagaattggggagcaacgcttaccataaacagcagtgcaaacgacgtgtggattgagggggttaccctagaaaactcatacaatcagtattatactaaagaagaacttgaagccggaatggaacctgacccggcaacaagcaacagctgttttgacagagacaagtggattaaggctatgattgccaaaggaatgtctaataatgagataaatagctggcttcagtctagaacgtatataggaaatgaatataacctcgacccggagaagaatgggagaaaagattcaccaagagagcgtgcctgcgcattgtataccgcttctgacagagttataatacgcaattgcagagtggtttcaaagcaggacacaattggaataaataaaaaccgtatatattttgaaaattgcttcttagaaggaacaaccgattatatttgcggaggtgcagtagccgttatgaacaactgcaccctcaatgtcggttcggccaagcctatggattcaaatacaggcgcaacagattctgcctgcataacagcggcagggcagtcgtcaggcaatggatatttattctataactgcgaggttaccggaacagattgggccacaccgagcgagttaggaagaccatggaatgcaaatgcggaggtcacatatataaatacaaaaattaataaatgtaagcgcagcggatatacgaataagtatttgatttcagataagggctggacagatatgggcgataataaagcggaagacgcccgctttggtgaatatggttctgtggacgctgaaaccggtaaggccattacaagcagtgtgtcaatacgtaaaaagtttatgctgaacgaatggtcaatgcttgagtataacccatataattatctcagaggcagcgataactgggatccatccggtatgaaccggtattattcggagtttgatgagattgcctcttcaattaacattgacacttcaggtgaaggcgatattattctacctgaagcggcagatggttatggttatcagtgggaatcagacagcacatacgcaagtgttgacaaagataagaacacaatttctattattcggccattatatggagacgagcctgtagaaaccaaaatttcagtatatatacgcaagaacggaacacagtacggcgcgagaaaggttattccgcttacaattcagccgcacagcagcgcggaaaatacattcagtgtaaatggaaccgtaagcttgtcttctgcttctgaggatgaagtgaaggttacagtaatacttatgcaaggcgaatgccctgttaaaactctggatgtaacagttcctgccggtcaggagagtgcagactacacgataaataatcttcccgagggcagttatacagctcaaatatcaaccgatacgcgtgaatatactttgatgacagattcaagcgttgagctttcaggtagatctggcgagacaaaggaattaaatatctcactgagcgagtcaatggctacgccttaccctgcaaaattcactgttgacgatttaatcaaaacagaagatatgatgcgctggagcaacggcgtagatgtcacaacttcgtctgacagcacaaagcctcttaaaacggcttcaagcgcaagcgcaaccaaccttttggtaaaaactcctgaaaactatacagcggagtatgaaaaagcgtttggccctgcagatagtttgcgtacgaatttcaccaagaagctgggctatataaacttctgcgccgaaagtgaggaaagcaccccttcaattgatacatatatttcggtttacttctcagtatcagaggagcaggctgcaaagggaccgtacaaggtttatgtgcttaccaacagaaagcgtaatgattcacgcatatctattgagacgccgaaagttggatttgttgaaaatctttcggctgattttgtaaatatgtcaacagataccgacggcacaggagtacatgtaattgagcttcctgagtttaaagcgggcacatatgaattcaagtggtatccggtgaaaacggcagacggaggcacaaaagtcgcttcagatttctttgctttgagattccttccggtttccgagacagacggaaagtagaaaataataaattgaaaaaacaataatttcttcccaattaatattaagaccttaatctatcaaaaagatgattcttttttaagattaaggtctttcttatgtgtttattttaaattttataaaatagtattattattggaatacctataatgaatataaagtttaataagaaagaaaagcagatatacattaaccgttatttatcaggtgtattggtaaatctatggcatagtgcgcagtacgctgtattctttgattaacaaatataaaaataaaagtggacaaaccctttataataaagaatttgaccacttttataaaaatgcttggtggatcttcagggactcgaaccccggacctaccggttatgagccggttgctctaaccaactgagctaaagatcctcatttgttctgactaatttatagtctcgaacaagaacttttatattataatccatattattctatttgtcaatactatttttataaaaaatttttaaacttataagaaaaaattctctaaaaaattgttaaaattgcaaaaagtacttgcaaaatatagagttttagtatagaatgtaaaaaaactgatattattttttaggaggtacacaccaatgataactgctggtgattttagaaatggaatgacatttgaatatgacggaagcgtatgtcaggttgttgaattccaacatgttaaacctggaaaaggcgctgcttttgtcagaactaaatttaaaaatgtaataactggcgcggttgttgaaaaatcttttaacccgactgagaaatttgaaaaggctatggttgaaagaaaagatatggaatatctttatcaagatggagatttatattactttatggatcctgaaacatatgaacaggctcctctcagcgctgaccagttaggcgacgctcttaaatttgttaaagagaatatgcaggttaagttttgttctttcaaagggaaagttttttcagttgagcctccgacatttgttgagcttgctgttatgcatactgaacccggagttaaaggcaataccgctacaaacgtaacaaagccggctactcttgaaacaggtgctactgtgactgtcccgatgtttattaatgacggggatatgataagagtggatacgcgtaccggagagtatatggaaagagtataattataatataataggaggcattattatgtctgatttgacaaaagaagcggcatatatcaaaggtttgttcgatggtatgaagctggattcacagaaggatgaaacgaaaattttatcatctataattagttttttagagaaaactgctgatgagatagatatgcttgaccaagagcagggatttcttgcagaccaaattgacgatgttgaagaagttattgatgttttagcagaggaaatcagcgatgagtatgacgatgacgctgatgaatatcaaattaagtgtgacaattgtggaaacaatgttcattttaccggcgacgacattgatgatttggttgaaggtaatttcgactgtccatattgcggtgaaactgtacagttggacttgagcggtatggaagacggatgtgactgcggatgcagtcatgaccacagcgaagaatagtatttttgaataatatttaaaacagactgaaatttcagtctgtttttttgttatgtttaatttgatatgaaatttatttctataattttgttttctctcggttatagttttagcttattggtaaagtggcacgcgctgtcattcgaaataacctaaaatgaaataggataccacagaaaatattatagaaagaaggttagttaatggctttatggtatgattctaagaataatgagtatgcttcagatggcaaaaaaggctggataaaatcgtattgtgataaagctttgtctgaatttaataatttaatgtcagcacattttaaggggcagtctaaccgccatatggcatgtgatttggattttgacagcaatatgacagttgaagacaagctgaaaataattgaagatgaaagcaatgcggcagataacagattaaagactgagcttgagagcaaaattaataaaaaagctgacagtataacaaacggcggttttgtggcaggcggaggagtagtaagcgaagaagaaggagcggttgttattggaaacaaggccgagtcgtccaatggtatatctataggcggcggagccttaagcaaaggcggtatagctattggaagagatgctaaagtgtcttcaggtaatggcgtacagcttggcgcaggagaaaatataaaagaaaaaacattaaaagtatatgactatcagataacagatattgattctgaaaccggacaatcatatataaaagatattggaagactggcagatattaatttaaatatagttaatgttgctgacgctatcaatactttaattgatacagatgaagatactgtaaatttaataaccaatgaagtcagcgcccgaattgaggcggataaaaatattaaaaaggaaataccggtcaaaacaatagagaacataacgtcagagactacagataacagcagctatgttacaccgcttatggttaagaatgccgtaaataatttgattgaaagctctgaggagataaaaaacattaccgacggcttaaatcaaaaggcagataaggttacaaacgggggctttatagccggcggagcacaagcaggcggagctcaaaatatatcaataggcgacggtatagcctctaccggcgaacgcggagtagtaattggagcgggagcagagggagctggtcgctgcgttgcagtcggaagtgcgtctacggcggcagcggctaatgctgttgcgataggatacggtgcggaatgtttggcagataatgccgtacaaatcggggacggaagtaattctgataaagaaacattgaaatttcgggattataaaatagttgaatgcgagagtaactctaatgcgcattatttaaaagatataggaaggataataaatcttgagacaaaagataaaaacagcattgtgggagcggtcaatgagatttataagaatcttgaacttagtctgatagttcctaacgccatttcacagagcgttataatgacaaaagattctgatggaaagtacaaattttcttttactttcaataatgcgtatattacgtcaaacagattatttgataatgattttaaaagtcagattaataacacgtttgaaataaatatgttagatgcgccagagtttaataaaccatattatttatatcttgaatgggatttgattctggatgaatttacaatgtttagtacagccgataattttggaactaaccttaatactgaatgtttgcagttttatataggtacgtttactatagtggatgataaaacagttgattattacgatgagcaggagaaaatttctgtaaatcttataccgatgataggaaactatctgtcaagactggattataaatgttatgaactgcaaagagatacggccaaaaagaatacagctgtattattacagaaacttgataagacggaggaatttaacatttggcaaaacggtaattggatagtggaatataatataccgcccataaaaattacagacgagacatacggaagctttacactgccgtctcaaatgttggaagcggcgggagttaaagaggaagcaggcgaagagaaaaaatattgttatgcttcttacgtgcttgacactgataacttatcaggtgaaataagcggttctgatatgacggtgacatgcggcttaaaagaggcaaagggaaaaccaaacagctatatagagatagaagatgaaacgaagttagcaactataaatatatatctcggaactattatattaaatgcagaagattacatgacgcctgatggaacctcgagtactatatattcaggcagtgaaacaacaaatacggaaatgactattgatttattcagaatatttacagagtcaaccgatgtatcaggagagttagtagaaattacagcagatgaggtaagtgcattattttaattataaaaaattatattttgaaaaatagcagtgaaaataagccatgttaatataattattagttcggctcatgtttttagagtgagagtttcataaaattcgcaggcaaagcctgcatattaattaaggagaaaatattatggcaacaaaatttttaggaacggcggcattaacaaaattagtagaaaagattaagggcgtatcaacagcgataccgacaaagttaagtcagcttacaaacgacagcggttatcagacaggttcacaggtatctactacagttacgaatgcgacaaaaactttagctttaaagactgaggtaacagctgtagacaataaaatcggagatttagctgatttggatacagacaatacgagtatagttaatggaatcaatgacgcatggacaaattgtgaggaaataagggacaatataggaacaagagcaaatttaacaacgactgctaaaacagaccttgtatcagctataaatgaggtagacagcaatgtagataatttacaggaaactatgatgacaggatattatacaaaggctacagtggatacaaaaatagcagagtctaaagcaggactagcaacagaaacatatgtaaacaacaaagtgtcaagcgtttacaagtataagggcagtaaggatacatatgcgtccttgccgacaacaggaaacgcagttggagatgtatggaacgttgttgataagaacggtcaaaattttgcatggacaggctcagcgtgggacgctcttggcgagactatagacttaagcggatatatgaagaatgacgcactgcaggaaattacagcgacagaggttgaagctttatttaagtaaatttggagggatatagatggcgacaaagattttaggaatgacagcattgacaaagttagttgataagacgaaaaaatatgtaaacgataaaaagatgctaaatgtgatgaatgattcaagtgcaagtggaaactactctgttgttttaggaggacaggggacggtgcccggagtttgttcggtttcattgggcggttattctaatgctgtgaatggagaaagggcagtagcaataggcggctggtctttgctctgcaacggatataacactgtatgcggtaaaaataatttagaaccaactgccggatattattctcataataacggcgacggatttatagttggaaacgggacgttaagttcccgttctaatgctttccgtgcggcttacagcggtgatgtgtatgctatgaagtcaataaacggaaccggagccgactatgcggagctcagagaatggtcagacggaaatcctgataatgaggacaggtgcggactatttgtatgctttgacggcgagaagatacggcttgcaaattcagaagacccaaaagacttactcggagttatatcaggaaatccgtgcatagttggaaacaactatgatgaccagtggagtgggaaatataagaaggatgtatttggccggttgcttaccgaacatatgatatgggaagaggaaacagataatgaaggcaatattataacacctgcaggtgagggagatgtatatattttatctgaagactacgatccatcgcagaagtatatacctagaaaggaccgcccggaatggggatatatgggaacgcacggagaattggttgttatagatgacggcacatgtgaagcacaaggccgctgcaaaccgaatgacgaggcaaaagcaacggcggcagaagatggattttatgtgcttgaaaggatagatgataagcatattaaaatatttatgagataaaacggttatattctgccaaaattagttcggttaaaattttaaaaaggtcagcgtttgctgaccttttttatatgataatagcaaaataaaaatataaagtcaaagaagacttttaacggtgttacaaatatttcagcaattacactgtgatgtaatgaaaattatctgagtgggacgattactagctgtacaagacgcttagagcagttaactgaactaatttatacgccattgtcaacaatctcaagcggtttattagaccaaatattactaaattgttccatagaataatttgacataggataaacaatgttgtaatattgtattaatacagaaagggatgagcgttatgataaagaaaatattagaaaaaaccatggttttaattgcggtagttatatttataggaacggtaaatgtaatagcagctgataacaaccacattactgtttatgtaaatgattcaatattggacgctgatgttaatgcgcaaataattaacagcagaacaatggttccaatgcgcgctatttttgaagctctaggagctgaggtaaactggaatgaggaaaatcaaactgcagtcggcacaaaagatggcgttacaataagtctgacaataggaagcagaacaatgtatgtcggtgacagagttaagaaattagatagtccgcctttgatagtttctgatagaacattaatgccggtcagagctgtttcagaagcttttggatttgaagtgaactgggatgaaccaactaaatctgcttatataggaagccataacaggcttgacagtttaaagcagaaggtttcagaaatgggtattgatgataagatatatcaaatgatgattgtaactcctgaatcaataaccggggttgaaaaagctactgaagccggtgaggcaacaaaggcggcaatagaaaaatatcccgttggaggtttggtatatttttctaaaaatattgtcagcgagaatcaaataaaaaatatgattaataattctcagtcctattctaaaacccccttatttatatctgttgatgaggagggtggaagagtagcaaggctcgggaatgccggtattggttttcctaaaattccacctatgaaagagattggcgattctaaggatgttggaaaagcttcagaggcaggtgaaacgcttggaacagcgctgaaagaatatggttttaatcttaattttgctccggacgcggatgttgaaatcaattctaattcctcaataggcgaccgttcgtttggcagtgaccctcagcttgttggacaaatggcgtcagccgaaatcagagccatgcagtcaaaaggggttagttcctgtatgaaacatttccccgggattggtgcggctgaaggagatactcataacggttttgttgcaactgacaggtctttagaagaaatgaatttatgtgagtttgtaccgttttcatacggagccgcagcagactgtgattttgttatggtaggtcatatatcagcccgaaagattactgaaagtgatgttccgtcatctatgtcttcaagagtgatagctatgcttagaaacgatattggtttcagcggcgttgtaataactgacgccttagacatgggagcaataattaagacttatacgacgtcggaagcgtgtatagcagcagtaaatgcaggagccgatattttgcttatgccctctgatatagatgaagctcattttgccttagcgaatgctgctaaggaaggtattttaacagaagacaggattaattccagtgttatgagaatcttagataaaaaaatgtctagggggttaattaattattaaatatgtttttaataagagtttattgctatagaattgagtattaataaatatcaaagcggtgtttgtaacatggttgtaacacgtttgtaatattgttgaaataagacaagctaattgactaaaataaaaaataatttatacatgttgcacaaaaaatgtatgataatttagtgtttattccctcttgtaaaagtatttagataaggttataatttaactataagaaagttaatttataaaaattctgaaagggggagcaaaaatgaaattcagaaaggtgatagtcggagcggttactcttgcggttatgtttgtatcatgcagcggattaagttgttttgctttatcagatgccggttcagacaaaccggatgatattgaccaatctacgtttgagacagttgttaaaatagatgaaaatcttaatatgattatggataaaaatgagaattctgaagttgtttgccaatctgatattgacgaactcgctgcccttattgatagatttaatgatagcattattaagcaaaactccggtttgtcacaaattcattttgatatcatttggaaagttgattttgtgactagccagatacctgaaaaagataaacttgatatgagaaatattcaaaagagtattgaaagttttaataatatagtcagacttttgaaaccacgtacggaaagtgctgaagctgtcggataatctgtatctggttatatttatcaaagtataaaattgaaaataaaactccaaaccaaataatcaaaacaaaattttataaaaccctcattatttctttttataaaagaattttgagggtttttattcgttagtcagatgaaaattaacaaaataacccaacaaattctaaaaaagtcttgtgcagttgttttgttttgtgatataattactaaaatagaaagagttacagttctatattgatatgaactaagaaggtgacttaaaggtgacaagtaataaaaaacgaaagattcttgtagttgatgacgttgagcagaaccgtatgatattatctgaaattttaaaagatgactatactgttattgaggctgatgacggtgatgtttgccttaaaaaattgcgtgaagataaagatataatcttagtgttgcttgatattgtaatgccgaaaatggacggatttcaggttttaagagagatgtctaaagataaagaactacagcacaaatccgtaattattacaacggcagacagggccatagatgctgaaataagagccttgcgtgatggagctgtggattttcttgaaaagccttataattctgatatagtaaaatgcagagttgataatatcgtgactcgtatagttttggaaagcgaaattcttgaagaaaaacttgatttagccaatgagcgtttggctgcaatggtagatcttatacctgacggcatagctatatttgattactatgagtcgggcagggtggatttaggatattataatgaatattttgcgaatatatttaatattacgcgcagtatagctgatacggagaaaatatcttttgaaagtttaaatcaattatttgaattggacttaatttatccgggcgacagaagtcatcttgaagaaaaggttaaaaaatgtattgatgatagcggaactcttacatgtcagtttagaattaaaaggaatggagcgtttagctgggttcgtatgtctatgattacatttttgggcagcaatggagtttgccgctgtcatgttttattctctgatatttcttctgaaaaggatagagaagaacagataaccgacgcgcttaataagcttagatatgtaacgagacacgataaattaactcagatttataatagagaaactttctgcgcttccacagataagctgctcagtgtcaatccttctgtaaaatactcaattattatgtgggatataaaaaactttaaagtaattaatgaattgtttggcagcgataagggcgataaaattcttatattaatagctgatactttaaaaagtttggtaggaaacaatggaatttacggaagaatggagtctgataaatttgttgtttgtattcccgcaagcctatgtgatataaattcaataattaataaaatggatatgacgctcaatagcgccaatattgttgattataatttgaaaatttttgctgggatatataatatcatcaatgatgagaaaataccaatagaccagatgtgcgaccgtgccaatatggcgcttaaaagcgctaagcgtgattacgtgaacagatattcttattatgattctgaaatgcgtaaaatggttatggaagaagaactgatattgaacgatatggatactgctcttcaaaatcaacagtttaaggtatgctatcagccgattttcagcgtcaccagcggaaagccaatagctgcggaagctttggttaggtggatgcatcctgacaggggcgttatatcaccgcagaagtttataacagtttttgaaaataataagttcattacaaaattggactggtgcgttcttgaagaggtttgcaaatttcaaaaaaagcgtctcgacgccggaaaagttatgctgcctatttcggttaacttttccaggcttgattgttacaaacctatgatatgtgaaaatgttttggggttaattgaacaatatggactaagtcctgatatgataaagatagagattacagaaaccgcctatacaatggataaggaacagataatagatgttaccaataagtttaggagttatgggtttcaagtccttatggacgattttggaagtgggtattcatcgcttaacactttaaaagatgttaacatagatattttgaaaattgataaaagatttattgatgatattgaagattcagataaggccggtgctattgtttcgagtgttgttcgaatggcaagattgattggcatggatattattgcagagggtgtggagacgcagtatcagaaagactttcttagaggtatcggatgtgataccatacagggatatttttattctaagcctttgtttgagaatgaatttaatgaggttatagataaatatagtaagctgccaattgataaatgtgtatctgatattagagccaatgatttgaatgttgagagtatttggagcggaaataaagaagtggacgctttgtttggcggactcatcggcgctatgggaatgtatgaacttaatccaaatggagttcttgaaataatacgggttaatgacggatattatgatttgtttggctcgtcgccaggcagtgtgtattctgatttgggtctaagtttcagcagacttgaggatgaaagcaaagacttgttgctgaacgcttgcagcagagcaaaatatgaaaaccaaataataaatgttgagcttaaaaagtatcatgaagacggtcatttaatgtggctgtcatgcagggtaaaacatattggaaaaagcgacaacagagacttgttttatatattgataaatgatataacagaacaaaagatgcgtgatacttcacggcaaatttctgtttatgcggatatgtttaaatcattttttaatgaaatttttgaaataaatacaattaataaaaccgtaacggttatgtatactgatggcagaattggttttgagacaggtgtgaagtttgatattgatacatttatgaatttttgcaggtctaatttggctgatcctaaagattatagttcacttgataaaaatataaagcagtcttttgaaaatgcacctgtttttgtcgatacatataaggttttagatattgatggtaatgctagatggtatgaatgcagggtgctgaaggttaacggttcagatttaggcatatacctttgttgttcagcagatattactgaagagaaaaatattgctttatcaaaagaaaatatgagaatagccgagcatgtaaatgaggaaaagaagcgtttgtttgcggttttgagcaggcttaatatatgtgttttcgagttagatttgaaaaatgacgtttttattatggatgaacagacggaatatgaatttaataactttttcggtgatatttgtagtataagcggatttgttaataagacttttggagaagacaaaaatgcttttgatagctatttgtcaaaagttaaaaacggcatatttgattcaggaataactgtgagaattttaatgagctcaggtgaatatggctggtttaaattagatactgtgcgtcaaaccgaaaaaggcgaggttaaaaagattatcggcacgatacaaaaggtagatgaaagtctgacagacgatataggaatcataagagaaaaagaacagcttgtaagtatgctgaattctatgcagtttggagttggaatttttgagtatgattctgatagtttggtaccgaaattttataataaccgtctgagagaattgcttgaaatttttgacggcagtgtttatacgtcgtcgccttatgttaatgatttagtggtttatatttctaatgtatgcagcaaatatgttaatgataaaaatggtgttaatattaatttgtcagaggaacatgaatataaatgtagagacggttcaaaagcttatgcaaatcttagtataactataattagtttcagcaaaaataaaatggtagtttattgtgttatagatgatataacaaatagaattgaggcggaaaacaaatttaaagagcaaggatatgtaaactcaattttggttgagacatctgagtatataatattagattataatgctgtaactaaaagtcttactatatccatgccggtgcgtgatggaaaaagaaaagaatacgaatacaaagatattaactctctcagttcggtagggtgggtgtatcctgaatatttggaatcaattgatgaattgctgtttagagaaaattattctgaagacaaaaaggatgacagcatagaacttttagcgaatataggaggatgcggatacagatggcaccaagctgtttttcattatgttcctgacagtgagaataaaatagttagagttatcggcagaatttctgatatacaaattaaaaaagagagagaacttgccttgagcaacgctttaaacgaaagagaaaaattgttggaaaaatctgagatagacagtgttacgggacttctcaacagattaactacagaggagtgtattgaaaataaattgtccaaaataaaatctgagtgtgcgtttgtggtttatgatatagataactacgaagatataaacgcagacctgggacatataaaagcagaagattatttgaaaaaagttgcttcagtgtttgaggacagttttagacatggagatattatcggcagaatggattcggatgtgtttgtagcatttttaactgatgtaaaagcaaaggatggagtctataataaggtcggcaaaacaatggcaaaaatttgcttagtttctgaggagtttggatttggcaaaatgggcacagtaagcgcaggaatagcattttctccggataatggcgtggactttatgactctttataaaaaagctaatatggctttgtgcaaggctaaaaaatcaggaggcaattcttatacaatttatagtgaagtttaaatgagctgaaatttttagtgattttgattaaataattgattaagagttgtcgcgtggggatgagtatatgaaaaaattattgtacataattttgatattatttttattcactaatgtcataaatatttttattcctgtttttgctgaagaaagttcctctgcggaggtgtctttttgtgacagggatggatgggtgagcatggttgacggatactccggcgggcagtttaattttagcaggcttcaacagtatccccagccgtttgttaatgaaaacggcagaacgatgtttcctattctttattttgatgagatttttagggatggtttaagttatgatattaatgataatactataacgataacaagaaatattcttgatgttataacgactgtcagtgttactatagatagtaatgttttaattaaaaacggtgaagaaatcgttatggataccgtgccaatcagaataggagaaacgatttatattccgctgtggtgggttgctgattatcttggttatggcgttttatggagggattatcaaagtaaatggtggcctggaggaatggttgaatttggacaattgacatccatctttgtttatgtctggaatgaggataaggattcttcaccaaacggattaaggtattcatatacaattggcgaacggtctgatgatatgtctgaaatcaaggcaaatgctgcgtcagattttgaagatgtatttgctgttattaaaagacttcctcaaggagcaacagttttaactacagcgatttatgggcttgatggatataaagtcccatatgatatatataatggaataacaaatgctgtgtttaatggaggctataagggcggatatagtacatattgtctcgatgagattccaccgattattaatagtttgggtgattttacaaatgaatggtattcagaggagctttccgctttaggagaaccggcgctgtatgattcagtcggtcaaatatatcgtttttcatatattccttcattttggaatccgtttgttgttcggatagaaataaacgatgatggaacagcaaatgtgtgctataaatccggcaacggcgttgcgggtcctcacagcggcgggattttaaaatccgagagtgccgaattaagcagagaagaaactaaagagtttcttgatttattaaatgataaggattattggaatatgccaaaagaagttgagagattaggctgtgacgggtatgatgtagtaattgaaggagtaaagaacggtgtatatcatatagtaaacaggtggtgcccaatggaaaacgattcagctttttacattgaaaaatattttgaaaatttggtaaaagaaaaatttcctgaataaagtaaaaataagtatattttagttttatgatatcaaataaaaaatcagacaataaagagataaagctgtttggtaatttacttatataccatgattttatgagaaactattatatgtttttgataaatatattaattactgcatcgaataatcacgttcattataatgaatttgataaatagatagaatgttaagtatttagtttttttttatactttaataatatacagctataagtaaatgagcggtaaaattattaaattaagggtttaagtatgaaataagcatctgatggctaaatctttcattaatttagataatatatttattgaagacaaaccagataagaaataagagtaatttaaatcatattgattgaaatgaataaacataatttacagaatagaaataaaacctcttacagtatgaactgctaagttttttataatcttagtatccatattataagaggttttttgtgactttatatttcaaagctatacatcaaaactgatttgttcaattccccggtcttgctcacggacagttgctcctacagccggaactgtcttggttctgaatctttctatatttttcagtcctgaatctgaagcgggaacggcctttgacactatactgccctttctggaactcattatgttaacgccttgagttgttcgcgtagtttttaagggtatcctttctgtatttacggtaatcgccctgtctttgtctgaaaataaaacaatgtccatttcggtttcggccggaagataaaacatctcaacaagaggcgattttgaagaaaatccgttggcaagtttttttcggttagtttttgtttgatatgacttcagcggaactctggccgcctttccgttttcaaagaagaatactaaatctcctgaaaaatcatcggttgcggacatacccacaatctcttccttttcagttagtccgacaagattgggtataaattctcccagcaaacttgctttgctgtcaggtacgtcgtaggctttgattttataaacgtctcctgatcttgcaaagaatataatttcactgctgttctgagcttcaatctcctgaatcatagtatcatcgtccttgagccgctgttcaccgctggtgcggagtgatacgagtgagattttctttaaatagccgtgctgtgttctgaaaagtttgacgctgtaattatcaattatttcttcttcgactatgtctttaatctcatcagcagttataatttcagtttttctgtcgcttccatattttttcgctatttgtttcagctgtttttcaatcagtttgtttatttttgttttgctttcaagggtggatttcagttcctcaagttctttttttaaggtttctatctcagctatcctttttagaatataatctttattcaaattcctgagtttgatttcagccacatattctgcctgaacatctgttattttaaaacctttcataaggttcgggattaccatgctgtcgtcttctgtctcacggacaatttttattgccttgtctatatccaaaagtataagtgagagaccttcaagcagatgcagtttttcacttttcttttgaatatcaaacgctatggctcttttgatacagcttcttctgaatctaagccactcgcaaatcatatcgttaactcccaaaacaataggagaaccttccacaagaatgttaaagttacagccaaaactatcctgtaaaggcgtcattttaaagagtttcagcattagtttgtcagggtctactccacgttttaagtcgatagttattttcagacctttgaggtcggtttcgtcacggatatcagagatttctttgactttccctgacttaactaaatcaactattttgtctatgattacttcaactgtggttgtataaggtatttcttttatatcaatgcaattttggctcttgtcatactcatattttgctctgactttgaaagaacctcgaccggtgcggtaaatttccctgagttctgagcggttataaatcagttctccgcctgtcgggaagtcgggagccagcagtgtgtcaagtatatccgcgtccgggtcatgcataagcataatagtagcttcacaaagctcacgcagattaaaactgcaaatatttgaagccatacccactgcaattccttgatttggatttgccaaaatgcttggaaatgtggccggaagcagagtcggttctttcatagtgccatcgtagttatcaacaaagtcaacggtatttttgtctaaatcaccaaataattcactgcatacaggatttagttttacctcggtatatctcgaagcggcgtaggccatatctctcgagtaaacccgtccaaagtttcctttggatttgacaagcggcagcagtaaagcgccgttgccgtcagtaagtcgaaccatggtttcataaatagccgaatcaccgtgcggattcagcttcatggtttgtccgactacgtttgcggacttggtaagattgccgtttaaaagccccattttatacatagtataaaggagttttctgtgcgacggtttaagaccgtcaatttccggaatagcacgtgaaattattacgctcatcgcataaggcatatagttttcttccagcgtatctattatttgctgttcttggattatgggttttttcatttaatatattcactccagtattatgatacatctgccatttcgatgtattggtgtccgttttcggcaatgtgttcttttctgccggcaagattgtctccgagaagaaggtcaaatgtttcctgagtttttataacatcgcatggggtgactttgattaaccggcgggtttcaggattcatggtggtcagccacatcatatccggttggttttcaccaagtcctttgcttctttgaatagaatatttttgtccttcaagttttgaaagaatctctgatttttcctgctcgttgtaagcaaaatatgttttcttttttgaggttatctcatacaaaggggattcagctatataaacgaaacctttttcaataagcgtaggtactaaccggtaaatcatggtcaaaaccaatgttcttatctgatagccgtcaacgtcggcgtcggtacagattattactttgttccatctaagattgtttaaatcaaaagaacttaaatccttattatgttttgattttatctccactccgcagcccaataccctgagcaggtcaacaataacatcgctgttaaatattctgtcatactccgctttaagacagttaagtatttttcctcggagaggaattattgcctgaaattcgctgtctctgccaagcttacaggcgccgagagccgagtctccctcaactatatagacttcacgtttttcaggatctttgcttctgcagtcaacaaattttttaacgcggttagctacgtcaagattgccgcccagcttcttttttacgtttattcttgttttttctgcggtttcacggcttcgtttattaacaagaacttgattgcatattttgtcagcgtccatcttattctctataaaataaatagccagctgttccctcaaaaattctgtcattgcgtcctgaataaacttgttgtttatagcttttttagtttggttttcgtaactagtcatagtggagtaagagttagataccaataccaaactgtcctgaacatcgctgtattgaattttgccctcgcttttattgtatttgttgttggctttgagatactggtcaatagcatatacaaaagcgtttctaacagccttgtccggcgagccgccgtattcaagaaagctggaattatgatagtattcggttgtgctgaactcgttgtcaaaacagaatgcaaagctcatttttaacttatactcagggaggtcctccctgtctcttccgctgcgttcggtttctatataatgaacgctggtaaactctttttcttcagtcagctcttttatataatccactataccgttttcgtatagaaactcaaactcttcaaattcttctttggaaatctcgttttttaaaacaaatttaacgcctgaatttacaaccgcctgacgtctcagcgtttctttataaaagtccaacggtatgtcaatatcagtaaatacctttatgtccggcttccagcggattgtggttcctgtgtggcggtgtctgaattttgtctttttcattccgtcgatattttctccggcttcaaaatgaagctcatatttatatccgtctctgagaacttccacatccatatattcggagctgtattgggtagcgcaggcgcccagcccgttaagacccaaactatactcatagtcgccgccggtattgtttttgtattttccgccggcataaagctcacagaaaacaagttcccagttatattttttctcatgttcattgtagtcgaccgggattccgcggccgaaatcctcaacttcaattgagttatctaaaaatctggtaattattattgtgtcaccaaagccttcacgggcttcgtctatagagttagacaaaatctcaaacattgaatgttcacagccgtcaattccgtctgaaccgaatattacagccgggcgttttctaactctggcagcaccttttagggccctgatgctctcgttgtcatattttttagcgcacatattatattcctccaaacaattcgagttattataccataaaacgaaattattgtaaagcggtcaaatatccaaaaatccgacacaaaaatagaacgccggcagagcgttctatttaataaaattcagtttattttattcagtcatagttctgagagcggctgcttcaggggcatttgttacagatacgggatagcttgtatattaaacattccggcaactataattttaagagttagtttgctgagccagacccggttccgcccgccgggcccgggcggcgcagatatttactttagcagttgattccatataaagttgatgttattggttattcagtttataaacagtaagttaaaaaaatggtttacgcgctcggagctggcgagcgcactgggctaggccgcataccaatgaaagtatcaactgatatggaaaagaagacaatttaaaatataaataacttgtatattagacattccgtaaactataattctaacagtcagtttgctgagccaggcccggttccgcccgccgggcccgggcggcgcaaatagtaactttaattgctgattccatataaagttgatgttttggttattctgtttataaacagtaagttaaaaaaatggtttgcgcgctcgggtccggcgagcgcaactgggctaggctgcataccaatgaaagtatcaaattaaaaggggaaaagacaatttaaaatataaataactttatattagacatttcggtaactataattttaacagtcagtttgctgagccaggtccggttccgcccgccgagcccgggcggcgcagatatttactttaaaatatatagacttcctcaaaatattgacagctttaggtatgttttagaatttagaaataatattataactcgccgcgtctttttattcagacgcggcgtttttgtgtttaaaacaaaaatatttatggtatagttaccgaatttatgcagaataatattattaacaaatatgaagcgtgattaatttaggaaggaatgagatacatggaatatttaagcgaatggacagtatctcctgagaggtggctcaggcttggatatattttgggcgcgtcggaaaacggcggaagaataagcataagcagcgacgaggaggatttgtctaaacttgccgcagacacaatcaaaataggcgttaaatacgcaggctcaaaagtgtataattttggggaacaaaatttgcctataatgcgtcatgccgtcaggttttataaaaccggcttaggcatttttgtcaatacaattaagggcgataacggcaatgtgttaaacgtggatttgttagataaccgcggtattaaagtgccgctcaaaaatttagttaagcgtgaagagttagccaaagctgaaagtcttgtcacttctgatattactatgggaacggttgggcaagaggtaaccttatttgagtttaaaacgcattatatgagacatattatcaacagtatcaaaagtgatacgtttaatatgaatatatgtctttcaacaaaatcaaagactatttcagaaattttgaaggtcgttcttgatgacctatactcaaaaatagagcctgaggcgctggaaaagtatgagttcagcggtataataagcgaaaacggagagcagattaatttatataaatcagacggcacagaactttccagagaacaaattttatcagtaatgatttatgttttgctcagagacagttctataagaacctttgtggttccggacactatatcagaatatactgaaacagcgattttgaggcttggcggaaatgtgatcagggtatcgggcggcgattcggagataatggagaaaataatttccagcggaagcagcgaacaaatgctgatgcagtttgacggaatatatgcggcagtaaaaattttggattttctgaatagatacgatattagttttgacagtctgacaatgcatttgccgcagatttttaaagccgaggcagaggttgcctgcggcgacgaaaaacaaatggaaaatataataaaatctttaaaaagacagtttaagaataatgcaactatattgggcgatagtgacacagacgatgaaaaaggaagtgataataacaaaaaaagtgaaggaattaagattgaaagcaatggaactgtaactattgttttcccgggaagcggaaataatatattaaaaattatttctgagtccgaatctatggaaacggcggaagaaatatcaacgctgtttaaaaataaaataaaaacacttgcaaagagctgaacggtatgttataatgaacacgatttgtgagacaggcgctcgcttgtttcaccgtacggaaccttgcccggttattgccgggcgctttattatatgacagatttttgcatatcctaagattccgcgtctgtgtttcgctgtcaacggtcgatatttaatggctgcgaataagtttaaggcgtttgtatcttggattacgccgaatcgggtcaattttaaaaagtcaaaatcttttcattaagcctgcaggcggaacggatatggttgcattgcagcggaaaagttttgattcggaatggttttgattgcagatttgaatacaaatgactgaaatagtagtgtttcagggacttggtttatgtcttgagtattttatactgagaattttttagttttgataaaatatatagggtatattttttgtattgtattttagtttgtaacagctgttttggctttagattttctgtagggcgtaatgtgtgttaaaacctttgtctgtgcaggaatttgttgttatattatccggaacgaatcgaataaaagttattacaggaggaaaattttgaagaataataatgatacacgacagaacaacaataagcaagctcagaacgtcgctaacaagatggcgcataaggtcgtggataagatagctaaaatcagcggcgttaatgagaaaacaaacaacaataataatcgaaataaaaataataatagtaacggtaaaaacggaaacagaaacagcaatggaggaaacagaaagaataatacgccgaaacatacagataaaccaatccgtattatacctctcggcggactgaatgaaatcggcaaaaacttaactgtgtttgaatatgaggacgatgctttgatactggactgcggtatggcgtttcctgacgatgatatgctgggtgttgatattgttattcctgatataacgtatcttcataaaatcgcggataggattcgcggcatagttttgacgcatggtcatgaggaccatatcggagctttgccttatgttttaaaagaattttcagttccggtttacggaactagacttactctcggtattttaaaaaataagctcaaagaacatggtatactgaatcaggtaaagcttaacacgattaatgcaggagacaaagtgaagcttggagcatttacggctgaatttattcatacaaaccactcaatagccgacgcggtagcaatcgcgcttcatactcctacaggtataatactccacaccggcgattttaaaatagattcaactcctatagacagcgatatgattgacttggctcgtttcggcgagctgggaaaggaaggtgtgttagcattattgtctgacagtacaaatgctgacaggcccggagtgacatttagtgaaaagtcaatcggaaagacatttgacaatctgtttgaaaaaggcgagcagaacaagcagaggataatagtagctacgtttgcatccaatgtacatagggtgcagcagattattaattccgcggtcaagtataaccgtaaggtcgctgtgtcaggacgaagcatggaaaacgtaatatcggcggcaatagagcttgagtatatgcacgtgcctgaaaatacactgattggtttagatgagataaacaagtatcctaaagaacagcttgttgttataacgacaggaagtcagggagagtcaatggctgctctgacaagaatggcgtttaccagtcacaaaaagattaatatagaaccgaatgatttggttatcatttctgcaagccctatacctggaaatgaaaagtctgtagccaatgttgtgaacgagcttttaaagcagggagcagaggttatatatgaaaaacaggctgacgtccatgtttccgggcacgcctgccaggaagagctcaagatgatattgtctttagttaagccgaaatattttattcctgttcacggagagtaccgtcatctttgcaagcataaaggtcttgctgttcacacgggtatagaccctaaaaatatatttgttatggacttgggtaatgttttagaattgtcgcgctcatctgcaaagatagtgggttctgtgccgtcaggcaaagttttggttgacggattgggtgtgggcgacgttggcaatatcgttcttcgtgacagaaagcatttggctgaagacggtataattatagtggtaatgacaatagaaaaagagagcggcgagtgtgtttcaggacctgatataatatcaagaggttttgtttatgttcgggaatctgaagacttaatggaagagattaagaaacagacaacttctgttgttgaaaattgtttatcaggccacagttttgactggactactctgaaaacaagagtaaaaaatgatgtcggcaactatctatatgtcaaaacaaaacgcagaccgatgattcttccgataattatggaagtatagaatatttgatatgtaaagttttgcgtattagcccttgacttatttggactcatatagtacaatgaaaattgatgtataagaactatatgtcagacagttcattagtaccatcctgtctaaaaataaaactagggcgagttttgaatattacgtaaatctgtgcatattaacataaaattttaattgcattgtttcgtcaataaacaaaagacgctctgtcagagcgtcttttattattataaattatttaaataaaaaaggagattcggatatgtatacagtttcgtgtgaaacgcattttgattcagcacattttctattaggttataaaggcgggtgtaaaaacattcatggccacagatgggttgtcagcgcgtctgtcagcagtgaaaccctgatagaggaaggcggaaaccgaggcatggttatagactttaatgaagtaaagcctgttttaaatgaactcgtagaatgttttgaccacagacttgttgttgagagagatacgcttcgcagtacgactatgcttatgcttgaggaagaagagtttgaggttgcagaggttgatttcagacctacggttgaaaatttttctaagtatttttatgatgaattaaaaaagcgcggcgttcctgtatccaaagtaagagtttatgaaactccggaatcttatgccgaatactgtgaggactagtatgaatcatgacagccaggcgtttaaagtatgcgagaagtttgtaagtataaacggtgagggaattaaagccggacagctttctgtttttgtaaggtttaagggctgcaatcttgactgttcgtattgtgatactaagtgggcaaatgaaaaagacgcggattttgagtctatgtctacagacgagatagttaagtatgttgttgaaacctctgtacagaacgttacattgacaggcggcgagcctcttatacagcccggtatatccgggctgataaaaaacttgaaggaaaacgatcttaatgttgagattgaaacaaacggcgcggttaacttgaagccgttttgttctgacgaaacgcgtcccgattgttttacaatggattataaactcccctcgagcggtatggaagacagtatgctgactgataatttcttttatctgaaagacagtgactgtgttaagtttgtggccggttctgaaaatgatttagaaaaagctctcaaaattatacatgaatatgatttgacaaaccgctgtcatgtttatatcagtcctgtatttgggagtatagaacctgtcaggattgttgagtttatgatagaaaatgttttaaataatgtaaatttgcagattcagatgcataaggttatctggaatccggaagaaaggggagtataaatttggctgagaataagaaaattgacacaaaagccattgaggagcatatcagaggaattttgacggctttgggagacgacccaaaccgtgaaggtcttgccgatactccaaagcgtgtggctagaatgtatgccgaagtttttgacggtatgaattatactaaccatgagatagctcagatgtttaataaaacatttgaggacgatccggattcatatcataactcaaacgatattgttgtggttaaaaatattgaagttttcagtttttgcgagcatcatatggcgcttatgtatgacatgaatgtttcggtggcgtatattccaaacggcagagttataggtctgagcaaaatagccaggatagctgatatggtggcaaaaagactgcagctgcaggagcgtataggttctgatatcgctgaaattatgcaggagattacaggcagtgacgatgtggctgtaataattgaagccagccatagctgtatgaccgcgcgtgggattcaaaagccttcggcaaaaactagaacacgtactatgagaggaaagtttgagagtgacacgagcttagtcactcagcttatgggagagtagagtaggagacgataaaatggataacaaaaaagctttggtgcttttcagcggaggggttgacagcactacagcgcttgcaatggctgtgaaaaagtatggcgctgataagactgcggcgctttctgtttcgtatgggcaaaagcattcaaaagaaatagaagcggcgcgtaaaattgccgattattatggtacagaattactagagctggacctttcaaaaatgtttgaatacagcagctgttcgcttctaaagcagaatgaggatgctgatattcctaaagaaagttacgaagaacagctgaaagatgctgacggcgagccggtatcaacatatgtaccgtttagaaacggtctttttttagcatctgctgccagtatagcgctatcgctggaggctgagataatttattatggagcgcatagcgacgacgcggcgggaagcgcttatccggactgcagtaaagtgtttaatgacgctatgaatactgcaatatatgaaggcagcggacataaaataaagatattggcgccttttgtggaatggaataagaagcaagttgttgctgagggcgtgaaattgggagtgccgtacgaaatgacgtggagctgttacgagggcggaaatgagccgtgcggtgagtgcggaacctgccgtgacagaagagaagcatttttggctaacggtcttgatataaaatagaggtgatagatttggagaatattcaaagagagcaggaaggtttgactttgctgggaaatcagaaaacggtatataaagcagattatgctcctgaggttcttgaaactttcgagaataagcatagagataatgattattgggtaagattcaactgtcccgagtttacttcgctttgccctataacaggtcagccggactttgcggaaattattatttcctatgttcctgatgtaagaatggttgaaagtaagtctcttaaattatatttgtttagttttcgtaaccacggtgattttcatgaggactgcgttaacaaaataatgaaggatttgattgagctgatggaccctaaatatatagaagtatttggcaggttcacgccgagaggcggaatctcaattcatccatatgcaaactacggcagacccggaacaaaatgggaacaagtggcttttgaacggcttacacacagagaaatagtataagaaagttttcaatttgctgttgtggaaattgaattcagtattataatgtataatagtataagagtttattagataccgtttttaaaaagattttttcttgttatgcgggatatttgatatgagaataaaagtttgtgaggttacaatatgaatgaaatatatgattatcatattgttacagatagttctatggagaaaggtcagcatattattttcaatgatgttaattatagcggcgtttataaaagagtaaatgataaaattcaaattgtgaaagatatttatatatcccgaaaaatataatgcggatttttttgaatatcatacgaaggtagcaatgagagaattagcattagaaaaagtgcgtaaagatctttatcttgagtatccgtccagaatgagctgtttatatgtttcgaacagtatagaagaatctgaaaaatgagcggatctgtttattgacttaaatataccaacttattttattgttaaactgaaaataataggaaacatgtttgtaggcgatgccaataattgttttgaagcaactttatataaagacaaaaatttattgcttgcaaaacggtactggaacaactgtcctaatgaggatggtgttccttcaataaaggaaatattagtaaatggtgatattaaggttattgaaattataagagaaataaatgcaaatgtataattatagtttaaagctgagccatagtttccgttaataaaaaaattttccaagcttttttagtttgatgataggtatataagaataatatcgttattatttgatagcgaatccggattttttattattagtaaaaaagttaaaatatactaataatattgaagtgtcaaatgtcttaactagcgtgcgttttaataaaatataattatacttagtctttacgtgttgaaatcggcagttatatgtataacaacgaaaaaatcaagtttcagaacttttgatttttaagaatagattatattattgcatatatgaatattatgacggctttttaaagccgtttttattgtgcttaacttatagtcaaaaattttgaaaattaaagtcaaaaaccataacatcactattgtttaaattttatatcaatggtataattatcctaataattattaataaggagataaaaatggatactgtagaaacaaaaaattttattgaatccgggcaggcgattcttggaattgagtttggttcgacaagaataaaagcagttctgattaaccgtaatcatataccaatcgcttcaggcgcacatgactgggaaaacagattggaaaatggaatttggacgtatactcttgatgatatttggtccggggttcagaaatgctatgctgatatgtgtgatgatgtttataaaaaatatggcacgaaggttgaaaatctttctgctataggtataagcgccatgatgcacgggtatatggcgtttgataaaaatgatgaacttttggtgccattccgtacttggagaaacactatcaccgctgatgcggcaagccgtttgacagaactgtttaatttcaatattccccaaagatggagtattgctcatttgtatcgggcgattcttaatggagaggaacatgtaaatagtataaactacctcacaaccctggccggttatgttcactttgtgctgacaggtgaacgtgttattggtatcggagacgcgtcgggaattttccctgttaattctgaaactaaggattataattcagacatgattaatagttttgataaagtgatttctgaatataatttttcctggaagctgtcagatattttgcctaaagtattggttgccggtgaagaggccggagtattgaccgaaaagggagccggaatgcttgacccgacaggtgctctgaaacccggagctcgattctgtccgccggagggtgacgcaggaaccgggatgactgcgacaaacagtgttgcgaaacgtaccggaaatgtttccgcaggaacatctgtgtttgcgatggttgttcttgagaaagaattgtctaaagtatattctgaagttgaccttgttacaaccccgtcaggcgagccggtcggtatgattcactgcaataactgcacttctgatataaacgcctgggtaaatatgtttaaagagtttttgacggctatgggatttaatgcagatatgtccatgctttataaaacattctttgaggcggctttaaagggagagccggattgcggcggactgcttgcgtataactatttttcgggcgagcatataacaggatttgaagagggtagacctattcttgccagaactcctgaaagtaaattcagttttaacaattttgctcgggtttgtttatattctgcgttagctacattaaaaattggattggatataatgctgaacagagagggtgtgaagcttgaaaaaatgcttggtcatggcggattctttaaaactcctgaggtaggacagagaattatgggcgctgcgattgatgtgcctgtaacagtaatgtcgacagcgggagaaggaggagcatgggggatagctttgcttgcagcatatgtaatagagagaaaagataacgaaagtcttgatatgtacttggatgaaaaggtattcgggacagatgccggcactaccattgaaccacgagaagaagatgttttagggtttaataaatttattgaccgatataaaaaaggtatctctattgagaaaacagcagttgaaagtttaaattaattattgatataaatatatttttagtaaaaataatatactaaatattttgatttgttttataaatatagaaataagctgtctattgttggaccaacctcaaaaagttagattaaaagtctgacaattggaaggccggctaatatttgacagcttatttttattaatatataaagtaaataatagcggaaagtcagctgaaaaccggacggaaaaattaaaggtgtttttagtgaacatcggtaggcttgtgttaacaagcgcgttaggtgagctaccatctgaacacgcagtgttcaatatataaagtaaatatttattaaaatttactttgtatatgaccccatataaaaaaattttttattatataataatgtatttgaatcatttaattattacactaaaaaagcgcgtttttcagtgaacttcggtaggtgtatttgtgaccacactgaaggtaggggtcacagacatagaaggataatcaaaacaagtcactgtatattagcagacagagttttattctgttgcattttttataaatggaagacccttttggaaaagctgaataattacgttcaagtagtttttgttatattttatttaattaaaataagctgtccatttaggacagcttatttttaaaatttggagcggaagacgagattcgaactcgcgacgttcaccttggcaaggtgacgctctaccactgagccactcccgcatatatacactttttaatgcttaaatattataacatgaagtcagttatctgtcaataccttttacaattttttattatattttatttacgtaaaattattttatactaaaattatagttctaacgatgaaactgattataaatatttaaattaaaattttattaaaaagtctattgaaaacaagtcagtaaaaaatcagcggctccgtaaagagccgttggatgtgaatagtaattttaaccgccgaacaatccttttaccttatcaattatgccttcagcttgattttccaaattttctacaacgcttccgttagggtcaagctttgccttcaccatgtcagctatattttttaattgttcgtccggcaaatcaattccgataagaccttctattgttttgattgggtcggatttaaagttgtccatcaatccagcatcagattgaagtttctcaacggcttctttggctttgtccataatttctgcgatttccataattaaacctccttaaaatttaaataaactgcttataaatatattttaaataaaatgtataaaaatgtcaatataaaattgtatatttaattaaatatttttaatatattcaaaaactattgcagcgatattgatttattaggataaaaataaggattttatttttaatagtataaatggcctttatataaagatttggattttaatacagtatttttttaatatatgttatattaaaaatttttaaaaattatagaatatatgaagtgaaacattatgaaatgttcacgctgcgcggaatatgaccggtcactcagcgggttgtgtaaacacgcaatacgtcaaactaagtcttattatatgacaactaagttaattattggcgtttatagtttatataatatacatttttgtttaaaagtgtagtcacagacattgaaggcttaaggataagagatacgttggctcacacctacccacaggtaggggcatagtacacctgccgatattcactaaaaatactgtcgccgtataataaaaattaataaataaattattatacttgaatacacaaaattccattacatccgctgtacatacttagaaaagtttgttatacttttttcgattacaaacttttccgcagctgcgcgccttacgcggcagatttcatctgcattgagtattcatattattgacattgtaggtaaatcaaaacaagttattttgtattacatccaccttttcaggtggagtcacacctatcgaagcttgctatactgcatttttattcaatttttaatttctttatattgtaaacacacttaacgtttctgtatagttttctgtttacttttcagtttattcagaatatgaccggcagttctaactcgcattatattaattgattattgcggaacatggtttaaaatatgtaaatgaagtgaacctgtatggattatatagagaaggtaaattccttttatatagtaaagattgaaaatttattgattaagattaaaaagcaatttcattgaagatttcatgatatattaatttttataacaatgataaaagtacatataaataaaaggaatgaattaggtattgtacctaattcattcccattaaagctaataaaaatctgtctaaacttttgggttcatttcaaattgaatcctgttctgtaatattattttattttgtattctttttaattttgtcccaatattcttttgcggcctgttcgtttttattatttgcgtattcataatactttttatcttttatattgtcaggtaaatactgctgaacaacataatggtttggataatcatgcggatacagataattctgtcccttttcagcattcccctcaccgtcataatgcttgttttgcagctgtcttggtattgagccggtgtctattgtttctatatcacgaatagcgttgttgattgccatataggccgagttggatttgggggcggtcgccagcagtacagcggcttctgccaaaggaattcttgcctcaggaaagcccagcatgagcgcgctgtctacacaagcctttacaatcgtaatcgcctgcggataggccagtcctatatcttcacaggctataaccataagacggcggcaaatcgactggatatcatcggcctcaaccaaccgtgcaagatagtgtaccgctgcgtcagggtcgcttcctctgatagatttttgcagtgcgctcatgacatcgtattgactgtcgccttttttgtcaaacttaaatgactttttttgagtacattgctcagccagctccatggttattttcaggttgccctcgctgtcgggaggcgtatacataaccgccagctccaaagagtttaacgccttgcgaacatctccgccggctttttcggctaggtgacgcataacgccgtcttcgcatattatttttgtatccgggaaatcatcggtttgaattttttcaagcccgcgttctaaagccacagaaatatcatcaggggtcaaaggcttaaactcaaacactgtagagcggctgagtatcgcgttataaatatagaaataaggattttcggttgtgctggctatcaaggtgatttttccgttttcggtgtattcaagcaaagattgctgttgttttttattaaagttctgtatctcatcaagatacaaaagtattccgttctgtccaaacagcccgtcgctctctctaacaatattttttatatccgacacggacgcgtttgttgcgttaaggcgatacagcgccttgtttgatgatttagcggctatattggcaactgtagtcttgcctgtgccggacagtccgtaaaatatcatgttggggatatttccgctctcaataatatttctgagtatgcggttttttcccagtatatgctgctgacccacaacctcgtctaaggttgtgggtctgagtctgtccgctaacggtttattattaagcatagagtgggtgtttgtcacaaagagcctgaacacgttttttaacgtcctctttgtttccttcaaaatctttgataatcaacgaaataagttctgcaacttcaaccatgtcttcctctttaaaaccgcgggtagtaacagccggagttccgagcctgattccgcttgtaacaaacgggctcttagggtcgtttggtatggtgttcttattacaggttattccgacctcatccagcatcttttcaacttctttaccggtcaaatcctgctttatcaggctaaccagcatgagatgattgtcggttccgcctgaaacgatttcaagccctctctcctggagtgcttcagcgagagcggaagcgtttttcttaacctgcttttgatattctttaaagtcgtctgacagagcttctttaaagcatacagcttttgcggcgatcacgtgcataagaggtccgccttgatttcctgggaaaacagctttgtttatcatcggaccatatttttctttgcaaagaatcatgccgcctctaggacctctaagggttttgtgagttgtggtggtaacaaagtccgcataaggtactgggctttggtgtaaacctgccgcaaccaatcctgctatatgcgccatatcaaccatgagataagcgccaacctcgtcggcgatttcacggaagcgtttaaaatctatttctcttgcgtatgcgcttgcgcctgacaatataagtttgggcttgtgttccaaagcaagctcacgaaccttatcatagtcaatgcggtgcgttaccgggtcaactccgtatggcacaacgttaaaatattttcctgaaatatttaccggtgaaccgtggctgaggtgtccgccttcagcaaggctcatgccgagataagtgtctccgggctccatagctgcaaaaaagacagcaaggtttgcggttgctcctgagtgcggctgaacgttggcaaattcagcgccgaacagttcctttgcgcgctctctggcgaggtcttcaactatatccacatattcacagccgccgtagtaacgcttgcctggatagccttcagcgtacttgtttgtaagcggagtgcccattgcttcgataacggcttcgctgacgaagttttccgaggcaataagctcaattttattgcgttgtctgttgatttctttttcgattgcctcagtaacttcagggtcaaccgattttaggttttcaaattcaaacatcaaatagtcctccaaatatattatttttattatttacaaaataaatgttgaaaaaaacatacattcatattataatgttaaaaatagatttttgcaaggggtattttaaatatgagggaaaaaattgctgataaaaaagagagaatattaaaaataattgagatatttggaaaagtgtacagtgacgcggactgcaccctggaatatgacaatccgcttcagttactcatatccacccagcttgcggcgcagtgcactgacaagagggtcaatatagtaacaaaggatttatataagaagtatagggatgtatatgattttgccaatgctgacgagcttgagcttagagaggatattaagtctacaggctttttcaggaacaaggcgaagaatataataggctgctgcaagatgctgatatctgattataacggagaagttccacgtgaaatggaagacttgctgaagcttcccggcgttggtcgaaaaacggcgaacttagtcagaggagattattttgggataccggggatagttgttgacactcatgcgaccaggctttcgaacaggttagggctcacgacaaacaaggacccgaagaagattgaaatggatttattaaagctagtgccggaagaatatcagacgtctttctgtcaccagctagtgtatcatggaagggagtattgtcctgcggcaaggcctaaatgtgatatatgtcctataagcgaattgtgcccaaaagttggcgtatgattttttattcattaaaaaaattatatatctactatgtatatgaccccatataatatatattattttacttataataggtgtttgaaccatttctttttctggcaagaaaaagaaacgcttcacctgtgaccacacctgaaaggtgtgtgtaataaaaagttacttgttttgaataacctacgatgtcaataatatgtaataggtgtttgaaccatttctttttctcgcaagaaaaagaaacgcttcaccaaagaaaaagtgcttgctcgcttaggtcgcctgcggctccaaagggcgctcgcccccgctaatttcatcttgaatctgcgcttcaagatgaaaaagccttgttactttcccgttgactttttgaactaccgtgaataatccttagccgataaatcacataaacctcaccatcatcccaatcagcataccgctgatgagttgaaattgattactgatatgcgccgccgtaatcctaatgccggacttgttgtgttttgggttaagcttcgtcaaagaggctatactcgttctattacaggtctttaccgcatactccgcaaacagggacaaatgccgatagaacattagtaccaatgagagcaatattcgaagcattgggagcagaagtagaatgggaaaatgaaacccaaacggcaacagcaacaaaggatggaataaaagtatcagtgacaattgacagtaataggatgcaaaaaaatggagaagaaataaaattggatgtacctgcaagattagtaggagacagcagaacatagaggttgcattgatgttttcccacaaaacaggggttggtgtcaatgccgtttctgaaatattgaacgcagcatttaaaagaggtatttttgacaggacgctgtatgagaagtacaaaattctaacatcaaaagggatacaggaaagatgtatgaaaatgtgctcaagaaggaagcgttttgaagtcgagaaaaaataccttttaattagtgtacccattagccttgaaaatgtatacataaagggcgaaaatgttgacatttctgaagaaaatgtatacatttttacacaaagtaaagtaaaggaaagaaaagtaaaggaaagtaaagtaaataaaataccggccgtgcctgaagagagcaaaaaacaaaaacacaagtatggaaaatataagaatgtgttattaacagacgaagagattaaacagctgagagaaaaacttcctaatgactgggagaagtggatagagacattttcggaaggcctggagcttaagggatataagtataataatcattatctagccatactccagtgggaggagaggaacaggcggaaagaaaccggaatcagaaaaagcaagtttaataattatattgacactaacaaaactgattatgaaggtttagaaaagaaattacttgataacatgttaggggaacagcgatgataaaattcacgataagcggaaggctgccgagccttaatgattatatcaacgtatgcagacataacaaatataaggcggcggcatttaagaagcggattgatactcagataatttctgagatacggaaacagcggataggcaaagcgaaaacgccggcatacatagaatttttatgggttgagaaagacagaaggagagaccttgacaatatatactcgggtaaaaagtatatattagacgcgctgcagaccgccggagttataccaaacgacagtcagaagtacgttatgggtttggtggatatgattgcttttgacaaagcaaaccccagggtggaggttacgatttgcagtgtggatgtttaactgtatttagagaataaaaaacgcagatatttaatctgcgtcttcgccgccgggaccgtctcggcgttctctgttatcagggtaatggtccatgttagtgctaacccactggttatcggtggcggtcttttctccgttttcagactgatgtgtggggtcgggttttctcttattcatttttatcacctcaaatatagtattgccaatatttgctgaattattacgggatttatgcggaactaaaatataatatataaaaggaagaaacaaaaatgtgtaagttaaagagtgggattattttaaaagataaggtgtttgtgccgtactatgatagacatacaaaaatgttagaagaattaaaaatatccgatacattgaaaatgctaataaattatacgttcgcgcggagcttataacacctaacggagacgtctttagtccgattgatgactgaagtttttatgatgaccaggatattattccgcattagattgtagaaaattatgaaaaaacgtgtgtgattaaagcgattaagatttgggttggagagcacatatatatcaggaaatcaaatttttttgtagacaaagagaattattactttagatcttgtatgggagtgttatacggcaacagcagagttagagcctgcggcgactgtacggtttctataccttaatggtctgccaatagtattgagaatattgtgcttatggaaaagttcacctataaaaataataagacaaaaacaatatactagagtgaaaatcgaaattagtcgctgttgataatgttggagggaaaaggtgaaatctgataacggaaaaccaaaacctacattgtgcccggcaaaaataattactgcggtagccaggataagagagtgtagaataaaaaagtatggagatagtgacagctggaaagatgttgagccgcaaaggcatatggacacggcttccgggcgctttgttgtatacataaaagaccctttgggcgtagatgaagaaagcgggctgccgcacttgtggcatttggtttgcaatactgcgtttttatataaattggaagatagaagcagcaatgatagctgaagatatcaaaaagggaatttatgagaaatagatatgttattatttgtaataattgcgaatatttggatataaccaaagacgtacacaatatgagtaattataaaaaactcatatgtggaagatttacaatactaggttgttacatttaaacgcacatccgattttatatctgtgtggtagttgtaaagatgataattataaagggttcgtattttataaagattaaattcaagtattatgtagtatatcattttttattttctaaaaaatctttttgcactgttattgttgccaatgtgtcgccgagctgtgtaaatattgcggccagcagcggcagttcttcaggctctgctgattgtgaaatgcttgctgcaatcgcggttaccacagcagtaatagcaatggggtccatacaaaaatcctcctaaggtttatattgtatattatgtaattctattttacttgtgaatatgataattttatttgactgggtgctgcaaaacttatgacagacgttgtcaaatacatgcggcctaaacttgagagaaatactgaaaaggtaataactaaaaaataaacgattattttgatgcggtccagcataaaagtgagctccgaaactaaaagtaattataagttttaataaatgagcagattgcctagacgttatcagcccaaaaaatctatataaacttgaacataatttatgtatgcagacatttacttagttaaacgctataaggatttaagacataaaaaacggcgagtctttatatggcagcgctctgcctgccgatggtatgttccgagtaaacaggacaagcgattcaattatgcgtaatgctttacttttaactgaaatatcggtgcaaattgaagcgatagactaaacaatatcctggttattaaatatgacatatgatgaatggatagaaaacctgacagacaaacaaaaagaaatatttgacaaaacacgttgtaatatatagaaccaaatcagctgcaagaaacaatatgcgaggtataccgaggtttgggttaaggagaatgtacctaaaacgtttgacgagttcccaaatataaagtataataaaattagtaaatataaagagttgaagttaatatatgcagacacaggattaaaaaaaatctgtaatacatataatcttaaaatacttgaaggtaaacatggcaaacacgttttgggataatatagaaactgttataagtgatagaacagttggatacagcttaaatgaaattgacggttctgaaaacgaaatgagagctataaaaattcattatttaaaaaaggaacatatatcatgccgagaaaggagtaacagatatggatttatgtaatagattgagagaaattgcagaaaaatatacacttgataagaatttaacccttagagtgatttgtgttgaagttacatattttaccggcacaaaagaacttataggaaaatatgatggctatattcaagcattggataatgaacccgaaatagcacaattagaattgaagatacctcaatatgcaaatggtattgtatctttgttagaaacggaaattaaatcaatagatgtaataaattaagcatctttgcgaatacaaggtgcttttattattcaaaaaacgaggtgataacatgatgtcaaaagacacaacaaattaataagcaattgcaataataaattaatattgagggagccgtagaaggctcttcttttgttacgaaaagaaggcgggattatatgagcggaagttaggggaattaactgtaagatttgcgggtgacgcgtcgtcattaagttctactatatcttaggtgcggccagaattatccggtatgaatgcaatgtcacaaaaaggcgtgaaaatcatcgcagagcagacccggcaaatgggcggatatgataagatagtcgcaaagccggcctaaagtctaaagcaaaagcaaagtatattggctgaaacggaaaaagagtataagaaaaatactaaacagctgaacgaaaatataaaagggctaaacggtcagaaatcagctataggcagtcttatgacttagaaaaatctgagattcaggctttggaatctgccaatgcagggcttgataaaagcagtcaggcgtataaggatggtgtattcgccgttatatctaaatggattattgtcattttcagttttacccatatggtttccgaatgcgtcatatggataactttttagtacggcttccgtttgtagttgatattatcgaaatatgtcggttttctctgtatacataaaaaactgaaacggaactatgtcaattttttatgcgtacacttgtcaaactaatggtttcttggagggcgtaaattatacgccctccaaaacaattttagttatactctttgttatccttagtcccattacagctgacagtaaaatacttattttaatatctgatttccttccgaatttatatagtaattaaattaattttaatccattatatcatgttgttttgttaaataatcttcttctaattttatacgcgtattaattcttctataattataaagctgcgtataatcacccacctgtctcgtatgtatatacaatgcttggtttacaagatataaatattcatatgctgttatattttcttctaattgttccggatatatattcatttcatattcgcttaatgcgtttttacaatttatcattcccgtatctatgcaaaactgatagtatgggttacatacttcctgattattttcataataatactttgctatatataaatctgcgtaaaatcgtgaaccgctggatgttgataacattctgcatattgttacaaatgcttcattatatgtcatattattgtcaaagtttgcatataatttcccgtcttgttcttgtcctgttattaaattataataaaataaacttgcggctaatttatagtcatatgacaatggttctatatcagaaaattcaaattttcgtgcagtcctataatttccataataactattcattccatataaccacgcctctttttcaagttcatcttttatttgctctgctgtataaccgctagttattccaataaagtctctatcatatgtattaaaaacatatgatatttttaatgcatctcggcgagtaattaaagaagtttgattccaacgtgattcagcatttctaactatatccaaactttcaagattttctattgctgttaactcattgcctagtttgaactgctcctctgaacttaactctgagacatgcgtatcttctgcaaaaacaaatacatttgttaatattactattatcaatacataaactatttgtttcatttttttagctccttttatcttaaaataatgtcatactagataaagtgtttatttagtaatgttactcttggcatactgcctaaactttcctcgtttaattctcatgagatcgtataaggcaaatactgtattcatgcaccataattgtttccaatatatgacttatgcataaaaaactaaaacggagctatatgtatttattaaccatttaaaaaggaagtatttgatggattgttattttaaacagttaattaattttatatatttaaaaacctttcggtgttttttattccgttttagttttttatgagtatgcttgtccttttaaatatcatcttgtcaatttgttaaaattaaagtattgctgttttcctcataatctactttatatcctatggctgcacagaattctcttattgacacatatgtatcatcaatattattattaaattttctttcatatctttctattgaattttcttcaattattttcttaaatttctcttcacttaaattatcatatatactattttttattccaagataattaactaatattctatcgttttgaaacaagtatggatatatagaattatcatataaatgtccgtttatatttaaatacagatatctttttctagcctcaaaaccctctctctttaatattatatattctccataagtttttccatcatattttaaatcacatcctgccttttcaggaaacaatttattgtctgcataatgtaaattaatttggcattttaataaatttgaaattatttgtttatatgctgctacatttataggcatatttaacatttcaaattgagtttcagtttcatcaattaatttatatttcaatgcttttttatatacttcttcatctgtaaaaatataatctccgagttcttaaatacattcttctcccgaaggttctaaacatcggatgcaccaagttaaaacttcacatattttagccttatcatatggtctcacttcccagccagcattgtttttcagttctaatttaaccattccaatggaccacgaatataaaacatagtcataactataaaaatcatttttcggattatagtcaataaatggtctgcctaagtacattcctcccatatcaattaaatcttctgtcaaacctataattttcattatgttaacaatacagtcttctcttgtaaaactatcattctcataatttttatacaatatcaattgctctgttagttcatcagtatttatttctgttttgtctaatgcatatgaatttattgagaaactttgaaatatcgcgcatgttattaaaataaagaatattattttacttatattatttttcattttctatccctttcaatcattatcatactgtatttaattcaggttcaactattataaattttttaatttttctatgcaaattatttgaatagaatattactattttcattttataaattcagttaatatttcatcatttttatttccaatttttttaatcaaaacgtttataatacaactattctctttatcaggatacataaatacaggcacaatattttcatgctcatttctatatcccataataaatttatctatatttttatttgatgtaattttatagcttgttttatttatttcctttttttagataagtttttcaaattaacttttatactaaattattatataaatccatatgtttttacatcacttgctaactcttctgatatattataaaattctgcaattctttgtggtgaattattgttcaaaaacagattataaattgattttgtaataatacttgatatttttgttcttatatttaaatgcgattttgtatagttatacataacaaatctatatataaaatttaatacaactatcacaataactatagagactaaaataataaaactttaagttttctcatttacgcatgttcctcactctaacaatataaacatacgtattttatatatcttgtccatataaataataatctgtcaaattagaatttgctttttcatctgtatgctgtgtatagtatatatcgtcattatcagcagaagttattattgaagcatattctatatttccgtcttaataataactataggtaaaacttaacttcacagcttcattatacttccggtttgtaacctttgtcaacaaatataaatgtaatcgactataaatggttgattatgtgaaagttaatgacgagaaatttgtttgcggtgtatatttcgccttctaggctgttttgttgaaatgcttaagtcattttgatatactgtcatcaaagaaaaatgggagataatggtatcaaaaaatcgacaataatatttctgataactgtgtttattttatgtctgagtttatatttgaagacagagctgcctgggtgaccgatattaacggaaacagcagtaagattaataggcggggcgaagttattcttccatttgctgtgcttgcagtttatgattctcacaacatactggttggtaatgaaattaaaactcttgaaagttttgaagacggagaaactcaaacagttgtttttgatttggattccacggatacacagagaatatgtcgtctttttatttgggatagtttgcaaacaatgcgtccggtttctgttcctgtagatatagaacagaatgaataaaaatattgtgtaaaaagaatgactgttaattttattgacttatttaacagttaatatgtttattatactatggggggattaaagcatgaaaaagataattggtttgttattaactttgtcagtatctataggtattttgttatttagcgctgattccgttattgcggcgtcttataacagttctgctgctttaaattacgccgcggctcattggaatgataacgttggtctttgcgccgagtttgtttccaactgtttgagtgcgggaggatgcagtgcatggagcaggagcagcagcgctttaagaaatcagctgataaattccggacttggaaccgagtatgaattaaccttgaattcagataagtcaattacagtgtcgaactattcagggaagttagctgccggagatgttattttttattattgtcccggagcgaaatgtttaacttttatatagaacagatgttaattagacaactgctaatattaaaaagtagttgctattttagagattttaaaatttgaaatgttataaataattagagtgcagtttaacttgatgtaaaggcgaggtatatatttagtaaatttatttttaatttgctgtgtattatcagaacaaagaatttagttttataaaaattaacagaaccttagtgaatactagagttctgtttttttgcatattttatattaattgcgctatatatttgtattggttgcgattgtttttctatagaatataaaaccatctgtttgaataatatttttacaaaatatatataagtaatggttttattatggaattatataaaatgaaaaatagtatacatataaattaaatttattgcgtcacagagcagaaggctattcgccttctgcaacaattttttccaataccgcgataaggtctgacatagtattcagctgtacgtctttttcaagaatagcattctttaatgcgattggtaagctttcaaatttatcgcgtaagtttggagctacatatgacataaaaatcacctctgaagtatatagtatccaaatgtcagataaacatacagtaaataaagttcaaacaatgctttattaaaatgaaaaagctgctttgttattcaaaagagacttattcacgtgttaatatataatataaattagcataaattttagtttcagggcgttttgaatgaggagaataaaaatttttgcaggtggattgtatttttgatgatatgtataatttgctttaaaataaaatattaaaatttaaatagctaattttcagatgtattatttaatcagtcttttatgcttattaatttgacataggttcgtcatttatatcagcgtatttaaactttatggaaaaaccacaaagcattattcacgcagttattagactgcataaatttgcgtctcccaatttatcaaagtcaacatgccaaagccatgatacatcctttctattatttgcaaggccgtttatcgcagagataaaattatttttttataatcatctgcacaattgattggctcgcatagtcggaatttatattacacaaagtattatagcttgtaaaaagtttcattattttaacataaagtctccgcgataaagaatttatgtgcgataagtcacatatctttttgtacgagaaattgataaaatatctttatattttgtcaaaggatgtggagaaatggaaattttaaaattgtactttggaaaaactttatactataaaagactttattttggcataagtcaagaagcaatggctgaaaaatgctgcatatcattaaggcagtatgttgatatagaaaatggaaagagattgccgtcattcaaaagtttaattaatatcataattaaaagcggaatagatttggatgagtttattaaggagattcaagaggagggatatactccggaagattataaaaacgtaaaaaataattgataagtttatatcgttttaatgaattaaaaatatgatataaaaccatatttaaaacaaatagtttccggttttattgtatttgatttgaactataaaatttttgattaagaaactaacgaatttattatttttaaaatggtgtttaaaagtaaatataaatttgaaacagccgactgcattactgcagtcggctgttttattatatcagtagtttgaacacgaaaactgcccggcatatgttataatttatcctttatcttacatttctgttcactttacagcaatttttcattttttactgctgcgtgaaaaaatctgaagccgtataatagactgtaattataaaaatattttatttgaggttaagaaaacgtcagtatatactgaattaaaactcgtatagaattatatatgaattgtcaaaaaacgacttccattgcagtcaatatataagaaatagtgctttacaaaaaattttgtcagtgttaaaatataactatagaatataaaataatgtggtggtacatatgcatgatatatggaatccgtggcatggctgcgttaaatgcagcgagggctgtgataactgctatatgtattttttggacaaggcgcatggaaatgacggttctgagatatataagactaaaaatggctttcgatatcccattcaaaagagcagaggaggtggatataaaataaaaagcggcgagatgatacgggtttgcatgacgtcagactttttcttagaagaagcggatccgtggagagacgaggcgtgggagattattagaagcagaagcgatgttattttttatttgcttaccaaacgcccggaacgtgtggctaagcatttgccgaatgattggggagacggctgggaaaatgtgttttttaatgtaacttgtgaaaaccaaaaaagggctgatgaacgtttgcctatcctgatggagctgccgtttaagcataaaggaattatgtgcgctccgtttattggtccgttaagcattgaaaagtatttaaacggcggacaaattgagcaggttatctgcggaggagagaattacaatggagcgcgtccgtgtgattatgattgggtcaaatctctacaaaacgaatgtaaaaaatatgatgtaacgttttgttttattgagacagggacggtttttataaaggacggtaaaagatataatattcccaataaaagaatacaaagcgagatggcgtataaatcgggaatcagttatagcggaaagaaaattaagtttaatctaaagagtaggtacggttacaaaataccggagagtgaaatgtatgttccatatttcagagaagtgtgcggaacctgcggcagcagacctatttgcaacggctgcggtaactgcggcaggtgcagtcaggtaactaagtagtgcaagcgcttaaaaaggaggaatgttatagaaatagttaagtttaagacgcacttgcaaaacgtttggacaatatttattatagtaatgctgcaggacgtttttaaatggttcatccggcggaaaatatctgtcgtaagagaattaagcatactaaatattatcttcttaatttaaagttttttgtgttttagagagatgatagaagtgtgttattaaatcagctgaaaatctttaaacatttgtatgcgaaaggtattgctattgagtttatagctgtatatggtattaaatataaaaaaatatagagaaatgaggtataaaaatgaaaaattattattttaagtttttggctgtgatattatccgctgtgatggtttttggtacagtttcggttttttcggaacctcagaattcagaacctcagtttgaggaattatcgcaggattttttagactatataaatttggatgaaagtgagagaagcgggattgtcgctccattcccggcagaaatcaaacaagagcataataatgacgctgttctcagcagtgttttacctgaaagatatgacggcagggattatgagtatttacctccggtaaaaaatcaaatgagcaccggaacttgttgggctttttcagccacaacagcgcttgctgcatcaatgcagaaacagtatccgggaaatatttttgacttttcggtgcgtcatatggagaattcagaagctataaacccaaatgatttagctgaccctgattctttaaaccgttatgtggacggcggcgggtatggtttgtctccgcttggatattttatgagaggagcaggacccgttgatgaatctgaaatgccgtttcagaataatattgaagcagaaaataaggcagaccttttaataaaacccatcgctcaggtaaaagaagccgaatatatgccgcataaggaaacttttttactacccgataccactgatgaatttattgctgaagctaaatataatataatgaaatatggagccgctggatgtgcgtattatagttacgatccgttatataatatggacaaaaactcattttataataatcagcgcggtgcctatcaaaatcatgcggttactataattggttgggatgataacttttcggctgacaattttgtagcaaaaccgcctgcagacggagcttggataatacaaaacagctggggttcggattggggagacgatggatgtttttatatgtcgtattatgacgaaacgcttgatgaattaattttttatcaggattcaactccatatttggaatacgataacagatactatttagaccctgcaggatggacaagaggacttggatatcctgacaacaacggtatttcttatgggatgaatatattcgagaagcttccgggagaagaggctttaacagaggtgactataggtgtaagaggggatacggattattctatttatgtgattcctgacgctgataaaatagagccggcgtcttatgatacctcaaaagaaactccggtttgcacaggcaataccgaccatgccggatatattactgcggagcttcaaaaccctgtgattttagacggagaacgttttgcagtgatagtaaaatacagctgcccgagttatatatacagcctgccggttgaagccagaattaaggtatatactgaatactatcatttagctgctgagccgggaacaagctatatatccgctgagggtaaagactggacagaaataagcaacgagaaatatgattatgccaattgttcgataaaggcttttacaaaggatatcacgccaaagacagaagtaacgtttgagactttggacccaaagggaattatgagcgtgtatgacaaagacggcagaaaagccgccaagaaagccgacggcagttttgctttgccgaacggtaattatacttatgtccagagtacatatcattgtaaagatgttaccggaactttttccgttagcggggaggaaagtataactgttaaagtcgaaggaaaaatggagcccggagactattctccggaattaattaaaagaacttatgagtatgaaaaagaactgaacagcgatgggtccctttcagtaggatttgatttggggaaaggaactttagccgcagaaaacgctgttgcgtgtgacgaggggattccccttgaactgggtgcagactataatatctcagggaacagtattgttttgacgcctgaatatttaaatgcagtacgcaattatatgatgcctgacggcggttcttgggtattagaaattaagtttgatgatgataaattaacagaatatcagtttgttataaagtttgaatccttaacggtggaaaatgttgctgatgaactgataaacgaattgagaaaggcaaaacccggcgctttatctgcggatttggttgattcgcttcctaaatttatacaagataattttacatttctttttaatggagatcttgaagttgagtcgtctaagaattataatttcgtgacctgtgatgttatagttatgtcaaatgacggtacatataaacgtctcgtatatgataatcagatgttatataaagttgtcatggcagtagaaaaatcgcatacgttaactgtgcgcggatatggagatgtttcgggtacgctgtttatttgtcaatatgacggcagcggtttattgattgactctaagccgtatactttggaacttaaaaatggtgatgagctggattttccatatgaaattgttgaaggaagcgttagaagggaattctttttcttcgatatgaatacgcttgagcctttggcaaaatattaggttttaaaatgtgaaaggaagcaagatgcagataaacagactgtttgagataatttatattctgctcaataaagaaaccgtgacttcgaaagagctggctgaaaggtttgaggtttcagccagaactatatacagagatatagatattctttccgcggccggtatacctatttatactgagaagggcagaaacggcggtatttctctgcttcacgattttgttctcaataagacggttctgacgcaggaggagagaaacgatattctgtcttctcttaaagctgtcagcgctgtgggggcggaccgaactgatacagcgcttaaaaaacttggcgctatgtttggcggaggagcggattcctggctggaaatagatttttcgtcttgggcggattataagaaaactgccgagacgtttgaaataatcaagtcggtcattattaataaacaggtgatagagtttgagtatttcagcggttcaggcgagagaacaaaacgtgaggcagagcctttaaaactatgttttaaaggtgggtcatggtatctatatgctttctgcaggtttagaaatgattttagattttttaaactgacccgcataataaacgtgaaaataaaagaagaaattttcagcaggagtgttcccaggaagattttcacagaaaaaaatagtttcaacgatgaatttatacggttgaagatgagaatatcgaaaaagctggcttacagagtttatgatgaattcgacgaatattatgcggataaggacggcagtttcattgcctatataatgtgtccaaaggaccagtggctttattactatatctcaacttttgggaaagactgcgaggttttagagcctaaagaggttcgcagcgggtataagtctgaaatagaaaaaatattaaaaatctataaacaagaataataagttgtataaattaatagattaaattagtatatagttggcgtgttatatggctgtatggatgaatatgaggcaatgtatatgaagaaaaacaaacgtattattgtaacagttttattaatagttttgctctctgctgttatagcggccgcaggcaaggaatgctatgattttgagcgcagagcatgtttcagccggctgaccggatacacagaagaaattggcagtgatataaagagaacgcttgagagtgacagaaatattttaaacggcgctgcaaacataataaaacagtatgatatttcagagcgtgatgagatagtaaaaatcctttcttcctttgagggaatgggtttaatttcgcgtttggagcttttgcttccgggcgatatgatgcttacgggtgacggagaaactttggatatgtcaggagtgctttcttatcaggaggaactgtcaaagggtgtgcatatttctaaacgcgaaaaagattatcaaaatcagtataattatatattaagacaatgtgttcctattgagcgaaacggtgaaaatgaagccattattattggtgtggttgaccttaataagcttcctgtatattttcctgccgcagattatggcaatgagactcagatttatttggttgaaagggagacgggcaattttttgcaggacacacagcataaaacgctggggaatatgtatgggttcggcgatagaaagaccaaaaaaggttacagcagcgaccaatttgtttcggatattgccgccggaaaatccagctccgcgatttttttgtctcaaacatcaggcgagtatctttattcttacgtctcacctgtaggcatacaagattggatgattttgcttagcatcagtgaggatgaggtgttttctcaggcaaacgtgatgatgaggttcttcttcggattagctctgtcgtttttcctcattgttttaatttattttatatggatgattaaggatgtcaggcgtgaaaatttaaagatggatgaacagctcaagaacgttcagtatatgcttgaagttgaaaaggaattgtttgacgcgcatttgcatcctgagaattttaagagagcacttaaaaaggtttctgattatttaactgcagaagcggcgtttttttggataatcaacgggcattccgatattaagtattgttataacggttcgggcattgtttttgatatagatgaagataatgaaatgtctgaattgttcccgggactttttaatattcttcttgaaaggggcggcatattaagctatgatatgaaggctgttgctgaggaatttcctgtcggaggaaagaacttggctcagtttaatattaacaatcttatgcttattccggtatcaggttcaggaggtgaactgacaataatatttggcgcctgcaatatgaagcgccgttgggaaagcgatgttccgctgagacaggtttctctaagcttttttatggctttaaaccattatgaagctcattatgagctggagagacttggaagaatagacaacttgacagggcttttgaacagaaacagtttcagcgccgctttggaaagattatcgagtaataaaccaaagtcgtttggctgtgtttatattgatgttaacggtcttcatgaaataaacaattgccttggtcatcaagccggagacgatatgctgaaagctgtggcggatgcattaaagcgaaattttggcgatgacggcgtttatcggattggcggagacgagttcgtaattttaagcgaaaataagactgagactgtgatttcagagaaaattaaagctgtaagatacgaacttaaaaatcaaggttatgcgttgtcggtgggaacggcctggaaagaatcttttaacagatacgatttgataattaatgaagcagaagcaaaaatgagagatgataaaagaaagttttattgtgaaggaggagcggtcagaagttcacgcagtttggataagcaggttgaaaagatggttttggaaaaacaggacgctgacgcgtttctctcggttttagctcctgaattcaaaggggtatattttgtcgatttagacagggatacagtcagacatctctatataccgttttattttgaaaaaattttaaaagagacaggtgatgtattcagcaaagccctgctgctatatgctgctagaaatgtaagacctaaatatatagagtattttaaaagcgtgtgtgattataacggtttaaaaatgaaattgagcgataatataacgcctgaatttttatatcaaaaaaaggacggctcctggctgaagcttagaatattaaaatttaagaattacggagagaacagccatgagactttgtggatatttacggattcggaatccgaaatacaaaattaaaacgtttaataaataatcgtcagattataaggcgcctttcacggcgcctttttgttataacaacattccgttcatggataagactgaccaatatttttagattaaggggtataaattaattaaaaatgattcagttcaaagaaacggattatggatttttatattattgagtatatcaaagcaaatgaatgtcatagaattatgtgtcaatactgagcggcaattttcatcaggatttctaacgtgtttacgggaaataaaaatttgatttgttttgtcaaataaaagataagcccaggttggttaatatattattttataaaatatgacatgctgttgtcatattaatagtattataatagcattatcaaaacttaggaggtaataaaatgaaatatgaaatcgttgagttggaacccaaaaccgtggttgggataagcgcagtgacatccaataacgaccctgaaatgcagaaaaaaataggtgacttgtggacaaggctgtatccgggcggagaaatagccaagataaaaaacagagctaacagtttcgctataggtctttattcagactaccagggtgataattattgtgtgacggcaggctgtgaggtaactgaagcggataatgacgatatggtcataaaaaccattcccggaggaaaatacgcaaaattttctgtgcgcggaaatatggttgacgctgttgccgaggcgtgggaagaaatatggaaaatgaatcttgaaagaagttataaggcggattttgaggaatatcttaatgaagattttgaaaatgcagaaataaatctttatattagcttataaaatttgttttaccgtccgccggattaatttaaaagattttcccggcgggcgataattaaaatggcttgtttattaattatatacgagcgaatcatcacatttgttttctcggctgtccgcccatttctcaaattcgtttaaaggcagaggttttgaaaaaatatatccctgaaccatatcgcaattgacgcttttgagaaaatttaactgttcagaagtttcaataccttccgcaacaacgtgtatgttcagccttttggcaaggtctataaaacttatgattatattttggctctttgagtttgttatatcctcaaaaaattttcggtccagtttgattgcgtcgacattaaattcttttagaagtcccagtgaagaaaaaccaactccgaaatcatccaatgaacatagaaagccataactatgcatttggtttattgcgttttttaccagttctatttgttggttatcaaaaaatattgattctgttaattcaagttcgattactccatccggaatgttatacttgtttttcagctcaataaacggacgcagataatttaaatttctaaaatgtacccttgaaagattaacagatatggtaaaaagtttttttccgctgtctattctttgcttttggtattcacataccttttcaaatacataaaggtccagctgtattatgtttccgtttctttcaaacagaggaataaaatctgacggatagataatcccgcggtcgggatgaaaccaccttacaagggcctcagcgccgcctgtttcaccgtttttaaggtttattttgggctgaatataaacgtgaaaatcattgttttttattgagtcgtcaaacagactgcaaagtttctgttccataatcattttatttgttatctcagagttataaaatgaacaatctgaaattttattttgaagctgacaggcagtgcgggcgcggtcttgaatcattcttatgtttaagccgggctcctccactatatatgcgccttgtgagatttttatattatgtggaatatcagagttttgcgcgtatgaattaatatcggttatcatttcatcaatgcgtttttgtataacgtttttgtcaaattcttttaagcataagaaaaagtggtctgcttcactccgcgttatcatctcgtcttctttaatatggcggcttaatactttatgtatatatctaatagtatcattgccggtttcaattccataatttaaattgataagtttaaaccccttaatattcatcattataacagtataagtcatgggcggtgattctgaaattaacttttgacactccaattgaaaagcggagttgtttaaccctccggtaagactgtctgagaatgcaaactttttaagccggttttcactttttctataatatctgaatattataatcagaaacaaagcaaagataagtacgacgataccgactattataaacgagtgcaatatatagttgtttgcctcgcccgatattaaatcagccggaacaagagtcagcagtacccaattatttatgcccagcggatgatatgaaagaataaggcgcgaattgtttacggaagtaaaattgaatactccgggttctccgccggacatatgacttttcatttcttcaatagcattttttgtcttgttttcatctttggccataaatatgctatcaagctgaataaacggctttacatctgtaggtgaaattacaaccttgccatcattgtcaataatacaggaaaggccgcttccgttaaagctttttggcgcgattaggttttgtatgttttcttttttgcggacgcccgccagaacttggttaatcttaccgttagattctacgggaacggaaaataccaggctttgaccttcgatatatgtaattgatttttcgccgttatatgaattctttatgccggataaattgtttaggttttcagtatttgagggaatagttttattgtttttatcaagcaagataagagaatcgaaatctaatatttctgcctttctgtttaaaaattcttccagcaaatcttcatttggtaactttttaatagagtcgctcaataattccaaagccagttcaaaagagtttagttttgatgatatatcattggcttgctgaaatgacgcgtctttgacataagaattggtgctgttttcaagaaccgtgtttagcccggaggtgttccatagcataaaagttattacagccgttagaattatagaaacaatacaggtttgaataacaggacttacagacatactatatatttttacgtcttgtgtttttttcattttaacaactcctgaatttctatatcataattattgtgtaataattttagcatgatttttttagtaaaacaataagatatttgagtacgtatacatatagttaattgttaaataatgaattttatgttataataatctaagaaaaacatttatcgggagaagagttatgaaagataaaaccaccttatttgagtatttatatgagaatttaaaagaacagatagtcagcggcagaattaaatgcggtgaaagtcttccgtcgatgaacagtgtttctgaacagtataatataggaatacggacagtaaaagatgttttcagagctttgagcagcgagggatatattaagacagaggagagaaaggctgcggttgttatctacagcgataataaagacagccaagaatcagcggttaagtatgtattggagcgtaaatcatttattgttgaagtttatcaaaccatggccttgttgatgcctgaactgttttgtttttcgtctcaggtttgcggtcagaaatatttagatttatgggaaaagagcttgagccgcagcaagaagaaagatacgcaaagcagatggagcgtggcttctgattttctttatgatattttggaaaaatcaaataacttactgttccgcgatttatttgttagtttagaggtatatgccaggcttccgcttttttcaagccatgacggatttattgagttagtggatacaaaaagtatagggaattcgatgtgggtaatggaatcattgcttaccgggaacagaagcgaaataatttatagattcggattaatgtatgacgcggtaattaacgcaatacaaaagtatttggatataatggccgaaaaaaatccgaatgtcgaagagggagagtatgactattcctgggcggctgaaaggggaagagaacattactatactcaaatagctcgggaactgatagataaaatcggaagcggaatatataagccagacacatttttgccgcatgaggctgaactttctgaacaatatggagttagcgtatcaacagtcagaaaagctattttaatgctgaatgaactagggtttgccaaaacgtttaatgcaaaaggaacaaaagctatgctgcagaataaagaaatggcgatgaaaagtataaagaataaaaaatacaagcgggatactttaatgtatttaagcgctctgcagcttatgaccataacggttaaggctgcggcggagtcagcctttcaaaacatagataaagatgttataaatgaattggatgaaaaaatgagttgtcatgattccataaatcttgattgtattcaggaatgtataaataagtatgtgagtttgcgtcctttaaaaacaatattagaggaaacgggtgaaataatttacgggggatattattatgctttttacagagacggcagtcaagccgcaaatttactgaattttaaaagtcaaaaggcatttgaatgtttaaaacatggggataaaaaagggtttgccgcgaagacttccgaatgttacggtcatatccttaaaatagtgcgtgattatttaattggatatggattgacagaggccaaaaactttgtagtgccggaataaaaataatatataattgattagctgtgctgaaaggtttgcaaatctaatttttattaaatacaaatcagataagtaaaaatatggcaggtctgaattattcagacctgccatattataattatatgttatttttataagaaataacatattcggaagttatgaagattctatatattttaattaaatacaattgtcgattttatttaggatatatgggataacaaaaaatacggcagctgaaaatcatctcagcataggctgatttataacagctgataaaatcggctgtacgtgaaacgtcctaaatgtttttatctgcttataaaaaagctcttggcagattacggcgacatagttagttaaataaaatttttaattttactctctgtgtttacatgaaataaatttatgaaattcctcaggaatattttcggcagataaattttcatgaaccgaacatgttccggcttcctttgcggtttcataataccagcatttataattcagcatatcaagcattttttgagtttcttcaatttgccgctcgacagctttcttttgcttagtgataatttcgagacgtctgtctatagtgccatcgccctcaatacataagtcaacgaattcttttatatctttgataggcatgccggttttttttagacattcaattatctgaagccaagacatgtctttttcctgaaacattcttataccgccgctggaacgttcaataaacggcagcattccttctttgtcgtagtatctcagcgttgacggagccacatttaatctctttgccatttccccaattgtataaaccataaccagtcctccaaaaaaatagaaaaattttcaaaaaaggtattgacttaaagctaactttaagttgtataatgtatttgaacattaagaattgtatcacaaaatttaaatcaagtcaatggaggaatagaaaatgagttttaatatgtatgtaccaacaagaatattatttggtttaggagctgttaaaaaactgcatgaacaggagtttccgggaaagaaagctgttatagtaatatcaaacggcaagtcaacaaaggaaaacggatatttggatactgtaaaaagtgaaatgagcaaggcgggagttgagacggttgtttttgataagattcagccgaatccgcttaaagccacagctgaggagggcggaaagttcgctcgtgaaaacaactgtgatttcatagtagccttgggcggcggcagtgttatggacgcgtcaaaagcaatagctgtttcagcaactaatgacggagacttatgggattatgcctttggaaagacaggcaaaggtatgccgataaaaaatactccgcttcctatagttgcagtgaccacgactgccggaaccggttcggaggtggaccagtggggtgttataaccaaccctgaaactaacgaaaaaataggattcggcggtatagatgagctgtttcctataatagcggttgttgaccctgagcttatgaaaactgttccgccgcgttttacagcatatcagggatttgacgctttgtttcatagtacggagtgttatattgcaaagtgctcaaatcttatgagcgatatgtatgctttaacggcaatagaaaatattggcaattatctgccaagggcggttaaagacgggaatgatattgaggcaagagagcatgtggctttagcgaatacattatcaggagttgtaatgaccttgagcagctgtataagcgagcactctattgagcacgccatgagcgcctatcaccaggatttgcctcatggagccggtctgataatgatttctaaagagtattataagtattttatcagccagcatatttgtgacgagcgttttgtcaaaatggctaaggcgctgggtatggaaaacgcggataaagctgaggattttatcactgcgcttgaaaaactgcagaacgattgcggtgtaggagatttaaaaatgagtgatttcggaattgagaaaagtgaagccgatgttatagcagccaacgcccgtgagacaatgggaggattgtttgaagctgacccgtgtgaattgggtcatgaggactgcgctgagatagttaaaaaatcttatcgttaataggaggtctgtttatgaaaggtctggtattatattactcatacagcggtaacacagaaaaagtggctaaaatgattcaaagagccacaggttttgatatagctgaaataaaacctgtcaaaaattatgaaggggactataactcggttgtaaatcaaggaaaaaaggaagttgacaatagggttgaacctgagatagtggatttaaaatgtgacttgagccaatatgataccatagctttgggctcgccggtttggtggtatacttttgctccccctgtcagaacagtgctgtcgggaaatgattggagcggaaaggttatatatccttttgcaacaaacggcgggtggcttggtcacacctttgaagatataaaagatatgtgccggggagctgaagtaaaaaacggacttaatcttaaattcagcggaactgctatgaagacaaagaaagacgaaatagaaaagtggacagagaatattaagcaaggcggtgagttataatgaataatattggtatttttccgagaggcggagaactgcctgaaatgttcgcagaatatttcagcggaaaagcgtatctcaatatgctcactgaaaaaggagtttctataggtaatgtcacgtttgaaccgggatgcagtaaactggattatgtagcataagagtgtatagcgtgtctgtagtctgatttttgccataaataagtacaggatacacagagaatagaaaagaatgtgtattcagttaaataagaaatagatagctggtatgagagaacaaggagtctttcataccagtttttttgtgggaaaagggataggttgcacaggatctgccaggagatttcagtaggtttgatgaatagctttcttccagaagtgtggtatagtcttgtgcttggaacaggaaaactacacagaagggagacaccgatatgacaacacagccagatattatctggaatgagcagtgcctggggatacggataggagaacaggtatgcacctatctgaaaaagcatgatgcggaataccagagactgcaaaagaaaatactggaacttacagagaagtatccagtgatagaaacatttatggagacgaatcagtcaatcagcctaacggaagaagagcataaggcagtacatcgatatttccaactggagagcgaaaaggaaatgatagaagaagagtaccatttttatatgggacaggctcaaatgatttcttatggagctatgctggggaaaataaaaaaagcaatactgggaaaggatgacggtgacacacagaaactgctggaattgctgctggatacctggattgatgaggtcgaagaacagctgaaagaaaatatagcgtaccagggaatgctggaaaaaatatcaaaatatgaagaacaagttcagacaatgggattagcaaaagaaaagcgaaaaacgatagacgcatatgttactgaagtcagtgaaagatggatattatatgcggaatctttatatcaggccggtatgcagaaaatcttagaactactgaatctgtaataaggacggataaaatggggaagcacgattgaacttccccatttgtcacttctattcgtctttgccatcaatgagaaatatgtatgaaacctgaaagatttcagcaatggcttttaattcaagatcagtgacataacgcttgtttgtttcgattctggtgattacatttttatccatatcgtaaccagctaactggagtttataggcaagatcacgctgagacatattgtgagtcctgcgaagctcaatcaaccgttggctgatcagattcttctcaccagactgtgtccttggctttggcattttaaatctcttcctctctggtaaaaggatggcttgtctcactttttgcaccatctgtattgattttaacgattggacaaggtagaatcggttgtaaaagtgagacaaagtagaagagaagggagaaatatatggagcaggcaaagatagaacagcttgcatttttatatctatgcagcgagcatgataaaaggttattgctgaaaaaagaaaaaatgccgttagctgattttgacaggttgacctacttgatttaccattttggttttaaggaataccatataaaagtgtggatggaatttgcaggagagttcaaaaaggaatgggattgtctggaagcacttcaggaaatgggggctgtgttggaaacataggaaatacagaatcagaaattagcttgcataaaatgtggatgcagaatttttgtaaaaatgcacccaaagaaagcagagaatggattcaaaaattgaattaaaatatgcagtagaacatttttgtgatatcattatcaatagagcagatttgtattttatgaatttgtaaaagaataatgaagcaaaaaggtgtgaagctaattatgagtgaatatgcagatatagtaattggaaatttatcattacattggtttagaaactatttggatagcaaaatcgttagtctgtttttttcaaaaaatgaccttattgtagtaaataattgtaatatagacgatgatgataaagatgccggaacatacactaaatatatgtataggacgactgttcggcgtgcaaaagaacgcttagatgcacagggatttggacttaataattttgaaaaaatatttaatgatgaaatggttcaagcagtagactactcatcttttttgtatcatttacagggagattatgatgaagaggacaagaataatgaaattcggattaagaaaaatgtttcattaaaaaaatggaaaaatgcaatgaaaaaaattgtttcttatgaacttgcaaatggaaacatacaatttggaggaacactttcagaggttaatattacaacagagtgtgacaaagttatattttattctttgaaagatgaggatagcgaatcattttatgctttaaatcctgaaataatcaattataaatatgtatacagacttatactagaatattgtgcaaatgatatggagataatattggatttctcaaatttggataattgggcagatgattgtattcccaaagcactagcagcgacagagaacgtttcaaaaacaattgttcttgttgaagggtcaagcgataaagatattttagaatttgcgatgtcacagttatatcctcatctttcagatttattttattttatggatttcagtgatgaatctggtggaaaaagagatggaggaacatcatatgtaataaaaaatcttaaaactttttatttttcaaaaattagagcaaattttattgcaatttttgataatgatgcagagggatattctagtaaatgctcattattaaatgaaataaaaaactggccggcaaattttagaatattattatatccagaaattacaatgtttcataaatacccaactattgcacctaatgggaaaattgtgcctgatgacattaacaagaaagctgcttctattgaattgtatttgccagattccattataaaaactggtgggaactattatccaattgaatgggaatcgagaaaacgaatacgaaataaaaataatgttgaagaagcattatatcaaggagtgatttcttataaagatgatataaagcataagtttcatgaaatgcgtaataaaattgagagaggtgatgaagtttttaaaacagaagaatggaaaaatatgaaaaaattactagaaacaatagtattcgcttttaataacgaacaataaatagcaacgtaaactaatgcaaatatcatgggcagggctcttcggggttctgccctttttctttttccagaccaaaagaccacctgctggaaaagaacaagaaaaacctgaaaggatgtggtgacttatcattataggaatcgatcatggatattatgccatcaaaactccccatgtgtgtttcccgactggactgaccgggtacgattatgagccgtataccatgcagaatgtcctgcagtacaatgggaaattttatgtgtgtggaactgggcggcagacgctggtgagaagcaagacttccaatgacaattattatcttttgacaatggcagccattgcacaggagatccgctaccgccggggagagaggaaaacagatgtggttctggcagccggcctcccactggcaagttttggcagggagaaaaaaggtttccgggaatatctgtttcggaaagagcagcctctgcgtttccggtacgaggatgagagctatgagatccggattcaggatgtaaaactgttcccacagggatactctgccctggctcttcacccggaatgtgttcgggacgagccttctgttcttctcgcagacatcggtggctggaccgtagacctgatgcggctggacaacagtgttccaaacgccgctacctgccgcagcctggagcttggtgtgatccggtgcgtggatgagatcaccgagcaggtacgcagaaataccggactgtctgtaacggacattcagatcgaacgtgttctgaacggccagagctgcagcatggacccgtccgcaaaagaaattattgtccggcagggaaggctctacacggagaaaatactgtctgcaattatggaatccgggttcgatctgaaagcaattccgtccgtgatcatgggcggcggagccagcattctgaaacggcacgtgacaccgcaggacgggttgtgtcggcagatttacctgacggacgtacacgccaacgcttccggctatgagcggattgtggggcagatgtgcgcgaagtaaagaggcccgttttctcgtttcgcctgaaccttgataacccggatcaccaaaaggcatggaagattctgcaaagtgttccggatgggcagaagagcagctatctggttcaggtgatcttaaaagatcaggaaaacaaccagctggaggaaagcatccggcaggcaatccgggaagaactggcaggtgtttccatttcaggctccggggaaagtgtttcaaataaggaagaaatcccatcccagatgctggattttctctccggattagagaatgcattctgaaaaagtcaagtcttttccggtgataaaatagccaaaattcaagcagtcaaattagtataaatcacggtttttgaaaggggtgatgcctattgaatgttattagatctgcatcctttgggggcttttgaaagcctcatattcgttgggtattgtgaatagctttctgtcacgttttagggtatgttgtgtgtagaaaaaagaaaggagaacaaacgcagtggagatgaaaaacatatgcggaaagattccggtagagctgcatgagaggctaaagctggaggtcgaagagttaggaatcagcataccaaaataccttgaaatggtaatcgaagaacacatgacaagaaaaggagaaaagacgaacatggcagagttaagaaccgtagcagtacaggtaaccgaggatttattttccagactgaaagcagttctcgccaaaaacggcatgaaacagaaagacttcctgattggactgatcgaagaggcactcgaaaaagaggaagccaaatggaaatcggaaacagaagaaacggaagagccggaagaagaaccagcagaaacggaaatggaagaagctggggcagaggaaacggaacctgcggagccagagccggataaagagccaacaaagcctgagctggaagaagctggaacagaggaaaatctgacagaatcggaagcagaagagccggagccaacagagccggaaccggaagaatcggaagccgaggaagagccgacagaaccgaaaacagaagatccagagaaaacagagccagcagaagtagacgaagaagaatcagccgaaacagaactggaaacggaagagccggaagcaacagatccagaggaagcagaagaatagacatcaaaaaacagaaaacaagagattgagacggtgcagagaaatctgcactgtttttttcgcagcgaagggaggctgatagccggaacaattcgattttttgaccttttcagcggaatcggaggattccgagaaggactgcacagagcagggggcttcacctgtgtcggacactgtgaagcggatgcgtatgcagaccacaactaccgggtgctgtttgatacggaaggagagtggttctgcaatgacgcaagaaatattgaaacagaacgaatgccggactttgatcttttatgcgcgggatttccttgccaggcattctccattgctggacgaagggagggatttgccgatgcaagaggaacccttttcttcgaagttgccagactggttgcagataaacgacctgcgtattttctccttgaaaacgtacccggtctgctttcgcatgacaaagggcggacgtttcacaccatcctcagtacgttatctgaactggggtatcatgtcgaatggaaggtgcttaacagcaaggatttcggagtcccccagtcaaggaagcgggtgtatattgtcggatatcttgatgaaagatgtgccggaaaaatattacctttcccaaaaacaaatggaacagctcttatacaagtccatgctggcaaacagggagaaagagtctacgcagaagaaggactgagctgcacgctgaccagtggggctggcggcatgggcggtaagaccggattatatgaagtcggtatcccaatcaaggaaaataccagaaaagggtacaagatggcctacgagggagacagcattgacctcggctatccgggtatcaacagccgcaggggaagagtcgggcatgagatcgcccatactttgacgaccggaaaccagcaagggacactgcattttgtagatatctcgcctccgccgctggtgacagatgttgcaaggtgtctgaataccagacaagattccagcatccataaccacaggggcgaaagttccggggtgctggtggaagaaacgccaagggcagtgctgacaccggccaaagaaaaagtccgccagaatggaagaaggatgaaagaaccggaagagccaatgttcaccattacggcaaccgaccgtcatggcgtgatctaccacggcagaatccgcagactgacaccaagggagtgtctgcggctgcagggataccgggatggtcagatttccaagatggaaaaagaaacatcggataaccagctttacaagcaggccggtaatggtgtcaccgtcaatgtcattgaagcaataggcagaaatttgaaagcagtagatgaagagatccgaagcggctcacctgttccagaagcgaagggtgggtgaagcagatcgatttaaaaaaccagtatttcggtacagagattgagatgacaggcatcagtcgttacaaggctgctgccgctgttggaagaatgttcggaacagagccatattccatccgctcttacagctcatggtgtgtgaaagacccggatggaaaggtctggaagttttcctatgattccagtatccgttgtcagtacaaatctcacggaagatgtttgaatgctgacagcgactatgctacggaaatggtatccccgaaattggaatattcggaaatggggaaactccaggaagtggtgcggtgtgtcaaaaacgcaggtgcttttgtcaattcatcctgtggcatgcatgtccatgtggacgcatccaatcatacaccaaggagtctgaaaaatgcactgacgatcatgtactgcaaagaggatattctgttcaaagccttaaatgtacagaccagaagggaagatgagtactgccagaaagtccgtcctatggtattggagaagatccgcaggatgcccaacagcaccattacaatggaaaaattcaaaagggcatggtatgagggaaatgacggaagctccgagcattacaactggacaaggtattatgcattaaacctacacgctgttttttccaagggaacactggaatggcgctgttttgaaagcaccctccatgcaggaaaagttcggtcgaatatcacactggcacttgccatatccgcacaggcgatcaaccaatcttgtacccatgcaaaaaagacggagatcggggataacccggcatttacgttccgcacctttctgctccgcctcggattgatcggggacgaatacaaaaatgtgcggaagcatctgcttgccaatctggacggcgataaagcatggcggtatgacaaaagcacctatgcctgtctgcagaatccaagacggacagacgatgcaaggtaacagaataacaggaacagacaggccgggtggaaacatccggctgttcttatgacaaataaaaagaaaaagaagaaagaggtagaaaacatgaagagtaaatatcaattcaggcgaatcctttccggggtgatggcggcagtcaccatcttatccacggtcatttcaccgctgaccgtttatgcttcagaagagccgaaagcggcagaaccgccagtgtatgaagctgtaaaggatctgctggatgaaaatgaagtggtaaaagccaccgattttgaactggaagttggacaggagtttgatgtttccagtgaccgcacgaatctggaaatcgaggatgaaagcaaggtcaaggtgacattccagaaagcagagaatgacgccggggagagcttcagtaccagccatgcggacacttaccatgccgtttattatgtggaaccagtcaaccagaaccatccggtttatcagattgggagaaacctgatcgtaaaagagcctgtggcagcgtctcagagtgaaccacagacagaacaggcagttacagaagaggatacaggttctgatgatgaggaagctgcctcgcaggaagaaactgagacagagcctgtagagacagaaattgttgagccggagacagctgaatttgaaacagaggaagcggagacagaagaaccggaagaaacagaacccgaatttcaggacggactttccgaatccgagtttgatgctgcattagaggaatccgaaacagaaaatacaaccgatgaagaatccgggctgacactcagcgatgtcctggagcaggcaggggaacaggatattgacctgatggcaatggaagatggggaaaccgtttcattcaccgcagtcaataccagtacaagagtaacacgggacgtaaatgtgacaagagggactgcatactattatgcagactacggtctgggttcctacgtaacttataaatatactgtaaaatttggaaacgtgtctgcaactgcctactgtgtgcagccgtccaaggcaggaccaggggatggtgtctataagattaccaaactgggtgacagcaaagcactggcaaaagtatgctactacggcacaaaagcatccggcgaaaatggatttttctcagagaaacatcctgatttttccgctggaaaacaatttatcattgtccatctggcagcgtcttatgccaataacagcggtgacgctttttccggtacgaatgcaaccggacaggctcttgcaaaagaactatatgattactgtatgagccagccggagataccggaagtggacatgagtttctccaatgcaaatgttaccgcatatatcagcggcaacaaccagagaacagaagagatcaccttcaaggcatccgaactgcagaccatcaccatgaagctgccgtccggtgtcaaactgcataatgtgacaacgggaaaaacaagcagtgcaggtgcatccgtggagatctgcggcggtaccaaattctacttatctgcaccgctgacacaggcagtgaatgtcaaaggggaatggtctgtcaccatgaagggaagcatcatcaaagattattccgcttataagatcacaaccggaagcgagacacaggaccttgccctggtatttggcgagggtgtgaccgatgagaaatatgtagattttaaagtatcatgggtaaaacaggcaactctggagatcgtaaagaaagaccgtaagagcaacaaagccatcgcaggtgcagtttatggcgtttatagtgacaaggatggaaagaacctgatcacaaagatgccggccacagatgccaacggagcttccagcgttatgatcaccaaaacacaggataccgtatacctgaaagagatctccgtaccaaacggatatctgctggataccaaagcctacgatgtgaaactggtcatcggggataccgtaaaacagaccgttaccgatgcagagcagatggcaagcctgaccgtttacaaattaggcgaagtcctgaccggagcaaaggtgaccgatgatggtgtttcctttgtttatacagagcagaaacaaaaaggcgcggtttacaacgtttatgctgcagaggaaattgtatccgcagacggaacaatcatctacaaaaaagatgcactggttaaagccggactcaccaccggggatgacggaagtgccacactggataagctatatctggggaaatatgtggtaaaagaaatgcaggcaccacaaaatctggtatgcactggtgaaagccaggagatcaccctttcctatgccggaagtaatgtggaaaaggtcatgggaagcgtgacattcaaaaatgaccgccagaaagcaagcgtgagtgtatacaaacaggataaagaaaccaggaaatatcttccgggcggcacttatggtctgtatgccggaaatgacatcaaagcagcggacggaaccattgtggtcaagaaagatactctcattgagaaagcagtgaccggaacagacggaaaagccgtatatcaggcagacctgccgatcgccaacagctactacatgaaagagctgggtgcaccagctggatatgtgagaaacggcgaggatgtgtactcctttaccttccagtacacaacagacaaagaggcaacggtttctttcaaccatacgttccagaatgagcggatcaatgcgaagatcaaactggtaaaagaggattccgaaaccggaaagaccgcacagggagatgcaacacttgagggtgctgtttacggattgtatgcccgtgaagatatcgtacatccagatggacagacaggtgttctttacccggcaggaacacagattgcaaccctgactacggatacagagggaaatgcagaagtcgcagacctctatctcggaaagtattacgttaaagaactgactccgcctgtcggatatctggcagacacggaagaacatgatctggagtgtaatgacgagggagatctggttcagacggtagaacgtaccgtaacttctctggaagatgtgatcaaacagccgttccaggtcatcaaagccgccaacaatggaaagaccgatgccgatctgttaaaaggtgtgggattcagtgcatatctggagagcagcctgaagaaaaataaggacggttcctatgattttacatccgctactccggtcatgctgactgcagacggacagacagaaatgttcacggatgagcgtggatatgcatgctccattccgcttgcatacgggacttacattgtaagagaaaccaccacaccgcacaacttcaaaccagttgatgatttcaaagttgtgatttcagagaacaatccagagaaaccgcaggtatggcgtgtgcttctggacgaagagtttgaagcaaaattaaaaatcgtcaaaaaagatgacgagacaaagaaatctgttctggttccgaatactgaatttaaggtatacgatctggataacaagaaatatgtggaacaggtgactacttatccatccactacggtacataaatcctattttacggatgaaaacggatacctgatcctgccacagaatctggcttgtggaaattaccgcatcgaagaagtgactgcaccagatggatatacccacagcaccaataccgtggaaatcaaggtagacagtgataccgcataccaggaagatccggtcagcggtgacctgatcatcgaggtggattttgagaaccacccagctaagggcagactgaccatccgcaaagaaggcgaagtagtcaaaggttttgataaagattttacttatgaggaagccagccttgcaggagccgtgtttgaagtttacgcctccgaggatatctataccgcagaccatcagacagatgagaacggcaaccgttatctggaatatgccaaggacacactggtggcaacggtaacgaccgatgaaaccggaagtgccgtaatcgagaatcttccgctcggaaaataccgtgtagaagagaaaaaagcaccggaaggatacacctggaatgccaaaggagaagaggtaacctttacctatgccggacaggataccccggttgtagacgaagaagtgacatttaccaatgaacgccagaaggtaagcatcaccgtggaaaaacaggatgcagaaaccggaagcgtggtagctggagccgtctttggtctttataataagaatgagatcaaatccgatgacaatgtaatcgtgaaagcggacaccttattacaggagattacaagcgatgaaaagggacaggcacacttcaccctggacctgccgcttggaacttattatgtaaaagaaatttctgcaccggacggttttgtatcctctgatgaggtactggaatttgatgccacctatcagggacaagacatccagaccattaaactgaaatcgattaagaagaaccagccgacgaccatcgaggtgacaaaatccgatctgaccacaggcgtggagttgaacggagcatccctttctgttctggatgaggatggaaacgtgatcgacagctggacttccgtaaaggatgagcctcatgtgatcaaatatctgactgttggaaaaacctatatcctccgtgaatcccttgcaccgcatggttatttaaagactacggatgtgaaattcaccatcgaggataccgcagaaatacagaaagtggaaatgcaggaccatgtaccgaaagcactgctgatcgtaaacaagaagggcgaattccttgataagatcaccctgctggataacgtcaaaggtgttgtggaacatttctttgagtacattacaggaagcctgacagacgttaccttcgaaatccgtgctgccgaagatatcaaagcagctgatggcgtaagcccggactattattccaaggacgaactggtagcaactgtaactaccgatgcaaacggtgttgcagaagtatctgaccttccggttggaaaatattatgtcaaagaggtaggcacagcatatggttatatcctggatgaagaaccacgatatgtagatctttcctaccgcgatcaggataccccggttgtcgtatacgatgaggactggcagaacaaccgccagaaggtgaaagtgaacgtcctgaagaaagaaaaggataccgaccgtgtattaaaaggcggcatctttggattgtacactaggaacgacatcctgtccgcatctggaaaggtgctgatggaagcagataccctgatcgagttaaaaacaacagatgtagatggaaagatttcctttattgcagacctgccgattgacggaacctattatgtgaaggagctgtatgcaccggatggatttgtcaccaccggagaagaacaggaatttgtttttgagtaccagggagacaaagaagcagaagtgtcctatgagttcgtatttgaagatgagccgacaaccgtggaactttccaaaaccgatctgaccacaggcgaggaactgccgggagccagattacagctgacggatgaaaacggggctgttgttgaggaatggacatccaccaaggagccgcacatcatcaaagaattggttgtaggaaaatcgtacaccctgacagaaaccaagccggccgatggatatgccactgcggaaagcatcacattcaccgtggagaatactgtagagatccagaaacaggtaatggaagatgatgtgaccaaagtggagatcagcaaaacggatattaccggagataatgagatcgaaggagccaaactgaccatcacagatgaaaatggcaatatcgtagaaacctggacttccggtaaagagccgcattatatcgaaaaacttccaatcggtaaatacaccctgaaagaagagcaggctccaaacggttatgtcgtttcggaagagatcaccttcgaggtggcagacaccgcagagatccagaaggtagccatgaaagatgataccgcaaagggacgtctgatcattgagaaaacggacaaggataccggagctgcactgaaaggtgcggaatttgaattgagggatgccgatggcaaagtggtagaaaccctgaccactgatgaaaacggtcatgcaaccagcggactgcttgcaatcggaacttataaggatggcaaatttgataaggcagccacttattatctggttgagaccaaagcaccggaaggatatcagctggatgagaccaagcatgaagtgacatttacttatgtagatgacaaaaccccagtgattgaagtcatccagaaagtgacgaacgagaagttgccggaggacaccccgtctgtaagtaacccgaaaacaggcgatgacaccaacctctggattccggccctgtgcctgattctttccgcaggcggtctgattggtatgagtgtggcatccagaagaaagaagaaaaaagggggcagataggctgaaacaattatattttgcgtatggaagcaacatggatctggaccagatggcatatcggtgcccaaaggcggaggtggtagaaaccgtccgcctggaggggtatcgactgacctttgcagccacaggaagcggtcttgccaccatcttcccggaagagggaagccatgtggacggcgtcctctggtcactgaccggggactgcgaaaagagcctggatctttatgaaggctatcctgatttttacgacaaacaggaaatcaccgtcaagaataaaggcggaagagagatcaaagccattgtctatatcatgacaaaagattacatgcagaactttaatccgcccggacggtcgtacctgactgggatcttaaagggctgcagacagaaccaaatcccgacagagccgatcctgaaagcagcaaggaaaccgcctgtgccgggaaagacacagaagagtcagccaaagaagcagagaaaagccggacaggaacgatgaagaaaaaaccaaagacaggaatcttacagaggtttttcaagatcatctgccttgcagtgacgctgacaagtgccgggtttctgatttaccacatggtatatcttccaatggagaacaaaaagctggtggcagagctgaaagggaatttcccggagccggaagctccgggagcctcaggctctgaaaagaaagaccaaccagctggaagaaaatgcccggtggctgcggtagaccttgtttctcttcgggaacaatatccagatgtgcagggatggctgacaataccggacaccgggattgattacccagtgcttcagtacgaacaggagaatggggagttttacctgaaacggaattacaaaaaggaatatgacatcaacggaagcctgtttttacaggcagactgcaaagtgtctgaaagtcggaaccttatcatttacggtcacaacatgaacagtggggcaatgttcggaaatctggacttctatgcagatgaaacatattatcaggagcatccctttgcttatcttcagacagaggatagcattcaggaatatcgaattgtcacggtgctgaaagcagacaggaatttgttcccgttccaacagaaacttccagatgtggcggcagtgcaggagtacttaaaagcagctaagcagagggaagtgttcgaaaccggagatgattacctgaagtgtatatacgataaggttttgacgctcgtcacgtgttcatatgaatggagcggtgccaggaacatcgtcctggcggtgccggtttccggggcagtgtggagtcagaagtgttcgtaagcacccgaaaagtgcagaaaatgagacaaataatgaccgcacgggcagggatgtgttcaaaacagggggattatgtaagggtgtgcattggtagtatttaggttgaaaaaagtgtctgaaagtaccagaaaagtgcagaatgtgagacaacttataacccagatccggcagaaagtgttccagaaaggagcgtttcctgccgttattatttacttggaaaggatggtaacgattatgaaacgattttatacagcagaatccgtaacagaaggacatccggataagctctgcgacctgatcgcagacagcattctggacgcgtgtctgaaagaggacgaaaattccagagtggcctgcgaggtgctggcgaccaaaaggaacatcattgtggcaggagagatcaccagccgatttgagccacaggtgtttgaaatcatcaaaaaggtgctggagagtgcaggctatgaagcagaggaaatccacatggatgccctcatccacaaacagagtccggatatcgccggggcagtggagagatccagagaacgaagggcagggactgtttctgttcagagcggacttgccagcggtgccggggatcagggcatcatgattggttacgcctgcgatgagacaccgcagcttatgccgatgccagtggttctggcgaaccgcattgtaagggaactgtctgcaagccgtagaagcggatatatcacgggaatcttgccagatggaaaggcgcaggtgaccgtggagtatgaagatgacagacctgcccggctggataccgtcattgtgtcctgccagcatgaaaaggaaaaatcccttcggaagctggagcatgagatccgggagaaagtgttacgcccggcactccgtatgctgccaccggatgaggataccaagatcctgattaacccatcgggcagatttgtgtgcggaggtctggatgcagacaccggactgaccggaaggaaactaatggtggatacctacggcagcctggtacagcatggtggcggtgcattctccgggaaggattgttccaaagttgaccgttccggggcgtacatggcccgttacatcgccaaaaacatggtagctgccggacttgccagccgatgccaggtgtcccttgcctatgccattggggttgcccagccagtcatggtgcaggtggatacctttggaacgggaaagatctgtgcggatgactgcctcgccgcagcgatccctctggtgttcgggcttaccccaagccagatctgtgacaccttgcacctgaagcggccaatctaccgacagagtgcggtgttcgggcattttggaagaaaggaattcccgtgggagaaaacggataaggcagagcagctccgggataccgtgatgtaatgccgtggattccggaagaagaaatcaaacgtgcaagggagatcaccgccattgaataccttaagaaatatcagccaaaccgtctgaaaaaatcttcagccagaaatgaatgggagctgacagaccacgacagctttaagatcaacgagcagaccagccagtggcactggaaatccagagatatcgggggcaccagtgctttaaatttcctgattcatgtagacgggtgttcttttttggaggcagtgcaaatgctgaaagatgagtatcccacctatatccctcctccagtggaagcaaagccaaagaagccatttgtcctgcctacggccagcccggactgccgcagggtgttccgctatctgaaagagcggggcatcagtggcgaggtcttacagcggtgtgttcatttgggaatcttatatgagagtctgccctaccacaatgccgtgttcataggccgggatgaaaaccaggtggcaagatatgctttcctgcgtgggatttacgatgccagcggaaagtcttttaagatggaacaggccggaagtgaaaaggcatacgctttttgtgttccggcgaaatcgggatgcagacgggttgctgtttatgaagcctgtgtggatgtgcttgcccacatgacattggaacagagacagggaagccgggataagtaccgtctggagcttggcgggatcagcgcaccaaaagaagggcagagccagcggagcatgaaaaagccgcaggcattggaacattttctgtcccagcacccggagatcaccgagatcgaagtgtgtaccgacaatgactttgccggacggtgggcgtgtgaacatatccgaaaagcctacgagggaagctatcggatcatcgagaacctgccggaaatcgaaggggcagactgggcagacatggcaaaaatggctgcccgtacaccggagaaacggcagaatagggaagcgaggtgatgctttgaaagataaaatagaagtggaaatgctgtcacctctgatggcagagtttattccggactattcagatattgtgaatctggatgatgcggagccattggaaggacctgacctggtgcagtatcagacatccatcgcagaaaaggttgacgagatcaatcggctcggtatgcctgacaaccagccatgcaacctgatcgattattttgaccaaaacaaggacattaaggaaaaagtggaacgcattacaatggcggtaaaggaacaggagggcgttttatatggctgtgcaaacctgacactccgggagaatctgacaccagaggaataccgtgtggtggggcagtatctgagagggcagtacagcgatggctggggagaaagtctggaacagcgggagatcaaggtagacggtggtgaattatacttacatttctatgttggtgccggctcggatttccagatacaggtgaaagcaccggaaaacggtgtgcaggaaaagcagccggaacaaaagccgtcccgtccagaacttaagctcttagggcatgacggaaatattttctcaatccttggggatgccgcaagactgcttagacgtgccgggatgtccgaacaggccaacgaaatggcggatcgtgtccacaagagcagcaattactatgaagcgctgggaatcatcagcgaatacgtggaaaccgagctgtcggaccaccgtgaacagcccagaacgccaagaaaagaaacactgaaaaaagaggatacctgccgatgagcagttccataaagaaaagcacttccagagaaatctggaaaataagcgaccgaaaggatgatgcctatgggaaataccctgaaacttgaagatcttttaaaaccggactgtgtgccggatgagtctgccggaggggagaactggcgtatcctgcatggagataccttaaaactggtcaaaggattccagccggggatctttgatgcagttataaccgatccgccctatgcgtccgggggaaccaagcagaacgaacgcaaccgaactaccaaccagaagtacagcagcatgaaagcagaaaatgccctgccggattttgatggggataataaagaccagcgttcctggacccactggatggcagaatggctgtacgatgtgcggaaagcctgcaagagaggggctccgatctgcctctttattgactggagacagtacccgtccatcaccgatgccctccagtgggcagggtggatctggagagggactgccgtctgggacaaggggaactcccgtccgcagaaaggcagattccgccagcaggcagaatatattgtatggggaagcaacggaccgatgccgatcaaccgcccggtgtcctgccttccgggtgtgtttcgttatggaaatccccagaaccgcatccatgtgacagaaaagccgctccagctgatgaaggatgtcatccagatctgtgagccgggcggcctgatcttagacccgtttgccggagctggtactaccatccttgcggcggcagagtcggggtttcaggcagtcggcattgaagtgaccgatgcgtattataagctgggaagcgaccgtgtccgcattgcactggaagctggggaagaagcggaaaacaaagaaccacagtagccggatgtctggcagacatctgaaaaagagaagaaaagaatccagatgtccacaagacatccacagagcggaatgctttgtgggtgtttctttttggaaaaacgccgggcagaggaaacctgtccggccaggaaaggagatggtcgtattggaacaggcacttgcttatgtctgctgttctgcagaagaaggaaagaccaaagtacagcggtactgccggaagatctacgaactgggatatgtgccgatctgcccgcagtacagcttttccccattccttgatgacggggatgcagaggatatgcaggccatgcggagaatgtcccaccagatattaaggcggtgcaggatggtggtcgtctgcggaaaagagaccaccgggacgatgaacacggagatcagcatggctgacaggcttcatatcatctgtaccacactggatgggttaagcaaaatcaaggaaaacgagtgattcagagaaataacaggttcagaggggacgaagcaaaatgcgactggttttgcaagcatagcgtttggatatccaaacgcactttggggagaaccccaatcccccataccaagccgtaaacagacgaaaggagaacgaaaaaatgttgggatttatacttggcacaatgaccgaaggagtaatgggagtttttgcaatgtgtcttttcatagctgggaagcgtgaggatgaggcactggagcggtgccggatgaaacggaaggagatcatcgaccacggcgtgtgcatctgttttgtaaacagccagggagaggaactattccgtctggcagacggggaaagccttgtgcagaatgcccaaaatggagagcggaatgtatccacctgccattatctggatgccgattctgccatgatcgatgggaagaaatggaaccttctggaatttgcaaaagagatggaaaagagagggatcatgttcgccccgatggtgctgtgccaggtatcggaaagggggtgaggcccatatgaagaaaaaaatcattgctgcagcggtagccatcggcgtcctggcaggtttcctgatctggaaaaatcgtgaaatgtaatggagcaacaaccaataacccgttggaaagcaggtgaagagatgagaaaaagaaaccatgtgataccagtccgcctcaatgcgaaggagctgcgttttctggaagagcaggtagagaaaagcggcctgtcccgtgaggaatatatccgttcccttgtcatgggcggcgaagtccgggcaagaccctgtgagcatcatacggagcttttgcggaaaatatccggtctgtgcaacaatgccaaccagcttgcccatgtagctaacggctgtgggatggccggggaagagagcatccgggaaatgctccgcatgacaaaagaaacatggaggctggtcaaagaggaatggtagccgatggcatacaccagtatcatcccggtcagccgtctggacaattccatcacgtacatccgaaacaaggataagaccacaaaaaaagggcaaagtgccggctctctggaagaagccattgattacgccatgaaccgggacaagacggagcgttccatttttgaggatgccatcggctgtgtctgtgagactgcctatcaagatatggtagctacaaagaaacgataccacaagatggacggggtgcagggcttccatctggtgcagagctttgccaaaggggaagtcaccccagagctggcccaccggatcggcatggagctggcaaaaaggctcctgcagggaaaatacgaagcagtgatcactacccatctgaacacggagcattaccataaccacattgtgtttaattccgtgagcatggaagatgggaaaaaatatcacagcaacagcaggagttactacgaagatgtgcggaaagcttcggatgccttatgcctgaaatacggcttatccgtcatcgagccgaaaaacggcaaggggaaatcctacgcccagtggatggcagaacaggacggaaagccgacctggagaacctcgatccgtctggatatccgggatgcagtggcagagagcttcacatggaaacagttcctggatcagatgaagcagaggggataccagtggaagctgaaccggaagtacattgcattaaaagcaccgggaatggaacggtatatccgtctgcggagccttgggaagaattattcggaagagggcatccgacagtggatcttgcagccaaagagcaggacacctgctggaaaagaaggagcttcccgacccccgaaaaagaagttaaaagggatacaggccctgtactattcctatctgtaccagatgggtgttctgaagcagaaacccaaaaggatctccccggtgctccgggcagatatccggaaactggatgccaggatcgagcagatggaatttctccagaagcatcagatcaccacccgtgaagagctgcttgtctaccgaattccattggaagaacaggtgcaggcactcaccaaagaacggaagcggctctaccggagcgaaccggacagtgccaggatcggtcagatcaccgaagaactaaagccgcttcggaaggatatccgcctttgtatccggatcgaacagcagtccagagagatggaagaaaagatgcgtctggcagagcagatccagaggcaggcagaacaggaagagcagacggagaaaaacagacaaccgagaacagaaagcaggtgaatgatatgaattatggaggcgatgcggcggaccagatcgtccggtattcgctggacggcgtggaccacgggctcaggctttcgggtacgctggcaaagcatctggcggtatttgttgccgccgtattaaaagaccagaagaaaacgaggggcagaacccggatggtgcggatgttaaaggagaacaagccattgaagttctttaccgtgccgtccgaccgcctgagagaattctgcagtgagggcaggaaacggggactgctctatgtgatcatccgggataaaaagaacccggagatgagcgaggtcatggtctttgcggatgacgcagccaaagtcaaccgtgtcatggataagatgaaccttgattttgtaagaagcgaagtcggggaagctgtccatgaggtaactgccggaatggaagcaccggaaaccgaagcagtacaggaaaccgtacagatgccggagggcgaggtgcagttcgagatcagcgatctggacgaagcattccaggtcggtgatatggatttttcggaaggggaaaagaatcagaaccaccccgaaaaggagttttctgaactggaaaattttatcccggtgcaggaagagggggaagagaatctgtccggctcttccttgcacagcagaaatatttctaccgggcaggaaaacgggactgatggagcaaagccaagggaacaggagcgtcccagtgtccgccgggagctggagaacatcaaacgggagaaagcagaggaatcccagaagaagagccgggaaaagaaccgtggaccaaagaaaacgcagaagaaagcgagaaataaacgaaaggtgaaagcgaggtagaagatggacctgacaaaatttttagggcaggacacgcaggagcagtccacccagcggttatcgaaagaagaatatgccgcacagaaaaagcaggagagggaagaaatctggggtatgatcgatggaaaggcacaggaggtcttccagaatggggactccttaaaaggattccttgattttatgggacagtgcaagccgcagaggacagacaacctgttcctgctttatgcacagaatccggagatccggcaggtcaagacctttgaaaaatggaaggaagaaggtaaggtagtcaagaccggaagcaagggatacaacttcattgtcggacaggaatatgaaaaggacggtgtcatccagcaggggtactccatccagaaagcctatgacatcagccagatccgtaccaagcagccggaagaggcagagccaaagccgatggaccagctgatggaagcactgctgaccgacagcgaggtacggattcagattgcagaccacctgccggataaggtacaggcacagtatatcccgaacaagcggacgatctatgtccgaaatggcatgagcgaaaatgcaacgttccattccatcagccgggagctggcctgtgcatcccttgaccatcacgatggaagctacagccgggcaggggtatcggcacaggcctattgtgcggcgtatgtgacagcacagaaatacggcgtggatgtctccggtttttcctttgacaaggtatgccagatgcaggcattcggacagaaagatccgaaagaactccgctcctttatccaggatgtaaagagtgcagcctattccattggcaagcaggtagaccgcaaccttggcaaaagcgagcaggaatttatgaccgatgaatttgccatcccggaggaaaaaacggagaaacctgccaagagtaaaaagtccccggaacgctgataaaaaggggcttttccggctcttttgcagtagctttccgggaggaagtgtggtatgttgtggttgagaaaaaagaggaaaaaaggaggctcgcctatgacaagaatgcgatatgtaaagatggaccggatcatgaaccacatgctgatccatgcactccgggaagtgttccggcaggaaaaagaacaggggcttccggtggataccacacgggatctggttctgaagctggcagagcaggaagagggaaagctctacctgacagaagccgaacacagcaaatccgtggaagccttaaaccagctccgggacacatacctgaaaaacggacgctattccgatgggatcgacagcgttctgttaaagatcatgaaatccagataccgcccataccgtggaaggggaagatgaagaaaggatgtggtacaaatatacagaaatatgacacaagaaagaatagaagccatgcggagaagatatccgccgggaaccgaggtcacgcttaacagcatggagggggagagccacatgccacccggcttaaaaggtaaggtggatatggtagacgatgcagggcagatccacgtaaactgggagaatggaagcagccttgccctcgttccgggagtggacagcttccacattacggacctgccaagagcagagaggcccaaacagcagccatcccggtaacaaacagccggaagtcagactgggtgatttggcttgccggactgcctgtcatctggtgggtagcaatcctgcttgcggatgccatccagccgggcaggaatcttttcgagctaatggaggttctcacagaaaagctgaaccatcccttccagtttcattatacggaatataccatcaagtcgatgctggtctgcacgttactttacgcagccgggatcggcattttttattccagtcagaagaactaccgcagaggggaagaacatggctctgccagatggggcgatgcccggcagatctgtaagaaatatagccagaagccgtactcccagaacatcctgctgacacagaacttccgcattagccttgacacccacaagcaccgcagatgtctcaacattctcgtagtgggaggctccggtgcaggaaaatccagaggctttgccctgccaaacatcatgcagtgctgctgttcgatggtcatcaccgatccgaaagccgagctgctccgaaagacaggcggtctgctggaaaagaaaggatatgaggtgcgtgtctttgacctcatcaatcccgacacatctttttgctacaatccattcgagtatgtccacgatgacaaagacgtgctccgtcttatttccaatctgatacaaaacaccacacccaaaggttcccagtcctccgatcccttctgggagaagagcgaaaccgcactgcttcaggcactgatgctgtatctgctccacgaagctccgccggaagaacagaacttcgccatgatcatggagatgttaggctcggcacaggtaaaagaagaggacgaggactacgagtcccctctggacattttgtttgaccgtctggagatgcgggacccggacagcattgccgtcaagcagtatcacatttacaagcaggcggcaggaaagacggccaagtccatcctgatcagtgtaggtgtccggctggcagccttcaatctgccgcagatcgccaagctgaccaatactgatgaactggatctttccaacatgggagaaagaaaagttgcccttttctgttgtatcccggatgcagacacctctttgaattatctggtaggcatgatctacagccagcttttccagacgctttattacatggcagaccgtgtgcatggcggtgccctcccggttccggtcaactgcatcatggatgagtttccaaacgtatccctgccaaatgagtttgagaagatcctggcaacctgccgttcccgttccatttactgcagcatcatcatccagaacatgagccagctaaaggctctgttcaaggactcctgggaaagtctggtgggcaactgcgatgagtttttgtacctgggcggcaatgaaaaagagacacacaaatatgtatcagaattactggggaaagaaaccatagacaccaacacctacgggcagaccaaaggaaaatccggcagctactccaccaacttccagcagagcggaagggagctgttacagccggatgaagtccgtatgctggataaccagaatgcacttctgtttatccgcggggagcggcccatactggatgccaagtatgacctgatgaagcatcccaacatccggtataccgaggacggaggtgccggcccgttcaattatgcgaaagcaccgctggcgcatgatgattttacatttgacgaaacaagatatgacgattacgaactgcttctggatgaggacatcatcggggagcttttttgatgggaggaatgccaatgaatttactgaaaaataagaaacacacagaaatcaggaaagagaccgcaccgctgaagatgaagagagggcagaagaaactgtttgctctgtatgcagttacggtactgtcgatctgcattggggcgacctgcgtttatgccgcaggcgatccgctgaccgtagtcaataacctgtccacgtttatcttttccctgatccgcgccattggcctgatcctgctgggatttggtatcgtgcaggtcggtctgtccttaaagagccacgatccaagccagagggcaaacggatttctgacactggcaggcggtatcatcattacctttgcaaaagagatcctggacctgatcatgggataggagaagagtccagaaggggagccatgcgaaatgccggctccctgctcacttttgaggatgggaggtgaaactgtttgagtgataactggatcgtacagaatctaaattctgccttgcagacctggagcgacaagctggctgaaatctggacactgctgacgcaaagcccggagaatttcaagggcggggcaatctggagcgtgatgacgaacatcaacggtggactgaaagccatcgggtacggcctgctggttctgttctttgcggcagggctgataaaaacctgtgggagcttcacggatatgaaaaagccggaacacgtagtgaaagcctttatccgttttgcactggcacagggagccgttatgtccggcatggagcttctgactgcgatcttttccattgtgcagggcatcgtgacaaacatcatgtcccactccgggatggcagggggaaccgtaacggaactgccctcggagatcgtggacaagatcgaagcggtcgggatgctggaatccatccctttgtggatcgtaaccctgttaggcagtctgctaattaccgtgctttcctttgtaatgatcctgaccgtatatggaagaatgttcaagctgtacatgtacacggccatcgcaccgattccattggcaacctttgccggggagccaacccagtctgtaggaaagaactttatccgttcctacgccggggtatgtctggaaggagccatcatcgcactggcctgcatcatcttttcggtgtttgcatcaagtccgccggccatcggggacaccagcctgtccgccgtgaccattgtctggaattacgtcggggaactggtatttaacctgctggtactggtcggggcagtcaaggcatccgaccgtatcgtaaaagaaatcatgggattataggaggcgaaaaaaatggaagaaccaaagacactgagctacgactggcagtatggccgggaggaattatttctcagggtagacagttacatgagcgatgacaatctctatatcgggctttaccatatggaagatggatacccggaaagctttgcagaccttacggtaaacctgccttttgctccgctgggcggtatcaatgaagcctatatcgaccacaatttcagtaaagaaaagcttcgttttataaagcagcataagctgggaacgatacagccggataccgcatcctccggttactgcattttccagagggttgcattcgacctgaaaaaactggcagagcttgatccggaaggaacaaaaagatttatggaaagaaatggcatccggcaaagggatgtaccaaaacagaaacaaaagaaaaaacagagattacaaagagaaaggtagaaaacaacatggaagtgaaaatgaataaagaaatccgagactatcaggagtcaatgttctggggcttaagcttccggcagtgcttattttcggtactggcgattctggcagcccttggtatttatttcctcacccggaaatatgccggggaacaggtaaccggatggctgtgcgtgcttggggcggctccctttgcagcctgcggctttttccgttaccacggcatgacggcagaacagtttgcatgggcagtcatcaaatctgaactgctgtatccgaaaaggctggtattcaagtcggagaacctgtacttttcctgcatggaagagagcctgcggctgggtgaaaagatgatgggaaacggagcggagcttctggagaagaagcggacgaaacagaagaaaccaaagaagccaaagaagccaggaggaaggggtgatgcctttgattaaaaccttgagtcagacactgaaacaggacaaagaaaaattcaaagtaccgaggtctgtccagcaggcgatcccgatccgcaagatctggccggacggtatttttcaggtggagagcaagtattcccggacattccggtttacggatatcaactattccattgccagcaaagcggataagacagagatgttcctggactactccgaacttttaaatgcactggattccggctgtacggcgaagattaccctgaacaaccgtaagatcaacaaggaagagtttgagcagtccctgctgattccaatgaaaggagatggactggacgagtaccggaaagagtataacgatatgctcctttccaagatctccggtaccaacaacagcatttaccaggaacgctatctgaccgtcagcgtccacaagaagaacatcgatgaagccaggacatactttgcccgtgtgggaacggatatcatcacccatctggccaagctgtcctccatcggggaagagctggatgcagaacagaggctccagatcttccgggactttttcaaggcagacgttccgcagagctttccgtttgacatgaaagcctttgcgaaaaagggacacagcttcaaggactggatctgcccggacacgatggagttccacaacgaccatttcaagctgggcgagcagtacggcagagtcctttttatggaagattacgccagctatgtgaaagacgagatgatctccgaactgtgcagccttggcaggaatctgatgctgtctattgacatcatcccggtaccaacagatgaagcagtgcgtgagatccagaatcgactgctgggcgtagagaccaacgtaacgaactggcagagacgccagaatgcaaacaataatttttccgccgtggttccctatgatatggagcttcagagaaaagaaaccaaggagatgctggacgacttgactaccagggaccagaggatgatgttcggtatcctgacaatggtacatatggcagaaagcaagaaacaactggattctgatacggaaaccctgtattccattgcgagaaaacacctctgccagatggcaactttgaagtggcaacaggtcgatggactgaataccgtcctgccgtatggtctgcggaagatcgatgcggtgcgtacccttaccacagagtccactgccgtcttgattccgttccatacacaggagatcatgcagccgggcggcatttattatgggcagaatgcagtcagcaaaaatatgctggtggcagaccgaaggaagctgttaaatggaaactcgttccgactgggagtcagcggttcgggtaagagtttttcggcaaaagaggagatcgtagaccttgccctttccacggaagatgacatcctcatcctcgatccggagtcggagtttgcttctctggtggaagccttaaacggagaggtcatccggatttcggcaacctcagatacccatctgaatgcactggatatggattctgcctatggcaatgaccgaaatcctctgattgaaaagtcagaatttatcctttccctgtttgagcagctcgtaggagccggaaacctttcggcaaaggagaaatccatccttgaccgctgcaccgcagatgtgtaccgggattacatgaggggcggttacaaagggcaggtgccgaccttaaaggacctgtaccgacaactcatgctccagccggaggaagaagccagagggctggctctgtcttcggaactgtttatcaatggcagtctgaacacttttgcccaggaaaccaatgtcaacacgaagagccgtatcatcgactatgacatccgggagctgggcgaacagctgatgccccttggcatgctggtcacactggattcgatttttaaccgtgtgatccagaactggaagaagggaaaaacgacatggatctttgcggatgagttttatctgctgttccgctatgaatacagtgcggactttttctaccgcctgtacaagcgtatccgtaagtattccggatttgtaaccggacttacccagaacgttgaggaacttctgaaatccgataccgcccgcctgatgctggcgaacagtgagttcctgatccttttgaatcaggctaccaccgaccgggatgagctggcggcacttctgaatatttcagacaaccagttatcctacatcaccaatgtaggtgccggccacggactgatccgttgctccggaaatctggtgccgtttgaaaactcgtttccaagaaatacaaaactgtaccgcctgatgacgaccaagccgggcgaagcgtaagagcagtacagaccgggactggaggtgagagatgaaggatatcaaaaccaaagaagtcacaacaaaaccaaagactaaaaatcctgcctccagaatcccgaaggagctgatgcggacggccatactggagagcaaggaaaagtcccagaccatcgcaaatgccagggataatgacatgggggaacagtccccatccgagtatgccagtggaaaagtcgcatccgcagaggaatgggctgccagaaagtctggcagaactgtaaccagcgccggaaagacagcagcacagacttcctacgagaagatcaaactgagagttactggcaaaaaagaagcggagaaagaagctgccagaggaacaggggacacacaggctcccgatccggtcagtcgggaagcaccagagcaaaagaatcgggaacagacatctgagaacgtgaagattaaaagccgggaagctcaggaagcacagatcaaagatgtccagatccagaaagccaagcggcaaaaggcggtttcagatgctgtcaaaacaaaagaacagaaaattcgggtagccagagagacaccgagaatccagaatggacaggaactatcaggaacgaagcagttctccatccgagaccagagccggaaaaaggcagtcgcagatactgcaagacagaatgccatctgccagaaacagccggaaaccatccggatcaaggaaaagccacggaaacagttggagccgaagaccatacagcggcgtactattaagaccgcccctccatctgcgaagattagcatccagccagagcagaagctccgtgtagccagttccaatgccctgacaacccggatgcagaagcagatggaacgaagggcagcgaaacaggcggcgaagaaagcagccttgcagacttctgatggaatccgtcggatacagaaaacggcaagggcaggggagaatacattcaaggcagctagagccgccgtggaagtggtagcgaaaaccgtgcagtccatgatagctgcactgggagccgccggagcggtcatggttctgcttctggttatcatggtcgggatcattggcggtgcggcattctctggaagctcagagagcaacgaagcactcagccaggaagtactttcctatacggcaaccatccagaaatacgccaaccagtatggaatccccgaatacgtttccgtgatacaggcaatcatgatgcaggaatctggcggccgggggaccgatcccatgcagagcagtgagtgcccatacaacacccggtattccaacagcccgaatgccatccaggatgcggactactccatacaggtaggaatccagtattatgcggactgcctaagagaagccggatgcaccagcccacaggacatggacaagctgaagctgtccctgcaagggtataactacggaaacgggtacataacgtgggcgattcagaaatatggcggctacagtgcagaaaatgccctgcagttttccaatgagcaggctgcttcgcatggctggagtgcctatggtgatccagaatacgtccctcacgttctgcggtattattccagcggcggattgtttgccggcttgtttggaggcaacggccagatcgtatccgtggcactgactcagcttggaaatcagggaggccagaagttctggtcatggtatggatttgacagccatgtggcgtggtgtgcctgctttgccagctggtgtggggatcaggcaggactgatcgaaagcggcaagatgccgaagttctccctgtgcgatgacggaatcgcatggttccagagcaaggggaaatggaagagcagaggatactcgccagcacccggaaccctaatcttttttgactggaacggagatggaacctcagaccatgtaggaatcgtggagaaaaccgagggcagtaccgtatacaccgtagagggaaactccagtgatgccgtgaaccagagaagctacgatatcaataacggaacgatcatgggatatggtatactttgaaaattaaaatagaatataagttataacctatgaaaagaaatttgatatgtgtaagttgatttttttatttgattgaaattttaattttatatgaaatgaaaagaaccagtgagagaatcgttaaatttcactcactggctcaattcgtttcaaatttctcggacaactctgtcagttctttcaccgtttcctgggtgtgatgcaacagggtgtcacgcatttctggcggacagctggaataaagcattttcatctgattgacaccctcattctccagagaaatatctggatttataagcgtatctaaagagatgtgtaggacctttgccaatgctctcaaaatcaaataggaaggattcattttccctttttcgatattggcgatttgctttacagaaacatggctcagatcagaaagttcttgttgtgtcagttctttattctttcgggcttcccgcattttctgccctaaagcagttaaatcatcaatcggcataatcgttcacctcaagaatattgtatcgttccggtttgtacaaaggaataaccttattgtgcttgctaagaggtatgattatgctgattatgtgaatgaaaaacttctgttcagatgaagttacactatcttagtgacaaacgcaaagtgcagggagatatttgatggcgcattccgtagatgttttacacctaatcaaatgtggcgaggatgtggctgaaaaaaattacgagcgccagagttccctctggcgctcattttactttcgctgtgcgttttttctgtactctaatggcaacaatcccgtgctttttcggaataattctgcaaatcggcttgaagtggaatagcctactgtttgggcaacttgcccgactgtcagctctgtatatgccagcagatattctgcttggctcatgcgccgctgttgaacatattccgtgatggtgcagtcgtagtatttcttaaaacagcttttgagctttgttgttcccatgcaggcaatctgtgttagccgttccagaggaatatcaaaagcatagtgatcgctaagataagcggcaactatttggagattttcaatatcctgttgagagagcttatgggctggtttatcaggatgtttcttctgatattccaccaccattgaaacagcttctgcgactttaccctcataaaaaagttttgctgcaatcccttccccgcgatagtctttgatttctgtgagtaaccgtgacatttctggaaagtcggatgtttggtcgatcttccgaaatgcatccacaggattgatctgtgcctccgggtacagttttttcaggtagtcctcataatatgccggtgcaatctcaatcccaaccgaacggattggaatatttttatgtatcaaagccttgtatggagcgtagcctccaataaatgttttgatacaaccggcagacagtctacggtatggagataattcctccccggaaatagagtcataccgagtgatactcagacattccggcatggagcattccaacatgaaatcttcgtggaaggaaaagttatggattttaatatcatataagtctttctgtccataagtccagtaggtgccttctccaacttcgggagaaagtttccagcagtcacctaatgccccatattgctggttgtctgggtcacggataaaaccgtgttcaatcagtagcggtgtataaaactggtcaataatttcagacatgaaaacagaccgcctcctttttgcaacgattagacgaacttttgaaaggaacagacgaacattgccggaacctattgaatgttgttcgataaatgcgtattgtattaggcgaagattagaggtatctaaccgaagaatatcacaaaccacttgtcgagtcaagacaatgaaaggtaggaggtcaaaatgagtaatcaagtaaattctatgaacaaaggtctgacagtgaaagaccttgtaacaacaggtatttttactgcactgttatttgtttttgtattggtgggcggtgtcttttttgcaacgaatcctgtacttacttttttcatgccagcaggaggtgggctgcttgctggccccatttatcttttgctgattgcaaaagtacataagcgttggagcctttctataatgggcgttatcatgggtattatttggttcgtgactggtatgcactgggcttttgcattgggctacatgatcatggcgattgtcgcggactttgttgctggtgcagggaagtacaaaagcaaaaaactcaacagcctgtcttatatcctgttctctctcggtggcactggttcatatatcgtgttctttgttgaccccaacggctgggcgcagaccatgctgggaaacggaactgaacagagttacatcgacaccatgcaggcaactgcaaataccggcatcctgattgccatgtttgctgctgttatcattacatctgcaatcagcacttttgtaggctgcaaaatgctgaaaaagcagtttgaaaaagcaggtattacagcatgagcggtaaacgccacaagaaagagctttggctcgacccacgggccaagctctttcttattcttatgtgtgttttatcgtccatgtttgcgccctcacttgcatatcaatttatccttgttatgctgattgcgatattgggggctttctttggaaagtggaaatatgtcattaaggctgtatgcttttatgcggtcatctgtgccctgacaatttggatcatggcagaaatgacaggcacgctgcggacaatgtttattgcctttttaggcttgtttcataaggtctatgcgtgcggaaccttggctgggattgttctgactactacaaaagtcaatgagttcctgtctgctatgaaccgtgtccgcgcacccaaaaagttagtaattcctatggcagttatgctgcggtacattccaactattcaagaggactggcgctatatcacagacgctatgcggatgagagatgtttcaccatctctggcgggctttttaacacatccgggcatgacggttgagtgtatttatgtacctttattgatggcagcttcaaaagcggcggatgatctttctgttgcttctgtcactcgtggaattgaaaatcccaatccacgcacctgtcttgtccagataaaatgcggaattgccgattggggcgtcatgaccgttgccgtagcttatctgatttttgaattatgtgtgcggggaggtgtgatcggttgattgagtttgaaaatgtatcgttttcctatacgggacaggaacatggtgggctacgcgacatcaatttgaaaatttcggacggagaatgcgtcctgttctgtggccgcagcgggtgcggaaaaacaacgattacaaggctggtgaatggactgatccctcagttttatcagggggaacttcatggccatgtgctggtagatggtcaggaaatcagcaatatccccatgtatcagattgccgctaaggttggctccgttttccaaaatccacggacgcagtttttcaatgttgatacagacagtgagattgcctttggaattgaaaatgaagctcgccctcccaagaaattggctgagcgagtagagcagacaactgaagatttgcatattcaaaagctacgaaacaggaatatttttgagttgtccggcggagaaaagcagaaaatcgcctttgcttctgtttatgccatgaacccacagatttatctattggatgaaccatcctctaatctggatatgacttcgatccaggaactaaaggaacatttgcggctgataaaaaaacagggcaaaacggttttgatagcggaacatcgtctgtactacctgatggagttggctgaccgaattgtttatctggaaaacggagaaatcaaaggaatatacaccccggaagaatttcggcagctatctgaacctgatcgtgaacacatgggtctgcgagctgttgatctacaggcggtattcccgccaaaagcccacttgcctgcgcctccccctgtattggagctgcggaatgtgacgctccgttacaagaagcaaacaattttgcatgacattgagctatccgccggaaagggcgaagtgattggtgtggtcggccacaacggagctggaaagactacattttcccgcgctctctgtgggcttcacaaagactgcgatggacaatttttgtgggaaagcgagccgattgagcgtaaggaaaggctgaaacgctcttacatggttatgcaggatgtgaattatgaacttttcgctgacagcgtggaggcagagtgctcctttggtatacgcaatccagatcaaaccctggtaaatgcaactttggaggaattaggccttacccaatatcgggagcgccatccaaacacgctttctggcggtcaaaagcaacgagtagctgtagctgttagcatgatttgtgggaaagatctgctggtattcgatgaaccgaccagcggccttgattttgacagtatgacgcaggtggcgggactgatccgacggttgtccaatatgggaaaggttattttcattgtcacccacgattttgaatttgtctgccgtacctgctcccgtgtcctgcattttgacgaaggcgaaatgcccgatgatgtaccagttacaatggatgccctcccgaaattgagagagctgttctctgtttcagatggaaaggagaggtgatctatgaaacagaaaaaagaaaacagagtagctttgctgctccactgggccggtgagcaaaaaatctggctgttcctggcaatttttctatcggcggtcagcggtctttgcattatcgtcccttacattggaatttaccggctgatggacgccaccttcaatcatacctgcacgcaggaacttgttgtacataccgtggtaatgattgcagtggcggtaactttgcggtttgtcctgtttggctgttccggcgtagcagcccacaaaggggcctatggcgctcttttcaaagtgcgctgcatggttgcagaacacatggccagagcgcctttaggggccttgaatgaacggcgcaccggggacataaaaacggttctgaatgaagatattgaaaagttggagctgtttctggcccataaccttcctgaccttgtgtgctatctggtggggccggtagtcatctttatttatctgatgaccgtcaatattcctctggcattgatttccctggttccgctgatccttgctgttgttgtaatggggatgatgttccgcaatacggatgacctgatggaacgggccaatcactccattaccacactgaactcggttatgattgagtacatcagcggcatgaaattgattaaagcctataacatggggagcaaatcgtttcaaaagttttcagacgctatccaggaagaaaacgccatgtggaatgaaacttcccggcgcatggggccaccttatgcggcctttgttgttatcatcgaatgtgggatgttgatgatggttccaatcggcggaatgtttttcctgaaaggctcactggctgccagcgcatttttgctgttcgtctatgtaggttccatgtatctgacggaaatacgccccctacaggaactggggactaattttgccaatgtgctgaacgctgttactaagaccaaagagatactggatattccaatttatgagggtggagcggactttccccaaaatcacgatattgaacttcggaatgttcggttttcctatgatggcaagaccgatgtactgcaaggcgttaatctcaaaattaaagatggtgaacgcatggcccttgtgggacagtctggtgccggtaaaagtaccgtgattgagctgatctcccggttctatgatgtgcaggagggcgaagtgctgattggcgggaaaaatgtaaaggaactcaattatgatactatcctaaaaaatgtcgccattgtgttccaaaagaccttcctgacccgtgacagcgttttagaaaatatccgcatgggcagtaacgccactctggaaaaagtacggaccgccgcaaaagaggcgcagattgatgatttcatcatgtctttgccggatggatatgacacgaaggtgggcagcttcggctctcgcttctccggcggtgaaaaacagcggattgccattgcccgcgctatcctgaagaatgcccccattttgatcttagacgaggccacaagcgcctctgacccggaaaatcagatggagattgacaaagccattcaaaatctctgtaagggaaagactgtcattgtggtagcccatcgtttgagcgcgttgaagatgtgcgagcgtgtagcagtggttgaaaatcacacaattacctgtgtcggaacccatgaggaagtccgaaagaacaatgcttactatcggaaggcgtgggaggactacgaaacagcccggaatattacttatcagttggagggaggcgagcagcatgagtgagcatgatgtattgaaaaagaaccgtaatttttatattggcgttggcgggactgttctggaagggcttctctctggcagcctgtttatgctgctttactctgtcatgcagtttttgtggtcgggacaatttgacatgaaccgtgtcctggttctgacctgtgtgatcgcggtggtttttcttcttcgtatcctgatttacagctatggctataccaaagcgcagattggcggtgcagcggtcagcaaaaatattcggctttttatgggcaaccatttgaagcgcatcccactgtctcgattttcgcaggggcagaccggcgattatatcaacaccattacaagcgacgtaaacaactacgaaaaaatcctgacccataaagtcggagatttcgcaaagaattttgccctgtcattgatgttgattgtctttgttatgacgctctatgttccggcaggaattatcctgctgatagccgatcttcttttaatccccggcctatggctttctttccgcatggtacggaaatatggaaaagaaaagaacgatatttgtgcggagaacgtcagcagcattgttgagtatgtttctggtattcagactttccgagcttatggtgtaggcggtatgaagaacaaaactgttatcaacgccatgcgggagttttcccggatcagctttgtgtacgaatcaaaagtgcttcctattggtgcggtctttggtattttgagttggctgtcctgcccgctggttatcttgctggcctatgcaccctgggtcgcagggacactgagcacggtggactaccttttgatttgtatgctgcccctgttctgtgcaaagctggctaactcgatttttgtagaccttaccagttataagaacctgatgatctcgaaaaacaaaatcttgagtgtaatgaatgagccggaggaaactggcagcatggagccgcttcacacagctacccatgaaatcacatttgacaatgtagattttgcatatgttcccggtgaaccgatactaaaacacgccacctttacggtgccagatcaaaagctcacggccattgtcggagactctggctccggcaaatctactattttgaacctgattgcaaaatattatgaagcaacgggcgggacgatttctattggcggtaaacccattaaccatgttgccgcagagcgtgtactggagcaagtttctatggtagaccaggacatatttctttttgacgataccatccgggataatatccgacacgctcgtcctaatgctacggacacggaaatcgaggctgcctgccgggaggctaactgtgacagcttcatccgtaagatggaaaagggatacgatacgccgactggcgagaatggaaatcttctctctggcggtgagcgtcagcgaatttcaatagcccgcgccatcctgaaaaatagccccatcctgcttttggatgaagcaacagcatctcttgacattgaaaatgagcttgccgtaaagcaggccatcgccaatctgctaaaagaaaaaaagacagtggtaatgattgctcataccctttccattgtcaaaaacgctgatcaaatccttgtaatgggtgatggcaggattgctgaatctggaacccatgaggaattgcttgcgaaaggcggaaaatatgctgctatgtggaacgcagagcaaaaaatatcagcttgatgggaaataagatgtctgtcggatcgaatatgatattagcacagaaacctatgaacgactgaaagaatcagtcacgaaagaataattacatagcgcatgaatctgccccgattaaggggaaagaaaaaaccgttggttggggcaggtaattttgcacactcattttaagttattaccataacggcggttttgagaaatcagagccgccgtttctttgcttttacacaaaccaatgacgacttccagggacacggtagccgattggaggttaatttatcgtgccccgtttactttgtcaaagctcacatgatctgcatcagttaaaaaaattattgttcttcgttcgggcaagtataatattgcatcggcattatcgttctatgtaattcagtataataatggctgtttttggaatgccagttttccattgcggaaatttggcgtttttgatagccgtttttatgatgatacttttagagtatatcgctgtcgatcaccgccacactccgatttgatttcgcaaaaattcagatcggaggaaaagataagtggcttacaataaagcaaaagaagaatatagatggaaccagtggaaagcagaggaagagaagatcctgcgtgaacagggcgtggatgaagagacgatccagaagcttcgggagtatgactgggacgatttcaatgcagagcggagattccgggaacaccagacctcgcttctggactgtatggaactgctcctggaagaaaaagaaaccaaagagtcccagccggagagcgtagaagccctgctggataccgtggagaacgaagaactgcttcagatcctgttatcaactgataagaaaacccttcagatgattgtcctgaagatgatgggatatgcaccaaaagagatcagtcatcacatggaactgccggagcagacggtttatacaagactgcggagattaagggaaaagatcaaaaagtccatgaaatttgaataaaacaaaaggttctcatcggctgactattagaacgaacagacaggaggattaatacgatggatgagaaagaagtgtccgaaatgcaggaagaaatgatgacggtactggtagtcgagccgatgaaagcaccctatgtcaaaagcatccccaatgagctggaagatctgcagcaggcagtaggcggtgacattgagatgacttatccgtttgaggatgaggttggaattcttttaaacggcaatggaaaatttgaggggttgccgttaaatcgggcattgtacgatgaccgaggacaggtctatgatgccattgccggaacattccttgtggtaggactgacagaagatgattttacttcgctgacaccggagcagattgaaaagtttaaagaaaaatatcagtcaccggaagttttcaccctgtttaacggggaacttcatgtgatgaagatgccaccgcaggaacaaaaagagcagaaggaaagtcggaagaaggatgcacagcagaagaatccggcaaaaggaaaaaagaaaaacagatccggggatgcaagataaaatatttttttgtgaagtgaataaaaaaatacactgccatcggctagtaagcagagggacatccctcggctgttctttggcaagtgaatatcggcactacaggtacgttcccaaccgtagaagcgtgacagtatgagcgccatgattaagtatagggtaaagattcttagacttggagcgagaaagcatagctgtgaataaggcggtggcagcctttcgccaggatcacggacgggggataatgatacacgttaccagccagagagcggaagatggactccgggttgtaatcagaaagacccccaggacatctgtgagcggcggcaggccagccgcccgcctgtagtgtccccttccccagaagaaatacagggatagttccgggggtgcgaggtcaaatgcggaacagcaagataaaaaagaaatcaatgaagaagtgtgtcgttgatatcagataccatgcggctgtgggagactacagccgtattcttgtggtattaacgtcacatcaaggggagagaacagatggaagaaacaaaaagaagtggaatgagcaaggatcaattctggaatctgattgaaaaagcaaaggaagtgtgcggcaccgatctggatgcttcggcagtgtggatcaagcagcagctcttctatatgacaccggaggatgtcctccaattccacaatcttgtttacagttaccgggatgcggcttataagtacggcttatggacagcggcaggtattatgatggaagcagggtgcagtgatgacagtttttccgattttcggatgtggctgatcgcccagggaaaagaagtttatctgaatgccttaaaagatccggattccctttccggcgtgactccgtatgggtactgtagttttgaagcgttgggatacatctcatcgcaggtctacagtgccatgaaagggaaaaatatctatcaggacagtacggcaagaatgcagatggaatgttatgagcaggtgatccgggatattgtgtaccatcccatgatcgagtatccgctggaattaccggaagcaatggtggtatatccgaaactctgtgaatgtcatttgtccgagcaggtaaggaaagctcctcagaaagtaaggacatggaatgtttcccggacggatatccgaaggatgatggcaagagggaatgctgccataaagaaaatgcaggaacagggacagaatacaccggaagcgaccagacccgtccgtaagggtacggtaagataagctttctggcaaggagaagtaatgtgttataaaaatgaatatcagaaaagggcacatggtgaagtggaacagatctttcgggagcttctcccggaagccgggcttcatgtaagggaagaacagatccgtctctgccatgaaatgctggatgcccttatgaaaaatgaaatcacgctctgtgatgcaggagtcggcatcggaaagacctatgcctatctgacagcctgcatcctgatgcggaaatatagtgtactgcattccggttattcgggatgtgacaggcggtctgtagtggtatccacttccagtatcgccttacagaaagccatcatagaggaatatgttcctttcttatcggacgtactgttaaaagcagatctgcttcagggagagttaaaagcggtcgtccgcaagggaaaggaacattttgtatgcgattacaggctggcccagagattagaggcagtccgggacaagaataaaaatcaggcacagatggaggcattgaagtccctccggcataattttgatttagattccgtacataacctgagcggttttgaccgcaggctggtgtgcgtaccgaaattctgccccagggaatgtccggggaaagcaggatgccgttatcagaagcatctggatatttccaggaaagaggatatttttttacagatttgcaatcacaattatcttctggcagatgccatgcaccgggcaaatgggtaccgtccgcttctggcagattacagggctctggtcgtggatgaggcccataaactcccggaagccgccagccagatgtatggaagaagcattggaagggaagatgtgcaggagattgcttactttttagtcagagagcataaaggcacggatggaaaacggctgctggaaggggtttccgctcttcagatggagattcgaaagcaccggaaagatggcatcgaggacatggctggaaaagaaagtttttattttccgccgggagctggcacagccttaacccagatgcaggaaagacttcagcttatgattaaaaggctcgccgggaatattccttactggactttccggcggctggaagagatggaagagctgttcggctggtttttaaagaacgacaaacggtatattttgtttttacagcaggacagccggggacatttaacctttatggcagtcaaccgggagatcccgaagtatctggacgccaccttatggagccggggatttccggcaatcttaaccagcggcaccttaaaagccgggaacggttttgcaaggaccagacagatgaccgggctggaaaaagaaacaggtgtccgggagtgtgtggcagaatccccattctgctaccaggagaactgtctgctttacatcccggagcatttaaaaccaagaaaaaaggggagccgggaagaggccgagcagcttgccgggcagatccgtgatctggtgtgttccacttacgggcatacgctggtactgttcacatcttataccctgatgggaaatgtgcagcagcttttgcgggatcagatcccgtttccgatggtgcaggtatggagaaactcccaggaagagatcgcccggtttaagaagatggagaatgccgtgttgttcgcagccggctcctgctgggagggtgtggactttccgggtgacatggtatcgtccctgattatcgtaaaactaccgttttctgttccggaccctatccatgaagcccagagggagcagtaccgatcgctaaaatcctacatccagaccatcgtggtgccagatatgcagaagaagttgcgtcagggatttggccgggcaattcgcacggagcaggacacctgcgttgtgtctattttagatcaccgtgccacgaaaaaaggcaggtatcggagtgatgttctggaagcactgccaaagtgccagagggcagaacggatcgaagaagtagaagattttatccgaagccggaaagtggagcgttactacagctgagagcatccgtggcgttgttggttctgcccagatccgggtagcagacaggacaaaaagtttagtggtatttcaggggcggtttggagcgaattggtagtattggtgatagctttatcggcatgagttgggtatactgtgtatagcgttagaggaaaggaagtgagcagaaatgagaagatatgagctggaaacagaaagagaaggctccaccgtttatttctttatcagagatgtggaaacactggatatcgtcctgcttccaaccaaatatctgatgcacaagatacggaggaaatgttcaccgaatacggtgcggcgctccgcacttgcaatcctgtactatctggaatacatccatgaaaagaaaaaggaattgacagacgtatatcaaatgccttatgttgaacagacaaatcactttgtggaatttttatactggctgaaagccgggaagcataccagagataaaaatcacagatctccaaacaatggaacctgcaacgcatacttaagagatgtgttcaggttctatctttttatagaagaagagtaccagcagttcggggagctgaaagtcctgtcctataattattttgtagccgtggatgcagtaggcgtaaagaaaagcatacgatcaaagagtttcaaaggctatttaaaagaggaagagcataaggcgagagcagcaaagaaagatgaaattgtggaaatcttgaaagcgtgtaccaatataagagatcggcttctcatgctgcttctggcagagacaggctaccgaatcggtgagatcttaggaattgattacagtaaggacattgattatcaaaaccacataattcgggtatatttccgtgaggacaatgaaaatggagcgagagcaaagaatgcagaataccgaagtgcgaagatcagcaaagataccttcggctttttaaatctgtatatcgcagagtaccgaaaactacttcagcaccagacaagcctgtttgtgaatatttcaggggataatagcggaaaaccaatgaacgtggaagcagtatactctatgctaaaaagaatggataagaaaacagggattaagatcacgcctcatatgctccggcattactttggaaatgagcggagaaaagcaggatggtcgctggaactgatacagctggcctatggacaccgccacatccagacaaccatcaattatctggacattgtggatgatgaactgctggatgccagccaggaattctacgagaaacactcctccctgtatgggattgaggaattgctataggaggtggtttttatgcctgcgtttttacagtcttttatagaggcagaacaagaacggagcaggcggattgagcagctacgaaaagaaatccgggagtttgcaaaagaggaagcaggaagttccattacagaacagattctgctgtttctggcagatgagatggtagaacatctttcggaaatagattatgaactgcgaatgaaatttgaattatacataacaccgctgataaagcgaaattacatttaccgatataccggaacgttcgaccggatacggcaggcgtacatccgggaacggatgaaaactccggctggacagagggaatgtgaatggaaatataaaaatgaaatactttttgttccataccactcagatcctgtaatcgtaaagagtgtggaaacggtacggtgtcggagtaacatggtctggaattttaaagcggcagccagtgagaaactgaaacgtcagatttttaccgtgctggaatatattctggagaattatgaaatttccagactgagggaatataaactgaccgggttacagcttttttacgaattttgcatccgggagcagattacagatatccagcttctggagctggaacaggaaacagcatttcaggactacctgaagcagaaagtcgagaaagagcaacggcgaaaacgactgaagagcattgtggaaactgcccgtaaagtgatttttatagaaactgatgaaacaagatgggatgctaccatctggtatttagagcggtttcgtattgccaaagaaagaataaaccagagtgacagtatagaaaaaatatcatttcaggaagttctacagcccaagaatcgattgctgcttcaggaatatatgaagtacgaaattggaatcggagaactggcgctcagtacggtgtacgaaagattccgaaccattcgaaattttttgcaggagatcagcgaactggaagttaccaagtgtgatgccagcctgattgatgtatatttaaagaatttgcagaatggtgctatgggagcaaagacatttaataccaatgtttcgggaatacagttttttatgaaatttctggaagtaaaggggtatataaaaaaggttccgttttatgcatcgtattacttggaaaaacagatcccagtccaccatgacagaagtgtggaagaggatgtgtatatggaaattatccaaaacctctcacagtttcctgaacacctgagaatgatgtttttacatctctggtgtgtgggactccggatcagtgaggtctgcaccttaaaaggggatgcgtattatatccagaatggtgactgctggatgaaggtctaccaggtgaaaatgaaaaattataaaagggttcccattccggtaacattgtatcgtctgatgcaggtttatctgaaaaaacaccctaccgaaaaagaagcatacatttttcggaatcggaaaggtggagcattttccaaaagcaccttcatggggcagatgaaaaaatactgctcccagataggcatacagaatggagaatatatttttaagtctcatgattaccgacataccgtagcaaccaatttttatgagcatggcgtatcaatccaaagcatccgggactatctgggacatacgtttgaggaaatgaccatgcagtatatagattatatgccaagaaaaattgctaaagaaaatgacgcatactttgaggaagaggaaaacagcctgcttgcctgtatgcagaaaggagagaagcatggataataaactgaaattccaacaactggaatgttataagctggctaccgatgagcaaaaggaaaagctgaataaggaacaatattttgatctggataaactgccgggaaaccagcttcagacagaatttgtcgaatacatttactaccgtggaacgcaggtatccatcctgaccataaaaagggaaaggcattattttaacagcttatgtgaattttttcagaagtcatcccatcaggaaaacagcctgcttgacagagaaaaagacttctggataaagcagttgaaaatgtggatgatacaaaacggtagggctttgacgaagcataaagtgacgaacattcagactgaatcggtggaaaaagctgccctgatccggtattttgaaagccttctggaatttacactggaccgatcagaaaccaatgagctggcaaaggatatctggcatctggaaaggcttccgcttatcctgcggacaaatccgattgtcaaccataagacactaaatttcagaggaatccggcaaccagatattcgggaagaagtaaaaaaagcaatttaccatcatctgaaaaccgaagcccttggcagtataaaacgtgaactgtccgccatgaataaattttcaaagtatttggatgaaaagcattccaagatcagcacctgcgaagagattgaccgggagatcatagaacaatttttaatcaacatcaaggtagaatcaaacggagggaatggcatccgggatgacctgctaaagcttcgaaatgtgctggaaacaatcggaaaaatttatgattttccacatcttacaaaactgtttttaaaatctgattttccgccagaacggaaagcagaattcaaatcttattcggacagtgagctgaaaagactgaatgcccagattgtaaaaatggaagagcagatagcaagggcaatgatcatccaccagatgcttggaaccagaatttccgacacgctgaccttgcggaaagactgcctttataaacatgaccgtcaggatatgattatcatataccagccgaaaacaagaagatatgaaaaaccgatcagccgggagctggcacagctgattggaaaggcagtcagttatgcaaatgagcattatcctgaaagcatttatatctttgcggacgagaacaaaccggagagaccaatcagttaccaaaccttgcaggataaagtgcttcgaatgatctatgaaaaagatatccgagatgacagcgggaaattattcggatttggaacgcatatgttccggcactgttatggggtaaagctgacagaactccatgtggatgattggaccatagcaaagctcctgggtcataaaggagtgaaaagcgtccagtactaccggaaaatgagcaatcagcgactggcagatgagacaagggaagtaagaaatcttatgtcacagattatcttagcaaatctggacggatggggagaagaatatgagcaaatacgacaagatgctggaattgaataaaagaaagagcgaagaaaaagtggaacgggcagtcctgacaatacggacaatggtgttggagagagaaaaggtgtccgtaccagcactgatgcaaaagactggtttatctagaggattcttttacaagaatccgattgtaagaggtgagattgatacagcaatggaacagcaggctggtatggtggatccaaggagaaacattatcagtcaggcgatggaagcggaaatgaatctgctccggcaacagctacagaaactgaaaagcgaaaatgagaatctaataaaggaaaaccagaagttaaaaaaagcactatccaagaaagagttgaatcttatcaaacagatttaagctatatcataatgcaaagtaggtctgccagaatacagcagatctgttttgcattgtgatatagaaacagattatgcttaaaaggcattaagcaacccataataatgggtattggacatagaaagcaatatgggagtatgatgataccgataagaaatagagtgtacctgaaatgcaaactgtcacagaaaaattatgaactttatgtaaaaagttgcaaaatctattgacctagagcttacttcaggttgtaccataaaataaaaagagcaaggaggaattttttatggatatcgaacagatgaaaaaagacttaggtggaggtaacgtatttccaatcggtgaagaaaacgtagcattcgcaaagtattttacaggtgaatgctatttgaatatgcttacaacagagagagtaccagttggtctggttactttcgctccgggaacaatcaatgcataccacatccatcataaaggtggacagatccttctggttactggtggaagaggatggtaccaggaagaaggaaaatcagctcgtgaattgaaagctggagatgtagtaaatatttcaccagaagtaaaacactggcacggggcagcgaaagacagctggttccagcatctggctgttgaagttccagcagagggagcttccaacgaatggctggagtttttaccggaagaagagtataacaaattaccataaataagaaagatggaggtttgatatcatggcaaagattacacagacagcaggaagaaatgctctgggaacatttgcaccggagtttgcacatttcaacgatgatgttctgttcggagagaactggaacaatgaagatattgatttaaagacaagaagcattatcacagtcgtagcactgatggcacagggaattacagattcttctttaaaattccatttacagaatgcaaaggatcatggagtaacacagaaagaaatcgcagcgattatcacccacatagcattctatgcaggatggccaaagggatgggcagtattcaaccttgcaaaagaggtttggaacgaggaagaaatagaaaaataacctggtagaaactgctcgtcagaaaagattcgcacaaagcacaaatgtgtatgccgttaaagccagcaactacaagggattgcggagggggagtccagtttaatgcagaaataactggcacattcatcacaagggcggacagattctgctcgttacttatggctcaggctggtatcaggctgagggcgaaaaagcagtaaagctacacgccggagacgttgtcaatattacgccggaagtaaagcattggcacggagcggcaaaggacagtgtttttgtccatttggctgttgaggttccggccgaaggggcttataacgaatggctggagcctgtttcagatgaagaatttaataatttagtataaggagatataatatgaaatatataactttgaacaatggtataaaaatgcctatactcggttatggagtgtttcaagttaatccggaggaatgcgaaagatgtgtgtctgacgctattgaaacaggatataggtcaatagatacagcccaggcgtatcataacgaggatggcgttggaaatgcggttgaaaaatgcggtctgcccagagaggaattatttataacaacaaaagtatggatttcaaacagcggttacgaaagagcaaaagcctcaatagaggagtctttaaataagcttaaatcagattatattgatttgctgcttattcatcagccgttcggagattattacggaacatacagggctatgacagaggcctataaagccggaaaagtcaaagctataggggtgagcaatttttaccctgaccggcttgttgatttctgcaagtttaatgaagtggttccagcggtaaaccaagtggaaacgcacccatttttacagcagagaaaggctcgtgattggatgagaaagtacggcgttaaactcgagtcatgggggccgtttgcggaagggaaaaataatattttctcaaacccggttttaaaagaaattggtgaaagtcataataaatcggttgctcaggttattttaaggtatcttatagaaaatgatattatagtcataccaaagacaacgcataaagaaagaatgaaagaaaacattaatatttttgatttcgaactttcaaaagaggataagcaaagaattttggaattagacggaaccgaaagtttatttctgtcccattatgaccctgaaactgttgaatatttaacaggtttaaaataatataagaaaataaaatcccatattgtgtttttaaaaggctcggtaatgctgagccttttagcgtgcagaaaatagcggacttttaacccctagatcaatagggcctaaacattaaatttgtgtataatgccaaacactttatgctttgttaacaatttggtcgcttagcatgcagaaaaagcggtttgagaaaaaggttgtgcaaacaagtgagatttaatcagtctatggaactgccattgaagctgactgaaggataaaaacagctcaaaaatgctgtgcgctcatctgcagccacacatattcactttttagacgatagaggctaaacattaaattttgtgtataatgttaaacttttaataattttatcggcagtctgagcggctcaacaatatttagcggcttttaaacttgcaaaatagaatatgagtgatataatagttttaatttgattattaaaaaaggagaaattagttttatggaaaatcaccctatacctccggtgtatgataaaaattctaagatcctgatattgggaagtttcccttcggttaaatcaagagaaatgaagtttttctacggtcatccgcaaaatagattttggaaagttcttgcaggactgacgcgttctgaatgtcctcaaacgattgaagaaaagagagaatttttaattcataatcacattgccgtatgggatgttataaaaagctgtgatataattggttcgtctgacagctcgataaagaatgtgagtgtgaatgatataaaaaatataattgaaaattctgatataaaagcagtttttacaaacggaggaacagcgcataaactatataaaaaatatatggactgcgattatgaagcggtaaagcttccgtctaccagccctgccaacgccgcatattcactggataaattgataaatgaatggaaagtgattttagattatttataaatatttcttttctttgttaatatttattcagcaaataaatttatttataaagttaagataaaaaataattgtcgttaggtatgttttattttttaaattccacataagatgtttttatgtataaatttttaaacatatcatgatttatgttttgggattaaataaaaaacaatagttttattaaatataaattattttcaagacagaaataaaaattatatagagctgtaaaaaataaagccgcgatagtaaaccacataaaaaacttaataattgcgggaaaacggcgttctcttcaggcttttagccatgaaaagagcgctgtttttttgcagcatttttgaaaaagatagttttattacgttctattttttatttattagagttagattttatatctgttgaagcatattgaatttattgactgatttcggaaataataaaatgtaaaagcaatggtgcggaggaataaaaatgaaaaaatcagtctggacggacagtattaaattacctgagttcccaaaagcggacaaagaaatgaaaactgaagttttaattataggcggcggcatatgcggaatactatgcgcgtacatgctggagcaaaaaggtattgattatatacttgttgaaggaagcagaataggatatggaataacaaaaaatacgacggctaaaataacgtctcagcacgggttgatttataataagctgataaaatcagtcggacgtgaaaaagcccaaatgtatttatccgctaatgaaaaagctctaagagagtatagattaatagctgaaaatatagactgcgattttgaaacaaaagatgcgtatgtttattcgattaatgatagaaaaaagattgaggatgaggtaagcgcagtaaacagtctgggatttaatgcagaatttgcatctgagacaagccttccattcaagacagcaggcgccgtaaaatttaaaaaccaggcgcagtttaatccaatgaagtttttaaatgaaatagtaaaagggctgaatatatatgaaaatacttttataaccgatataagtgaaaattggacaaagtttgacggcggtaagatattggcagataaaataattgttgcaacacactttccgtttataaataaacacggcagttattttataaagatgtatcagaagcgttcatatgttattgcctttgaaaacgcagataatgttgacggtatgtatattgatgaagctgaaaacggtatgtctttcagaaattatgaagaccttttgctgattgggggaggaggtcacaggacaggaaagcaaggaggcaactggagagcggttaaagaattttcagaaaaatattatcctaaagctaaagaaaaattttattgggcggctcaggactgcatgagtttggacggaatcccatatataggacgttactctaaaaccactccaaacttgtatgtggcctccgggtttaacaagtggggaatgacatcgtctatggcggcggctgaaattcttgcagatttggtggttggaaagagcagtgaatatgaaccactgtttaatccaagcagaaatattttaaagccccagctttttgtcaacggttttgaagcagtaacaaatttgctgacgccgaccttaaaacgctgccctcatttggggtgtgcgcttaaatggaataaggctgagcacacctgggattgtccatgccatggctcaaggtttgaaaaaaacggggatttgatagataatcctgcgaccggaggtgttgatattgggtaactattttgacggatattattataaacaccaaaaaggagacgatgttctttctttggttgtgggcaggtcaaattcagaggagtttatacaggtaataaccagggattcttcatacaatgttccgtttataggtgagaactatttttctgataagggcgttagtttaaatataaaaactgatgaaatttccttaaacggcgatttggagtaccgggatttgtctcctataaaatatgatataatggggccctttaaatattttccaatggagtgcaggcacggaatcataagtatgcgccacacactggaaggcaggctgaaactaaacggaaaagaaatagacttcacaaacggtttgggatatatagaaaaggacagcggaaggtcgtttccgtcttcatatgtatgggttcaggctaatgattttgacgagccctgctcaattatggcttctgttgcggatataccatttttgggatttcattttaaaggctgcatttgtatcattcagtataatgggactgaatatagaatggcgacatatttgggagtaaaggttataaagtgtgccaaagacaaaataattttggagcaggggaaatataaactggagatagatatagacaaaaataacggacaagagctgagcgccccaagcaaaggtgagatgacaagaacgataatagaaacagcagcctgcgccggggagtttaggttttataaaaatgacgatatgctgttttctttaaagtcaaataatgtgagttttgaatacgaggcataatagtataatttggcgcatccatattggatgcgccaaatcaacgcaccaatgtagagtgcgacgaacacatataacgctctcatcagtctgaacaatttccaatccgcgcacccgtgtagggtgcgactcccttacggtaaaaattaatggaaaggcagcaaatatttcaatccgcgaacccgcataaggcacgacacaacttctttaattcatccgttgtaagtttaacatttcaatccacacatacgcatagtgggtgacttattttctcatgtttaggtttctctgattctattttaaaatttaaaattgctaaactggtgttaaaattttttaatttttacagcttttatctatacacatttataaactagggtctattctttttttacaatttctgcaaatttcataatgcttttgagttaaaaactcttcatcctttgttggttttactccgccatcaacaatccactgtaattcaatacaataacctagttctatttcttttttcaacattggacaatcaacatcatctactattttagtcatttattcatcaccttatatattatatttgcagtacaaacagtagtataatttcaatccacgcacccgtgtagggtgcgacagcggtgtcacaatggaaacaaggaacaactataccatttcaatacacgcacccgtgtagggtgcgaccgtctaacagaagaacacgaaataaatcaaaagttatttcaatccacgcacccgtgtagggtgcgactgcaaaaatgtataaaattggtatatttttattcttataattgttatattgcggcataatatttaaatctttaatataatatgtgtttataagaatgcctcttattatatatttttgtaaaaacgcggtgcgaacctcccggggaaatcatgtgagcttacggttcgcacctaaaatattagggggtcattaacatagtgtgatggctttatacctatgtgctcaactttgcttttgtagttgtttccgaaataataaaaacgcagactatctgtttctttgtctattattttctctaacttatgtaacagcatttttgattgtcctgcgtcaagaaaacactcaaatactgaattttgtactctttgaccatagttaacacactgttttgctacttttcttaaccttgtctttccggcgggggttacggtgtttacatcatatgtgattaaaacaagcatgaaactcacatcatttccatagtaatggaggatatgcgtccatatcgccgcggatatatcttgccagcaactgtgcttgtacaagtattgccgtgccccactgcattttttcttttgtgaaaggatgtgttattgtctcttgttttctgttctgtcattggctcagaatcgtttttcttgcttcatcacagatagtaaccgctccgctctctttttgagaaaaactatctatggtgacttcccgtctgtttattaggcttaatacaaatctgtcagcaagaacgcttctaaactcttccatcaaatcaagtccaagcgacagcctgcccggtctgtcacggtgcaggaagcctacatatgcgtctaagccggccgcctcagctgcggcagatgtttcatgtgcgagcacagtataaacataggacagcatagagtttacagggtctagaggagggcgcttgtttcttccgttaaacagaaactcgtccttttgctgaagtatcatttcatcaaatatgccaaaatatatgctcgctccgtaaatatgccgccttcaagtgtgtggagattttctttccattgctgttctatatatatgagcgcccattgtctgggacagaaagcgaaatgctggattcctcccaaagacagaaaatcatcctcattatattccattaaactcctccgcttcaaggccgcttagaggttcaactgatatagaataatccgcaagcgacttgccttcgccgctgacaactacttttaaactcctgtgtactgtggcggaggagtattgccctgctttgcagttatgtttccaccagtatacctttaaaatttccatactgccgtcaggtcttgctgatgagcaatcgttttcaaacagggtgcagagagcctttttaatctgctcggcgtcctcctcggtaaagcctgtcttttcagcaagctgaacgttaatgctgccgaaaaatttgtatactccgaaatcaaccctgtgttttgagcccattgtgtctgacgcttttgcttttccggacgcactgtttacgcttttggttatctgcatgcttgtaacgtcgataggtttaatgctcaccgcggtttggactgttacaggccctctgactccaactgatagattgtcgcctttaaacgcaaacacttgtccgaaactgcgaacgtctatccattctttgcaggcggtttctgcatatttatcaacgtctttttttattgcttttaattcttcgcacgcgtcggcgcgttcgtggaggctgtcaaagccgtcgtcttttctttcattagattgtacaaatatttattctcccaggtcttggagacggtttctgatttttcttttaaggcagacgtctgatacctcgccgtatccgtcataatttattctcggtctgttcccgtcgagcgggtctccgttagggttggctttgttaactgaaaataccacagcaaaatcaattttgttttgtaaagtgctcattagttttcctccgtttcttttgtttcgtcttttttatcatgtttttttaatagttctgctttttgacaagcatatcccaataaatactgtgggtcgagcggtttgttattcataaaatcattggcgcttatttcagcaataactttttgcatctcgtcgtacagccatgtgcttgaactataaagcttttcaacatacggaagcagtttttcatcaattaccataagcgttttggccggctgtattctgtatttgcttctaagttttatagcgttcggaggacgcttgtctcctgatttatacaaaacatagtcttcaatttgttcggcataggccaataccctgccgaaaagatagcttctgtctttgttgcttttatctaatgacatgctgtagttcatccctttcgtatcatatatgtatttatttataattgaacatgttatgctggtcgctttgctcaattcccagtcctcattaaaagattgaggatttgaaactctttgcagtgacttgttcataaaatctttgggcatgcgtttgccgtcggttatgcaggatattagtatttccatcaaatgctttttttgtttttcgtcaacatttcttccgtaggcagcatatataatatcgtttattgaaggcgcgccggtgaactcaatatgttttaattcttgttttccgtccggtaaaatcttgctgactagtttatatttgtgattccaaacgcaggtcgtatgccaggtttttattctgtcaagataatcgtttggtgaaaattcacggtagtatgtaatagacagccgccccggagttgctgattccaaaatcataataataacattgtcattatcaggtattttgtatttatatccatttactgccaactcaacaagcttggcatattgtctttcagaattataaattgctgccggcgcttcatctccaaacgggtcgccgccagccgttatgtcataggtgtcctgtaacggggtcggaatatcctcgccgccgacgcaccaaaccacaactgtttggtctccggttgaaaacccttggttactgaccagccatctgagcgcactgtgtgctttatcagagctttcaaatccaactgagaatacgttttccttatttttgaatcgtcctctatatgtgaaaccgtattcatcgtttgcagagattagtcttgcgctgtctccggttgttcgtatttttgtagggtgcttataggttacagcctgggtggttccgctgacgaaacatatagacttttgtttgcggtttttgcggtcgtattccatataggaattcatcagttcagaatttgtgttgcattcaaaagagtttccgtatttatcctcaacccgaaaacgtacaacagtctttaatatatcagcaggcttattgtctttgtcgccgttccattttaacttttcctccggaagtattaaaccggattctatcaagtcatgaaacacagtgccgcgttttatgtatttatatattgctttaacttggtttggacaattttcgtcattgcaccagtcagaaagctgggcgcagtatttttcataattttttgaattatcttgcttagctatgtatctttgcgcgtcgccggctatatattttaagttgttataaacaatatgcggcgcgttattgctgctgcgcacagcggaatcttcagtgcatggggttatcgttcttgcttctgattttgtcagcggacgtatacgcagcagctcgccggattcattcagaaatatctcggcgtgagcattttgaacggtgtgggaaggaggagcaagaggcatgctgcagcgttttaataattccgggctgtcttttaatttttcatatgtctcacagagagcgtttatccagctcatccaaatacccccccgcgttcaaattcttctgcgcctgaaaagttttttccgggtataaatggtttgattttatatttttcagtatccatcactattgaacattcttcaggacgtataaactctataattccgtttttcatctgagcattccaaagccgtgtctgcattttttcaagcccggattcatcgggataagtgataccatgaaccattatgccaaatgacatgctttcattatcataataaccgtttccttccccaaatgtgcagggttcgacatatccctgacattccctggcgcctagaaaaatatcgcgtcttccgccccggtccagcatacgtttggtgatgaaaaagtgtttattctcatttctgtcatccgacagctcttctcgctgcatgttccattcaaaatgggcttctacctggtactcggcgtctattaaatatgtatatattgacaggtcattagaattgttttgatattttggaacgcgtatgcctcttgattcggtgcgtatgggattgattattctcaccctatctatgtaccatataaacgtcggtttccagtatatactttcacatatgccttttaaggcctgatatgtgggaactgaatagctgaacttttcgccccccgctttggttatagggtcgctgaacagtgcggtgcgtccggtaaggcgaaagcttattttgttttctctgttcaaaaaaatcacctctttaatattttaaaattctaaatccggattcatgtatactccgtaattttcatcataaaaccttctgttgagcacaaatgttcctgtgtcttctataataaatattcctccgctgtctttcagctgccgtatttcattttcatacagcgatacgctgtacgcataactctttcgtaataatttggtcttttggctgatttctgagtgtccgtttaagctgttaattatttcagctccgtcttcatatggaacaagcacagaatatgtttcgctgccgataactgaaaaattatccccggctgccgcaaaggcttgttttaaaaaaggcagaggtctagcagtgtgagattcgattgaaaattcgttttttgaaagcagacagacaagcgaatcttctttaggcagtttcaccacatagtcaaactcgcttaaattgcttgttgggacttttagatattcgttgtaatacgcttctattgcttcacgtgagagcaaatcaatattttttttgtgggacatcacggcttcagtgcattcttttgcttttgctatctcagggagacttgagagattttcaccctcggcccgtataagatatacttcacgcagtccgttgaactctccttctctgttgcaccgtcctgccgtctgaatcaaactgtcaataccggctaaagctcttacagcgcacgaaaatgataaatcaacgccggcctctatcagctgggtgcttattaccacaagtttttcagctgaatcaatattggccttattattcagcttttgcgtccgttctttaatttctttgattagtttatctctatgtgcacggcagagtttggcggttagcaaaattttccggcagtcagaatttatggaatcatatacggcacgggcggtcttggtagtgttaaaaaccagcaggacagacgggtttgttattaaacgttcattgacgaattctgctatttcttcatagttcatacttttatcgcttagatttatagctttaacccttttgagagctccgtcagtttctgaactgtaaggaacaatatcaggaggaacactgagttttattggatgttcgctttcgtttgactgcggcatggtggctgtgcataaaattatggtggagccgcatactttgtgcagaaagtttattgcttcgttaaataggcttaaagttttaatgggtaccgcctgaacctcgtctataatgataacagagttgcaaagggcattcatacggcgctggcagcctggttttcgtttatatatggagttaagaaactgaaccactgttgtaagtattaccggcgcgttccacctctgtgtatataatgaatatttttcgtcatcatcgttgatgaaacctgaatggtgttccaaaaccatatcatcaccgcaaatctctttgactgcgtcggcggtttggtcaagaattgtggtgtatggtataacataataaatatggccgcaattatgcttttgggcatgatgaagtgcaaatctcagtgatgacagtgtttttccgccgccggtcggaacattgagcctgtatattcctttgttatcggaaaaatcacagcatttttgagacacttcgcatctaattttgtttagtgttgtgtttggggaaaatgacgcggctttggcttccattttatttacggcttctgaccaatcaatcggctcagctataagagggtcaatatcagcctcaaagcagtatgcgtcatagcggtcgctgtctaccaaagcagaaaataaaagcttttgcagcattccgcaggaaaaagcgttgaacggtttcatctttgctataaaatctcttacttctgcaacagcctttttataaagttctttaattttattttcgctgattacagtttcaaaaaatatttcggctgccttttgataaaaattgtcagttgtattcattttgtttaagaagccgttttccgcatctacagtaatgcagtcaaaaagcccggtatggtgtgaataaaccgcgtctataataagctgagctgtatactgctcgataacgtctgccgccgacgtataaaagtttcggtaaatatatagagctccggtttgtgcgtgatgaacagttccgcgcgccgaactgtcgtttttgcgtatgtattcctgaaactcgggagacgcctttcccatatcatgaatcaatcctgtcaagtatcccaaaatcccaagacctgcttttttcattgtttttgaacaaagaaccgcagcattttcagaatgatttaaaattgtttgtgttttgtctttatcgctaatatatcgggctataatatccacttttatctccgtatgttaaaacattaaaaaatttattgtaatttgttatattataaaataaaaagaaaaaattttgcaagacatttgtgatatttgttaaaaataattatttgtagacttaaaaacgtatacgccatagggcgcaagacagcgctttatggcgtattgttgtatgtttgaaaatttataaaatacgtttatttaaaaggcaaagttatatcgatttcaagaccgtctttattttttgcattaaatgttccgctgtgagcggttatgattttataggccataggcagcccaagtccgtgggcagtctttggaattttatttaaattggttaagattttttcatcagcaccggcgccgttgtcttttatattaatacatatgtcagtatcattttgcgaagccgatataaaaattttgcatccgtctttgttgtgaactatactgttgtttatgagattgaacaaggcgcgttcaagaagcggctcatcccccataattactgcattctcacagtttaaatttaattctattgaatatttatcggataacccgctgtttaatatatccgtaactatgtttcttattaaagtgcatatctttatctctttttttcggttaggctgcatgtcatactctaaagaagaaactaagtttaaatcttcaataagtttttttatttttaaggtttgttctgttattattttggctttttctttattttcgccgtctgtttccgaaaacagttcttcggaatatccgagtattatcgaaagaggcgtccgtatatcgtgtgagacgcctgagatccaattagaacgggcggtatcacgctgtttgattatttgattttttcgttctattgaatcagatgtagtattgatgttcttagcgacttctttaaaaataccgttttcagacatgtgtacaggtttttcttgttttaagttttgtataccttgtatcagcatttttatttttttatataggccgttgccaaaaacgcaggctaataatatagcaaggcaaagattaaatatcagcacagccagtattctttgcggcagggtatcaaaccaatgcatcgaaaactcaatattatattttccaacgctgtttttgggatatcccaatataaggagaccatagtcacagactttctcatacaccggatagtcgtttaagaaccagcgtgatataacggcaatatcatttatattataactcgccggaatatcgtccggcacgttttgaccccatactacgtttccgctttcatctataagtatacaccatgacccttggggaacggcagtttcataggcaagaatgtatccgtcttcggtgtaggtcaatgcttctgaaatgcggctgagagtttttgtctgagattcgggatatatttttgctgtgtcagccgccgtcatagagaagctgaaaaagtttatcagcagcaataaaattgatatgccggaagcaagcaggataaaaaacataaatatttttatggcggttttattcattgtctgaaacctccagtttgtatccaagcccttttacggtaataatatgtttgggctttgagggggctgtctcaatcttttctctaagacgtcttatatgcaccattaatgtgttttcgtatccgtagtaaccgtctccccatgcggcaaggcataaagcgtcataagtcacgatgcggtttttgttttcataaagtttttttaagattataaattcttttgcggttagcggaattacttcttccctaaatttaactgaagcggtttcaagatttataactctgtccgagagtttaatgtctgtattcttaataaccggtttataagttcgttttaaaacggcagtaactcttagaacaaattcacttgtaaggaatggttttactatatagtcatcggctcccagcccgagaccggtgagcctgtcgtccgcttcgccgcgcgctgttaaaaaaataacgggtgactgggaaaacttccgtatatcctcatatagagcaaaaccattgccgtccggaaggtttacatcaagcacgaaaagggatatgttttgttctttggcaatttgcaaagcattgctgcagttttcggatttaaagatgtgataaaagccgctttcaaatagtttgttttcaagaagctttaacaattctttttcatcgtcaacaataagtatttttttattttttatttcatccatttttatcacctgactgtattataccataatcggctgatagataaagcgaatatttttaattttttctgatttaaggtcagcgtaaggttaagttaagtctgatgaaagaatgaggtgttaaaatcgttataaattaaatgagaaaggaagttttatcatgtcaaatcaattagtaagaacgttcggattatctaaaagatatggtgattcactgtctgtcagtaatttggatatgacggtaagcgaagggaaaatatatggttttttgggaccaaacggagcgggaaaaagcaccacgcttaagatgctgctgggtcttgtccgcccttccggcggagaaattgatgtattcggcaaacggtttaactcaaaaaatagaatgaaaattcttaaaaatattggctcgctgatagaaacgccctcgtattacggacatttaaccggaaaagaaaatttggaaataattcagactatactcaaagttccaaaatctaatattgacaaggtgcttaaaatagtgcgccttgaatcccaggctgagaaaaaggtcagggcgtattcgctgggaatgaagcagagacttgggattgcttcggcgatgctggcgtttcctaaattactgatactggacgagccgacaaatgggcttgacccgtcgggaatacaggaaatcagggatttgatacggtcattgccgaaaaagtatggaatgactgtgatagtttcaagccacttgctttcggagatagaccaaatggcggacgatattggaataatagctaaagggcgtatgatgtttcaaggcagtcttgaagcgcttcatactatgggagaaggaaaaagccttgaggaaattttcttagagttaacaaaaggggaggagagcctgtgaagagatatttattttgtgagtataagaaaacaagaagaaaatatatttttgttatggcagttgccataaccgctgtggcgttatgctggggattatatggaaagtataatgagagcgcattaaaaagcggctggatgatgatgctctatcagcttccgcttttgaatacaatttttatgccgttgctggcaattgtagtggcctcaagatttgccggtatagaaacctcaatgatgaaacaattatgttcggttatgccgaagcaaaggctgtacgacgctaaactaatatatagcttatctattataattgtttcattgcttatacagtttgccgcagtctatatagcaggcagatgttttggattcagcggcaggtttcctatagaattgtatgccttatattttatgtttacaatagttccggccgtggaaatatatgtttttcaattcagtgtttctatgctttttaaaaatcaggcagttccgttttttattggagcgattggagaatttattggattatttgcactgtttcttcctcaatacccatggataaggaactcggttatttgggggcattacggagctcttcagtttgtgggaggggattgggacaaagtgacaaggataagcacgttttacttaatggatataaattgggttatgtttgcagtatcgatattattatgcgtagccttttattttataggacggactttatttgtccgcaaggaggtataaaaatgattttaagtattataaacgctgacagaaaaaaattaaaaagagcgccgctgtggcttgcttttatatttatgccgataatcccggccttgctgggcactttgaattattcagccaatttggaaatattggaaaacggctggtatagtctatggacgcagaacactctgtttacatgttatttttttctgccgataatgctgggtatttactgctcatatttaatcagtattgaaagagcgaatcataactggaataaggtgctttcaatgcccgtcccggtttggcaggtgtttttgtcaaagctgataatttcttcgtttatgttgattatcagcgagatctggataggtgttttattcattgtttcaggaaatttggcgggtattgactctgctcttccttcggaattgcttgtttggctggggtgcggaactttgggcggaatagttttggtgtctgctcagcttttggtttctttaataattaagaattttgcagctcctgtcggtatagctttaataggcggactttcgggtttagccgcgctggcaaaagatttcggccatatatacccatattcgcttatggcgtttggaatgaattccaatgcgcctcagcgtctaatggaagggggatatttaaattttactttgacatgtattatctatattgttattttcacaacaatcggaagcgtctatctttcagtaaaggaacaaaaataaataacatagttaataagactgtggctgcaaatcatcagccacagtctttattaattgaaagcaagcttcagcttacatacgtttatatgggtgaagatttaaagtgttttgcgcatatgtcagtgcttgtttatgccatatcgcctgtaagctgcaggatttcacatgttaaacgacactttcaatatatcagcacagattttattatattctaaaagtttcttgtttttaacctttctgtatatttactgtttttgggttacaattatattttattaaataaaattatattgccgattaaaataatttatagaagtatttatataaattgtttgttagattttgttcacacattagggtattaaagcataaatacattgatttatattttcacctattttgtcggtttatttgctgtttaaaaaactttctatatcctccggtgttatcttgccgtgttctttttcaaaatcgtcaataagcgagcgcattaaatacaatatttgaccgctgccgcttctgccgttatacctggcgacataataaaacttgttaagaaaatctgaatctactctaatgctaatatgttttttcttattcataagtattccctcctataattaatactgcactaagttttagtgatttatgaattgattttacactacaaatgtgatataatttcacaaatgcactaagtattagtgcacaatatttaaaggagaaatttacgtgaaaaatataaaatataaaattcatagaatttatcgtcttgcttctaaagtaaacttatatttaaacttatctgtaaaacctgacgataaacgtataaaagcaggacttaatgagattaaaacagttatagaaaaaatattatcagagagctaagaagaaatataaaagtgtctttttaggtatatttttaatatttaataaatagaaaaaagtttatttttaagtataaacgcgatagaggaagtattattaataatatatgaaaataaaaatatatttaattgaattttttgtgataaaattagatataactttatataacatatattaaaaagtttaaacatttttatataaatattttattatatttctgcattattaaatcaggttttatccgctgtaaaagcagaggagtcccggtaaaattttaaattttattttatgataatgttatgctgtctgattatatgaacgctgtgattcaatagcagttttagtaaaagatacttaattattgaaagctaatgtaagttaatttaattataacacgcgcactttaaaaaagttaagtcacagttataaattaggaaaacgaattttttgtattcaaattaatttttctgtccgccatattaacgtctttaagctgctaacattttaataagcagcgatgtattttaaccatcccaaaaacacaatatatagtaataaacaaattggagcaaattttttttgaactctacctacaatgtggagaggttataataaaattaacagaaatataaaaattatatataaaaaatatgtgtttgcaagcatcggagggctgtgaccacacttttcttaaaaagtgtgtgttatacatatgattttattttgccataatctacaatgtctgtgaccccaccattctggtgggtgtgatacaaaataacttgttttgattaaccttcaatgtcaataatatgaatacgcaaatattattatgaatactcaatgaagatgaaatctgccgcgtaaggcgcgcagtcacggtaaagtttattattaaataggatataaaaaactgttttaaatacgttcacgctccgcgtgagatgactgctcacctaacgaggaggacgtgtacgcaatatatcacaattaataacgtatataaattatatagaaataccatctgcttatatgctatataaataaaattattttataatggataaaatttataaaaagttcttgacattagaattttatgtgctataatctatatcatacttatttggtatgaaaactaggaatggaggaaaagtgcagatggatagaagaaaagaatggaagtttgaaacgaaacagcttcacgtcggacaggaggaagcggatttggctacaggtgcccgcgctgttcctatatatatgagctcgtcttatgtgtttaaggattctcagcaggcagctgacaggtttgctctgcgtgagggcggaaatatatatggaagactgacaaatcccacacagagcgcttttgaagagcgtatagcggctcttgaggggggcgttgccgctttggcggttgccagcggagcagctgccataacgtatactttccaaaatttagccaaaagcggagaacatattgtgtcctccaaaaccatatacggcggaacttacaatcttcttgccagcactcttccggattatggtattacggcaacatttgttgacccgtcagatacgcagaattttgaagacgcggttcaggaaaacaccaaagctatatttattgaaactttaggaaacccaaattcaaatgtttcggatatagaggaaattgcaaaaatagctcataaccataatattcctttagttgttgactcaacgttcacctcgcctaatttgataaggccgattgagtacggcgcggatatagttgttcacagcgctacaaagtttatcggagggcatggcacagctctgggcggagtaataatcgacggcggaaattttgattgggaaggctcaggaaagttccctgatttggtaaatcccaatccgagctatcacggtgtcagctttactaaagacgtgggagcggctgcttttgttacaaaaatcagggcggttctgcttagggatacaggagccactctgtcaccgttccatgcgtttttgtttttgcaggggcttgagactctttcgttaagggttgaaaggcatgttgaaaacacgcttaaaatagttgaatttttaaataatcatgaaaaagttgaggctgttcaccatccgtccttgccgggagaaccaacgcatgagctttatgaaaagtattataagaacggtgcgggttctatatttacctttgagattaaaggcggtacggaagaggcacagcggtttatagacaatcttgaaattttttctctgctggcaaatgtggcggacgcaaaaagtctggtaattcatccggcaaccaccacgcattcacagctgagcgccgaagagctggaggaacaagggataaaaccaaatacaattaggctctctatcggacttgaaaatgcagatgacttgattgcggcgctgggagacgcttttgaaacaatataacaaatacctccgttttgcaggagtattaattaagttttgaggcacctattacgttatagcattaaagcatgattgagctgctttgtgaaaaaaactttgaatggtatggtattattttcatatttttgatataatagttacaatataaattgtctgaaagagggaaaaacaatgagtaaagttgtaaagagtattactgaacttataggaaacacgccgatgctggaactgacaggtattgaagaaagtcatagtctggaagcgtctgttatcgctaagcttgaatattttaatccttgcggaagcgtaaaggacagagttgctaaaaatatgattgagaatgcggaaaaaaatggtgacttaaagcccgggtcggttattattgagccgaccagcggaaataccggaatcggtttggcttctgttggagtttcaaaaggatacagagttattataacaatgcccgagaccatgagcgctgaaagaagaaacttgatgaaagcatacggcgcagagctcgtgttaactgagggctcaaaggggatgaacggagctattgcaaaggctgaggaattggcaaaagaaatacccggagcgtttataccggggcagttttcaaatccgtcaaatccacaggcgcactttgaaacaacaggaccggaaatatgggagcaaaccggcggcaatgttgatattttagtttcaggtgttggaaccggcggaactataagcggagtgggaaagtttttaaaatctaagaatccgaatataaaaattattgcggtggagcctgaatcatctccggttttgtcaggcggaaagccgggtcctcatggaatccagggcataggagcaggatttattcccgaaactttgaatacagagatttatgatgagatagtcaccgtcgctgacagtgacgcctatcagaccgggaggaaactggcaaagacagaagggctacttgtgggaatctcgtcaggcgcggctgtttgggcggctgttcaggctgcaaaacgtgcggaaaacaagggcaagactattgttgccgtacttcctgacacaggcgagaggtatttatcgactcctatgttcacacaggcatagaaattattgagacttcagaaacgctaaaaaacacgtgatgttctaatgacctaagttttggtttgtttagaacattgcgtgtttttattataaaacgatttttttattaacttttatttattctgttcgaacattgggtatcatggaaaggacataataaagtggacagaaacttttaaggtcattaataataaaaagaagtataaaacacattcgattttttgttttgttttctgttgactttccgcctacaatgtaatgattagaataaagaggacgtaaatgtaagagtgaatttttataacacaaacccggacgatggggtcacagttacaccttccaatgcttgcaaaatcatatttattataaaatttatttagaatggatagttaacattttaaaagtatggtaacagccataccgttgtttgctatactacattctttatataatttttattatataaccttaacatttttgtgcaatatatagcagcatttccagtttattgatataagccgctttgtatcatacacactttttaagccgtcggcagttttaatttcataggtgtgtatcttacaccgtttgttatttgttctgagtcggtgttctcgaatccgaggcggtgatatattggaactgcaaacggcgaagagtttacggaaatattaccggttaagctgtctttttttatgaactctaaaagagattttcctatccctttattatggtatctgccgtcgacaaaaaataacgcaatatgacatcctttattgcgcgttgcgataataccaaccaactcagcatttagaaatgctccataccaatgcagtctgtttaaataatttgggtcatgaatgctattgtaaaattcgtcaactccgtgtttactgtattcaggcgcttcgtattctaaaaatactttccagaccaattttagggcttgttctatttcgtttttataaagttctcgtaaatgcaaataaccactccttaatggatgtacagctaatatttatttgcttgtattggtaagtaatttttaaaacggcttaaaccggttttatagttttcggctgtaaacctctaatatataaggttcttttgtttttaaatctattttttcttcagaatattgataagaaaaaccgcaggataatgccaaagctttggatatcttgttattagcccgtgttgaataaaaaaactcttttcctctcaaagtgttggcacagtattcaagcaataactgtaaggtttgtttgcccaagcctttgccggtatattcgggtcccagcgcaatgccggcgtcctgaaaaatatgtggggatatttcctcaaccccggcaaagccaatagcctgaccatgttctttttcgtatatgaagtatgtatcatgcgtcttttgataagtgatggttttctttattctctcttttgctgattcttctgttttggttatttgccattgcatatatttggctgtttccggtcttgaccaaacatttttgtgcattgattcccaatcctcaaattttgcttttcttaatacaatatcatctgtttccattggattcatatagattcctctcattttttattcaataataattcatctgaagtatagattcatataatagatatgtttgtaagctgcagagaaccgcaggttatatctttaggagttataaaattaaatatttatatatcagccgtcaactgattttagggcgttcatctgataatatctgccttttttagccattagctcgctgtggtttccgctctcaattatctgacctttgtctattactataatattgtcggcgtctcttattgttgaaagcctgtgggcaattattatgctggtgcggtttttcatcagacgaatcagcgccctctgaatgtctttttcagtctttgtgtctaccgagcttgtcgcctcgtccagtatcagtatcgggctgtcgcacagcaatgctctagatattgcaatcagctgtcgctgtccctcgcttaacgtgtcctggcttccggataccaaagtcagatagccgtggggaagccgtctgataaatccgtcggcgtgcgaaagtttggcggcttttataacttcgctttcagtggcttcgggtttggaatatcttatattgtctaatatcgttccggtaaacaggctggtatcctgcagaactacagaaaaacagttttcaagactttttcgttttatgtctttaacgtccactccatcaattaatattttgcctgaatccacatcgtaaaacctggttatcagattaacgattgttgtctttcctgaaccggtttcacctaccaaggcaacattctgtccggggtttaccttgaaagaaatattttttagtatttgtttttcatcgctgtatgaaaagctgacgtcttcaaattccaccctgcctttcacattatctaagtctaaagcatcttccgaatccgctgcttcctcgttttcatccagtatctcaaagacgcgctccgcaccggcaagcgcagactgaatattgttgaacagcccggcaacagaattgagagggttggcgaattgttttgaatacgtcataaagctgactgcagttcctatcagcagaccgtattttgtgcagagtattcctccgactatagcggttattgaaaaagtaaggttgtttattatgttcatcagcggcatcatatatcccgcccatatttgagcgctggttccgcttttctttaactcttggttgacttttgaaaaatcggtttgtgtgctttcctctttggaaaaggcttttatcattttaagtccgtatatgctttcctcaataataccgtttatctcgcctaaacttcgctgttggtcataaaaatgttttctgcttcttttagcgattactcttgtgagtatgtataccaaaggcacgcaggtcaaaacagccagggtcagcggtatgctcagagaaagcattatgataagcgagcctgagattgtgagtattgcagaagcaagctgagttgccgactgtgcgattgttgtgcttatggtgtcggcgtcattggtgatgcggctcatggtgtcgccgcgcggcgttgtgtcaaaaaaagacagcggaagtttttgcagtttagaaaatatttcgcttcttaaagtcctgaccaatttttgagacacacttaaaattgccgtatcactaattgttgttatcagccagtttgacagatagagagcggctataaccgaaactaaaattataagggaatgattattaaccgttctgagctcggtgttaaatgtgttgaaagtcttacccacaaagtagggaatcaatactgatattccggaagccagcaatgtaagaaatacagcggagataactatgcctttaaagcgcatatacacttttataaggcgcatcagagtgcctttttggtcttttgctctctcggtgttgctgaacctggcggctccgcctacttttggtcctcccattctgggcagctcaatattttttgccatattatcacatcccttccgtgatactgccaatctgagaatcaaatatttctctgtaaatgctgcattcctcaagcagttcgtcatgagttccgaatccaacgcgttctccgtccgataataccaaaatattatcagcaaacatggctgtcgaacaccgctgggttatcaggataacggtggatttattatcttctgacaggaggttgtctctaacctttgtttcggtgagtgtatcaagggcgctggtagcgtcgtcaagaaccaaaatcggtgagtttttgataagtcctcgggctatggatattctctgcttttggccgcctgaaatattaacgccgccgcttcctaagtatgtgtcgataccgttttccatttcatatatgaaatcggcgcctgatgcttttattgcagcttcaacttgagctttttcggcttttgggttgccccatgttatattgtccagaaccgtgccggaaaacagcatagctttttgaggcacaagggcgacgctttttctcacagtttcaatattaagtttttttatatctttgccgtcaaacatgatactgctgttcttgtcagggtcatataatctgagcaggagccaggcgagcgttgattttcctgagccggtcgggcctataacagccaggcttttcccggcaggaacataaaaggataaattttttatagccggaaccccgctgcctcccggatatgaaaaagtcacattgttaaactcaaccgtacctgaaataacggcgtctgagttattctctgagttcttgaaatcatcctcacagtttagtatctcggttattcttgaaactgaagctttggtttttacaaaagtattaaatatatttgttatcatcagcagagaacttaaaatctgcgccatatacactataaaggctgaaatctgaccgggctgggtcagaccgagagtgaaaagcctgcttccggcaagcagtgcggccgcggagcctaaaccaacaacaagggtcagtataggtgaaataaatgttattactatttgagcgtgcacgccttttttcataaggttcgcattatcgtcttcaaaccttgaggcttcgtcggaatatgttccaaacgcttttataagcctaactcccattaagtattcttcaactaccgtattaagtctgtccattgccgcctggagttttccgaaccggggatatgacagcctcatccctaagtataacagcagaccgactattataacaaccaaatagattattatgcttagctgcaggttgagtattgaagcgaggattatactgccgatacaggttagaggagccttaaaaaatattctcatagtgccgtttacgaattgtgtaagctgagtaacgtcgtttgtcattctgatgattagagagccgctttcgattttatcggcgcttccctgcctgaaattaagaatttttgaaaataaatcgtatcttaaatcggctccgaagctctgagaaactttgctggctattatatttcttgagacggcgaacactgcacccagagcagcagcaaaaatcatgcgtccgccccataggtatacgttctgtatcataccaagctctatgccgtcgtttattatatgagacatgagcgtcggtcccaaaaggtcgcagagagcttctagagctacgcatgatacagcaataaaaaaccagtatttatatttggtaaaatagcgcatgtatattttcaagtgctgtcgacctccattgattttattggtgtagatataatattaaaagcagaaaaaatttattagccaaaagggttaatgataaatttttctaagtatgttcacgctgcatgttagatagcagctcacctaacaaggcgcacatgcacgccctgctgtactaaaaacactccttatttttatgcctttaaaaagttttagatattatcttttgggtattgcggataacgttttttatcttcctcggttatttgacgtattggtctgcagggaacaccaactgctataacattgggcggaatgtctttttttacaacacttccggcacctattacagaattatctcctatttctgcaccgcccaaaatgacagtgccggccccaatccaaacattgtttcctatctttatcggttttgccacttctaaacctgcgtttctttgttcagcgtcaatcgcatgttcggcggttgtgatgcacacgtttggagcaataaatacatggtcgcctatttcaaccttggcgccgtctgtgattacaagattatgatttgagtagaaaaaatctccaatatataggttatatccaaaatcgcaccagaacggagcggtaacttttgcgttttcgcccaggtttccaataatttgttttagcagacgatttttgttttcctcatctgaaggtttaatctgattatattcataacataaatcagtgcacttttcgatttcatttacgatttcagaatcataatttgcgttgtataagtatcctgcttttgctttttctttctcagtcatttttatctctcctaaaaatatatttttataataatctatattttataaaatatatcataaaatttaaaagttatattttgatttagcgcctaatgagatgtgtaaacgtataatattacaaccaagtttgattactctgcaatgtctgtgaccccaccagtatggtgggtgtaatacaaagtaacttgttttattatagccttcaatgtcaataaattacttagttgtgatgtattgtgaccccaccagtatggtgggtgtaatacaaagtgcttagttgtgatgtattgtggttgtacatcccgttaggtaactgtcatatcacgcgaagcgtagaggtgcttagaatagtttgttatgaatcttattataatgaacttttccgtgactgcgcgccttacgcggcgtacttcgtacgccctccgaagcttgctataccacatttttatatgatttatttttaatatatttgattttacaatatatctccacttaatttggtctttctattcgagtattcatattattatttgcgtattcaaattattgacaatgaaggtttatcaaaacaagtcattttgtatcacacccaccataacggtggggtcacagacaatgaaggtttatcaaaacaagtcattttgtatcacacccaccataacggtggggtcacagacatcgtaggtttattaaaataagtccctgtggctcacacgtggtcacagttacactcttccgaagcttgctgtaccacattttttataaatatttgttatataaacttgatttgtttgtctgtttttttggagactttccggtaattataaaactcaaaatatatttataacaaaatattgaacatttcacagctcttaaaaacttttaattttattctgcatttaagagtatatcataaccggttgagtaaatctattgtatattttatatgaaagaaatgtaatattttaatcagccggttaataaattaatcaagctgtgggtaaataacaatatagttatggaaatatgaagaaacattattaatgaaataaattatacctgtatccgcaatttgcacaagtaatttactctcaatgttaaaaatttatttacaaattttttgtgaaaagctattgacaaagattgggtgtggtgctattattataccaggttagcactcgacttgtgtgagtgctaacaagtaaattgttttatacaaaggagggcaggcttatggcatcgctggatgacagaaaaaagctaattcttcaggctattgttgaagactatatcaaaaacgctgagcctgttggttccagaagcattgctaaaaagaccagtcttaacctcagcgcggcgacaatccgtaacgagatgtgtgatttggaggatatgggaatgctgattcagccgcatacctccgccggacgtataccatcaaatgccggatttaggttttatgttgacaacttaatgcatagatatcaaatgacggctttggagataaaaaggcttagagccgctatgatgaataactttagggagcttgacaatattattaagggcgtgtcgtcagcattttcttccattacgagtttgccgacgtttgctatgcttcctatgaataaatacggcaatatcaaaaatgttaagctggccgacgttgacggcagaacgataatggttattgtttcagactcttcaggtcttattaaaaataagctgctgagactgaggaatactgttacgcctgaggaagttgcaaagctgaacagagttataaatgaaaatatatcaggtcttgatttagacggctttataagtcttgacaatgttatgggtataaaggacgctgttggagaaaacgttgaaatcctttcatctgtgctggagcttatatatgaggctcagagagaaattgagagcaaacaggtggttgttgaggggacgtctaatatcctgcggtatcctgaatataatgatgtggaaaaaattaaaaatatattggaattttttgatgacgaaaacgtgcttggcgaaattgtggacgcggttcagtttgaaggagacggcggcgtggatatatttatcggcgacgaacttccgcttccccagctgaaagagaacagcgttgttgtttcccagtaccaggtcggagaagatttggtaggcatagttggagttatcggtcctcagagaatggattatgctaaagttgtttcaggcataaagttcttctctgaaaatttaggtcagatgcttagcagcagattcagaccggacgatgatgaaaatttcgattataacggcggaaaagaggatggttaaaagtgaaatctaaagaagaaaatcagcaggaaactatggataataaagaaagcaaaatagagaaatgcatggaagaccaaaaacagcaggacgaatcggctgaagctccggttcaggagacagagaatcctgaaattaatgaagaagagactttggctcaaaagctggaagaagcaaaagacagatttttaagaaaagttgctgagtttgataatttcaagaagcgcaccgctaaagagaaaacagagaatttctctttaggaatctgtgaagctgttgaaaagcttctccccgtgctggataaccttgacagagcgattgcggctgccgagagcaatgatgacaaagaagctctgcttgagggaataaaaatggttagaaaacagttctgtgaagcgctctcaggtattggagtgagtgaaattgaggctgttgggaaagagtttgacccggataagcataacgcggttatgatggaggacagcgacttgccttccaacactgttattgaggaatttgctaagggttacgcttataacagggatgacaatgttaaagtgatacgtcattctatggttaaggtttcaaattagttattaatctagttaacaattttactaatcatataaaataaatttattggaggtaattataatgagcaagataataggtatagacttaggtacaacaaactcgtgtgttgcggttatggaaggcggagagccaacggttattccaaaccctgaaggagccagaacaacaccgtcagtcgttgcgttcacaaaggacggcgagcgtttggtaggtcaggttgctaaaagacaggcaatcacaaacccggataagacaatcagctcaatcaagcgtgatatgggtactgacagaaaagttgatatagacggaaagaaatatacacctcaggaaatttcggctatgattcttcaaaagttaaagagtgacgctgaggcatatttgggcgaaactgtaactcaggctgtaatcactgttccggcttacttcagcgattctcagagacaggcaacaaaagacgccggcaaaatcgcaggtctcgaagtaaaaagaattataaacgagcctactgccgcttcacttgcatacggtctagctaaagatgttgaccaaaaagttatggtatatgacttgggcggaggtactttcgatgtatctatacttgaaatcggcgacggcgtatttgaagttttggcaacaagcggaaacaaccgtttgggcggcgacgactttgacgataaagttatgaattatctcgctgatgagtttaaaaaggataacggtattgatttaagacaggataagatggcgcttcaaagacttaaagaagcggcagaaaaagcaaaaattgaactgtcaggcgttacatcaacaaatatcaatcttccgtttatcactgctgacgccagcggtcctaagcatcttgatatgacccttacaagagctaagtttgatgagcttacagctgaccttgttgagaagacaatgggtccggcaagagacgctatgaaagaagctgggttatcggctgaccaaatcgataaagtattgctggtaggcggttcttcaagaatcccggccgttcaggacgctgttaagaagctgacaaatcaggatcctcataagggtatcaaccctgacgagtgtgttgctataggcgctgctgttcaggccggagttttgacaggcgacgttgaagatttggtgcttttggacgtaacaccgctgtctttaggtattgagacaatgggcggcgtgttcacaaagctgatagatagaaacaccacaattcctacaaacaagagccaggtgttcagcacggctgctgacggacagaccagcgttgaggttcatgttctgcagggcgagcgtgagatggcggcttataataagactttgggaagattcagtctcacagatattccgccggcaccgcgcggagttcctcagatagaggtaagctttgatatagacgccaatggtattgttaacgttaaagctaaagatttgggcacaggtaaggagcaggcaataacaatcactgcaagcaccaacctttcggacgaggatattgacaaggctgttaaggaagcagagcagtatgcagagcaggataagaaagcaaaagaggaagttgacgttcgcaaccaggcagacagcatggtttatcagaccgaaaaaactttgggcgagcttggggataaagtgacagaggaagaaaagagcggtattcaggctgaagttgataagctgaaagaactgctcaaggctacgccgatggatgttgaagcagtaaagactcagacagaagaagtgtcaaagaagttctatgctgtaagcgagaagctttataaggctgctgcagagcaggcgcaggcagaacaggcagctgcgggtgcacaggacgcaggagctcagaacaatggcggagatgacaacgttgtagacgctgattatacagaatccgagtaatataaacaattgtgtcaggaaggaataaaagtatggcagataagagagattattatgaagtccttggcgtaaataaaggcgcatcggctgacgagataaaaaaggcatatagaaaattggcgaaaaagtatcatccggaccttaatccggatgataaggccggagccgaagctaaatttaaagaggccagcgaggcatatgaagttttgagcgaccctgataagaaatcgagatacgaccagttcggccatgcaggcgttgaccctaatgccgctgcaggatacggcggaggcggctttggaggattcggaggctttgaggattttgacctgggtgatattttcggaagcttcttcggcggaggggcgtctcgccgtaaccctaacgctccgcaaagaggcggagatatccatatgcacattgatttgacttttgaagaggcttgctttggaactaaaaaggaaataactatcagccatatggaacaatgtacatcctgtcacggaagcggagccgctgagggcagtcatcctgagagatgttctgcctgcggaggaacaggtcaggttaagtcagttcagagaacaccgtttggaagtatgcagacggttagaacttgtgaggcctgcggcggaaaaggaactataatcaccgacccgtgcagaacatgccgaggcgagggaatagtcagaagaagcaagaagataaacgttaatattccgggcggaattgataacgggcagagcctgagtgttcgcggcgagggcgacgcaggcaaaaacggcggaccgcccggagatgtgcttttgacagtcagggttaagccgcataagatttttgtccgccaaggcagtgacataatgtgcgattatccgatttcatttgtacaggcaacgctgggcggagaggtgaaagtgcctaccgttgacggaagcgttgtatacaatatccctgagggaactcagcccggaactgtgttcagactaaagggaaaaggcgctgttaagctgaactcaaataaccgtggcgaccagtatgttaaggtacaggttgagataccgaaaggaataaacgaaaagcaaaaggaaatattaagacagtttgacgacagcgttgacccgtccaaatataagaagcgaaaatcctttatggataagttaaaagatttgtttgaataaaatatcacagactgcaccgtatatagtgcagtctgttttcatacaaaataaaaaagatttaaaggtttctagtgaacgtcggcagggcagacaaagtctgccgcgttaggtgaactgccatctcacgcgaagcgtgaatatatttagaacagtttgtagtaaactttaccgcggctgcgcgcctaacgaggcaaactccgtttgtacatcacaactaagtttgattattgacactgtaggtttatcaatacaaatcactttgtattacacacacttttttaaagtgtggtcacagcccttcgatgcttgcaaaccacatttttatacaatcatattataaattgtcttaacatctggactttttaggtatttttggtgaacatcggcagggtgtgcttacgcacacctcgttaggtgaactgccatctcacgcgaagcgtgaacatacttaaaatggtatgtcataaatattttataatagtagactttaccgcggctgcgcgccttacgaggcaaatttcatttgccctgccgacgcttgccatacacatttttattatatatgaccttaacatctgttaaatctattgagacttttcaggtgttttggtgaacatcggcagggtgtgcctatgcacacctcgttaggtgagcacccatctcacgcgaagcgtgaatatgcttagaacagtataatctaaaaattaatatattaaaataataatttttataaaagataagtgacgcggttatttaaaatattaaagctatacaaatagtaaatgtattattttttgaggtcaatattgtaataaatgaattattgtagtataatgtaaaaaaagttttgaggagaaatttatggattggataaaagtcagcattattacaacaaataaaggaatagacccggttagctcagttttaaatgatttgggatatgacgggctggaaattgcggataaagacgatttcaaagaatttttggagaataaccgcaaatattgggattatgtggatgaggaactggagagacttaaagaagcggatacaaagataactgtatatctggacggcggcaatgatggtttgtcagagctggagaaaatagaaaaatctattaagttattaaaggaagccgatacaaataatagcttcggttctttaaaaattattactgaaaatgtaagagatgaggattggtctgaaaattggaagcaatattttaaacctctcgaaattggtgataaaatattgatacagccggagtggcagcctttggagtctgagacggacaggattgtttttaaggttaatccgggaatgacgtttgggacaggttctcatgacagtacaagattttgtatagaagagatagagaagaatatacacgagggcgacactgttttggacctgggctgcggaagcggaattctttcggttattgcattgctcctgggagcgtcagacgcttgtgcggttgatatagatgaaaattctgaaacagtagcatattcaaatcttgaaatgaatggacttgataagaacaattatcatgtttatatcggagatattattgaggacagcggtctacgggacaggtttgcagaatacgatattgttgttgccaatattgtagcggatgtgattatcgcactcagtccatatgttcgtagatttatgaagaaagacggaatttttatatgttcaggaattatcaatgaaagggcggaggaggtaaaatcagctcttgaaaaagccggtttgaagatagttgaagcaaagcagtcggatgaatggaccgcatatacctgtaagtgattgttttgaattttatttttacccaaaatgaaattaatttatattattgatgtaaatttaagattgtgccgaacgaaattgctgattatgatgtgtttcacacaagtgagccgcgttaggcgagcgctcgtttcacgcggggcgtgaatatacttagaacaatttgtaataattctttttaattataaacttttccgggactgcgcgccttacgaggcaaacaaagtttgccctccgatgcttgctgtatcacattttttcatatgaacttaacttttttgtccagtttttcgtagcctatccacagacattaaaggttttaggataaagagttatatagttcattttcattttcttaaaaaattttgttacatctcctgaaatttgaaaaactctaaaaatttattaagtaaaagttataaattaacgaaatctttaacttttcataataatttatttttaagcttttataaaaattttttctatttttatatatagtttaaacagtatcattgagaatctaaagaaatataaataacaaaataaaaggtggtaatagtgagcgtcggtaggccgcatttatgcggcgcgtaaggtgagcagcgcggacagaatataaaactaaaagttatactaatatattatccaacgcctactcacataacaatgtggtttgcggtcatatagcatattcaaattatttcgcatatacagattattaacattcgccgagagcacgatgtactctcggcgtttatattattggttaatatattgggtcctcatttcttctttaaaaaatagatttacaaaatccactgtactgtcgctgagtttttcttcattgataacttctctggcagtaagcgggtcgtcggtgagtatattgtctatgtcatatttgcagatattaataatattcgatggctcattgactgtccaaacaaacacttttttattattctggtgaatctgatctactatatcataatctataaatgtttcctcaatactgaacccatcaataaaagtcatttcagaaatattccctgcggccacagtcatgtcgtacagggtttttatattagggtcaatctctttgacctttttcagcgcttctatatcaagagaagcaagcatgcagtcgttttcaaatccgtttgcctttacaatgtcaatgacattcttttcgaaatcggtttcatgacctgttggctttatttctatattaagttttattttacctttgcataattttattacttcatcaagagtcggtagtctcaggtatgagtattcgtctgaaaaccacgaaccgacatcatatgtttcaagttcagcgtatgtcatttcccaaatatttttatctacgcctgatattctttttatattagcgtcatgggaaatcacaacaatattatctgcagtttggtgaacgtcaagctctatccagtcggccccttgttcgatcgccgccgcatatgccggaatactgttttccggataatccacagaactgccgcggtgggccgatatttcaggctcgttattaatattaaaagcaaagtcgtcaggagcgcctgcagctgtcagaatagtaaatcctataaaaataacagatactattcctaaacatacatagttgagaagtatgtgcttttttccttttggaggaatatatttgggaatcggttcctgttttttgtttttcagcttatagtatatgacgctgagagaagcataggaaatagtcaaacttaaagtttgcactgcaatacttatcatatctgcggcacggacggctttcagcgaatatagatattgcatatcgggttcgcagaagaattttataataagtattgagctaactgaaaatacggtttttataataaagcctataaaaaatataagcacaaccggtgcaactctgcccaataatacaataaaaaagttctttttggtcagcgccagactttttttgcttgctgatacaaaatttttcgattcaaagcagaagcatgtatagttcagagagaagcgaatagataatatgaacaatatagtatataagcaaaacattagtatagataaaatgttgctttcatatatgtaatcctgaataaattcagggattgcgtccactccggtgaatcctgaaatagcagtggtgaaaagcagggtatataaaaatatcaatataactccgcttttgaacggcttaaaagtacattttccggctagtttaaacatttgcacaattgaaatatccttctgattataagaagcatgaacataccaggttacagacataattttaaatattaccatcaggcagctcactaataaaaccgcaagccatataaaaattgtggcgggtcttgaaagatagtaaataatcttatcgtttgaaagatacgtgagtccggaaagcgacatcgttttatcaatagaaaagctgagtatcggatagataagaaaaactgttataaccgaataaataatttcaaatgccaatagagtgctcaaatttcttgacagcagctttagacaaagcctgcaatagttaaataattttttcattttgtatctccatatagttttggctgtttatttgaaaatattatatcgtattttattttaaaaatcaacttttacgtctaaattaatatattttgtgctgcaaataggttatattgattttactgtatatttaccgtagacaaataaataaaattacaaaatagccttttataaacagaacatatattttaatgtatattttattggaagataaagcagaataatccattataagctaataaaattttgttgtgtataatggagtgtgtttttgatgactatggatttgctaagagttgcggcagcctcggtaggttctattattgcattgtttgttttgacaaagctgctgggttataaacaaatgtctcagctttctatgtttgactacatcaatggcattagtataggttctatcgccgccgaaatggcaacaacggttgacggtagttttatgaagccgcttcttgctatgactatatacgcggttttagtatattttattgatttgctggctgttaaatctctgaagtttagaagattctttggcggcaggtctttggttttatttgaaaacggaaaactatataaagaaaatttgagaaaagcaaagatagacgtatgcgaatttttgactgagtgcaggctcttgggttactttgatataaacgatatatctatggcgatgatggagaacaacggaaaaatatctgtccttccgaccaccggcgcgcggcccgttaatgtggaggatatggataagaacatgcagggagttaatcctaaaaaaccgtcaagggcaagtataaatgttattttagacgggattattctttatgataatctaaaatacacaggtaataatgacatatggctgaaaaatgagcttggaaagcagggtatatcagacgtaaaaaaggtgtttttagcaacggttgatgaaaacaacaaactgtcagtatttaaggaactgagcgaatcgcccgataatgatttgtttcaatagggcttataaactattttattacagcatatataaaatgactcctgcttttgttggagtcatttttaatttagaagataaggccggtttcataaaacatacagcaatataatattaatttagtattgctataccgctactaatataatgttgaaaataatgtaacttaaaacatataagagcaggataatacaaatggaaagttaacagaaacttgccaaaaaatggtgtctatagcgaacatcggaagggtgtgcgtagcacaccgcgttaggtgagcatacatctcacgcaaagcgtgaacgtatttaaaacagtttgttatatcttatttagaaataaacttaaccgcggctgcgcgccttacgaggcagatttcatctgccctaccgaagcttgcaaacccatatttttatatattatctttatatttctgttagttttattataacctttacatattgtaagtggaagtcaacagaaacttgccccaaaatagtgtttttagtgaacatcggcagggtgtgcgtagcacaccgcgttaggtgaacatacatctcacgcaaagcgtgaacgtatttaaaacagtttgttataattatatttaataattaacttaaccgcggctgcgcgccttgcgaggcagatttcatcttcattgagtattcatgttattatttgcgtattcatattattctttgagtattcatgttattatttgcgtattcatattattgacattgaaggttaatcaaaacaagttattttgtatcacccccaccatgctggtggggtcacagacattgaaggttaaacaaaaaaagtttctatggctcacccccaccatacaggtggggtcacagactttgttggatgtaaagaaatgagtatgtatagcacacactttttaaaaaagtgtggtcacagccatatcgatgcttgcaaaatcatatttctattatatttgatctttaaacttctgataattttattaaaataaaaagtcgtcttattttatttattgtgatattgcttgtgaatatataaaagtttgacccaatatgtataatgttctgattttatgatttgctaaaccgattgacttttggtcagttatacagtataatattagtaagtttataagaattaaaattgatttgttcttttttgatttgtatttattttgtgttttgtaatctatcacttcttatgcgtcaataatattcgtcacaaataaatatttgtcaaagcaatcaagacgttttctttcagcaagattttattttatggaggtaagtaaatgaaaattaaaaaaacaattgctgccgctttaactgttgttatgctgtcaacagctgcttcaggggtatttgcttcaggggcaaatgaaaatatttccgggggaattaacggcggcgcagaggaaacccagagttatttaggggataatgaaagcgagttattggttagcccgtccccgggtatttttgacgataatgaggaaggcgcagaagacgttcagcctaccctttatcccagcggaatacaaacggcggagcctgatattaatattgaatcttccagtccggagccatatcctgagacaactgacgttccgtctgaggagccggcaaacgatgtgatgatttcatcgtaccaggttaatttcagctgccggcttgacggatggccgcgaaaggattatgctgtatttaatatatgttcggaagatggaaaaatccttgattcacacacaaagtatattactgatacggagagtttttcaatagattttaatataccggattctaaagtgggaactgtcttttatttggaggtaacaggcgttgattcaatagattattattcggataattatccggtgccgcttactgaaaagattccgctgtatacatattggtcggagccggatgaaaacggagacagggttccggtgagctcggcgcatatgaccgcacacgtcagaacacagtgtcctattaatatatacgctgacggagaatatgtctctctgtcttcgcctgctatatttgacggctcgtatataatagcaccgctgtcagagattgccggggcaataggcatatccgactgtacttacttccctgaatataatagcgtaaaggttaagaccggcgataacgaaatgcttgtcaatattggatattcgtatctgacagcgtttggcagcgatataaatctagaccttccggtttccaatattaacagcctgacatatatagaattaagaccgtttatagaggccttcggaagcactcttgaatattacgacaatggttcttatattgatataaaacttactaaatcccccatggctgtaagctctatagctgagcaggaggcaagaataaacgagagcggagttggaagctcgaccgattatcttatctgggtaaacaaagaaaagtttagatgcaccgtattctcaggttctaaaggcaattggaaatgggtaaaagattttactgtcggaataggagctgagggaagagaaacaataacgggcgtgtttgaatatattgactatacgaatatgtggccttatgattcgtattatgttggcccggttatggtattctacggcaattatgcactgcattcaacgtttttgaaatatgacggaaccccatatgataacactgttggggcgaagatttctcatggctgtgtgcgctgccaggcaaaatatataaactggatggtagataatatacctatgaagacccgtgtatatgtaactgaatcttaaaatattataatgagccggctgcaattttgcagccggcttttaatatccctgtaattctaaatataattcaaataaatgatatattgtggtttggtggttctgaattaagaatatactacctaaatttagcaaatcaatgttacattaagtcgtgtatttgttacttatttttgttatatcgttgattatacgtataaaagtaaaattattcctattttttcacttattattgttgacaagtgaaatgctttttgatacacttatttaggaaatatttttcagtgggagataattatggaagatttatacgaaaatgtcgaagattgtagaatattaattaacaacagtcagcttgatgatgaagttattaaactatgcgataagataaatacgaagattgatgaaaagtatggcagcgtggcgcggttctccagaacggttaacgtaccctattcaactttaaactgtattcttaaaaacggtttgtcaaacagtaagttttctatggttttagatatatgcaggcggcttagagttgatatatttgatatagaaaaatatggaattaaagctgcggatatatccataatatcaaaaatttcgtcgcttgatgagcgcggaatcggcgttatttcgggcattatagaggaggaatataaacgatgtataaaaattataaccaatagttgacaaataaatgtaattatgttagaatgaaataaaggaggtgttttaatggatgaactaactctgctgattaagcaagaaatcaaaaaacaatttcgcagtgtacgccaatttgcgttcagtgtaggaatcgcacagacaactgttgtcagcgctctgaagaacggtgtttccggcacaggatttagtacagtgatgaaaatttgtaaagctttagacattcaagtatttgattactctatcccgctcgtgatcaatgataacgtagtcacattacttaaaaagtataatgctcttgacaaattagctgaacatacagttcagactgtactcaacgtagagtatgaaagatgtaaagcagacgcaatgaagagctcaaagcgttagttttacaaagtttgtttagttgtggaatcttcgtctgtaaaagcacaggcaaatcataatatgtctttcagattgtggcatattaaatacaatgatatttacaatcttgactcatatatcatagccttgcagttgtttttactgcagggtctatggtatattttattttagtttattaagttaatatcaggaatcgtatccggataactgactgtagttctggattcaattttttcagggcagttttgggtcttaaagctgacattaatatttttaatttttaaattatctttatcaagcgtcagtgttcggttaattgttatttcatcttcgttgatattaaatgttcttttataatatgaagcatattggtctgatttatttaggcgctcagtaaatataaccgtatattcactgtcatcttgtgagaccgaggaaatctccaggtcttttataccgtttaattcaagtatatcgttgtaatcagataaatagttttgatactcatcataagttatatcagtttggttttcctgaatccctaagtggattccgctttcatcagcaggatccaaaaccgtatagtaatattccggggataatacgaaccaggttccgctgtttaggtccgcaccgtatatccatatatcgccgtctttgttttcagcgcagataattgactgggcagatttagtctctccattctcaatataatactgcgcagtagaaatttgagttatctccccgggcggtgtaagattttgtattgtattcacgtttaaaatatcttctgcagttagattatcacttgtagttatgtcgtttttttgatttgctgatgtacatcctgagaaaataataataattaaagaaataattattattattttagttgtagaaattttattcataattgtcacccgaatatttattagattacaaatacagttaaaactgagttgtttgccgccataaatgcgtccggtattttcttaaactatgtataccaactgtattatgaggaacatcatttattgaatataatcctgcgacggcgttgacggcaagtatattataaatgataaacttatgtgacatgagtttattatattgataatttatttatgagaaataattatttgaaatttataaaggcagctttttagtatgattgtaatcttacagtttgctgaattataaataaaacattattatagtttattttgatatagaatatgtgctctatattagtttgctttccaaatagatttgaaatgtaaaatatatagagcacatatttttgtgtacgtattaaatttattttgccgctttggcaacagcttcagcaactgcagggcttacgcgcgggtcgaaggctttagggattatatagtcctcgcttagttcctcgtcagaaataagtccggcgatagccttgcaggcagcaatcttcatctcctcggttatgctgcttgccatagcgtctaaggctcctctgaaaatccccgggaaagcgataacattgtttatctgattaggaaaatcagaacggcctgtgccaacaacgcgagcgccggcctctttggcaaggtcaggcattatctccggcgtagggtttgccatagcgaacacaattgcgtcgtccgccatagactcaaccatttcttttgttacaatgttcggtgcggacactccgataaatacgtctgcgtcctgcataacatcagccaagctgcctgtctttccgtcacggtttgttattttagacattttttcctgctctgaattcagtccgttcatgttctcgcatatagcgccgattttatcaaccaaaataatattttcagcacccatattcatcagcattctgcagattgctattccggcgcttccggctccgttaatgacaatctgagcgtcttcaatttttttgttaacaactctgagcgcgttaatgattccggctgacactactattgctgtgccgtgctggtcgtcatgaaaaaccggaatatcaagctcctcctgaagccgtctttcaatttcaaaacagcgcggcgctgaaatatcctctaaatttattccgccgaaggtaggagcaatattttttacggtttcaactatttcatcaacgtcattggtatcaaggcaaatcggaaaagcgtcaacgccggcaaagtttttaaacagcacgcacttgccttccataaccggcatacccgcctcagggcctatgtttcccagtccgagaacggcgcttccgtcggttacaacagcgacaagattgccttttcttgtgtagtcgtatacctttcttatgtcctttgcgatttcacggcacggttccgcaactcccggcgtatatgcggtggaaagctcgtctttgttattagtttcggcgcgggcggtaacttctattttccctttcaaacgtttgtgcaattcaattgcggctttgttgtaatccattttatcatctctccttgttcttatcatataatattttaagaccgtccaaggtgagcagactgtcaaccttgtcaatctcgtctgactctttagatatcattgtggcgagtccgcctgttgcaacaacagtggcgtcctctccgatttctttttttatacggcgtataatcccgtcagcttgtcctgcctgtccgtacacagcgccgctctgtatagcgtcgattgtgtttcttccgataaccgaagacggttttataatctctaccttaggaagcttagcggttttttcaaaaagcgcgtccattgagatttttattccggcggctataacgccgcctacatagtttccgttcctgtccaccgcgcagaatgtggtggcggttccaaagtcaactataacaagcggcggtttatacttgtgtattgcggcaacggcgttgactattctgtctgcgcccagctcgcggggattgtccattctgatattcattccggtttttatcccgggtccgacaaccataggcgtgcagtccagataacgtttaacaccgtttgtaagcgagtgcataacagtggggacaacagacgctatcataacgtcgtctatctcatctggttttaccccttcattcaacagaaattgtgttataagcataccgtattcatcgctggctttgtttttatctgtggccatgcgccagtgacggcgcagattatcgttttcatagagtgcggcaacaatgtttgtgttgccaacgtcaattgtaagcagcatattatcttcctatctgattcaattttttaatactttttatcttttattaagaataaattataataaaatatttatagtttcttgatttcagcgtttacaccgctgtcggttatattgagaaccgcataagagtatctggcacagcccggattaagcataagaatcccgtccgtttctctgataagagcgctgtgggtatgtccgaaaatacatatgtcggctttaacgtcgtgagctttctgtcttaatgtatacattccgctttttacattatagcggtgaccgtgggtcagaaaaatacgtttgccggaaaactcaaacagtctgtcataaggaacgtcgttaacgtaccaatcgttgttgccgagaacatactcaaatggaatatcagggtatgcggcggcaatgtcgtccgcgtcacgctgaatatctccggcaaaaattattaatgaaatatctttttcactttcaacagcattcattatgctttgaaaactgccgtgagaatcgcttaacactaaagctttcattaataagcctccgtttcagtaataataaaatattatagcacataaatatttttttgtcactatttttataaaaatacatacaatgtaatgtgaaaggagttgtatctaatatggacataaatgatttaacaaagggtgttaatcagaataatctcaataatactcttaaacagttcggaaacgtaatgtcgaaagatcagatgaaccaggtggtaaacactataaaaaacacaaatcaggagcagctgaaacaacagctcagcaagatagacccgaaagagattaataaggttctctcaagcaatccggggcttcaaagggcaataggctccaatcctgacgtgatgaagaagttgaacgctatattttcaaagaacgggaagtagttttaagtatattcaaaacttactctgaaaggtggcgattatatgaatgaagagcagaatatggattttgactttggttcggctatagaaaaaattcaagagatgatgggaacggacgacggacagtcaaagcttaataatataatcaacgcctttgtgggttctgatgaagataatgcgaacagtcaggaacaagacagcccgtttcctgatatggatcagatggatatgatgataaaactcggaaatgttatgtctgcgatgaagaccacaggcaacagcaaaaatgcggctctgctttacgctttaaagccgtacctgcgtgaatcaagacaggaaaagacggacagcgcggtaaagataatggttatggtaaaggcctttgctctgctcaaagacagcgaccttaatctgaacttttaggaggcggagctatgtacaaacgttatcaatccccgccaggaagcaaaccggcgggtaatccgagacctcagaaccatccccggagcagtcatcaggatatgggcggagaccgttttcagaacagctataatgatatgggtgataaccattttcagagcagtcatcaggacatgggagggaaccattttcagggcggtcatcaggacatgggaagaaaccattcccaaagcggtcatcaggatacaggaagaaattattctcagagcagccgccggaatatgggaagcggtcattccaatgcaggttccgggaatcgacaaaatcagagggcaaatcagaattatgacacacctcggcataattcgaacgataactttgagtatgacggacatagggatgatatgaactggaatcgggcggcggactataaccataggaatgagcctcggggagcgccaaacccgccggccggcggactgggaggacttttgagcggtcttttcggcggaggaaagtcaggcggaagaagagaagagccgaacatagtaaaatcaattttaagttttattcccccgggaatatataataccgaaacaaaaaaaattcttggcatattaacagcggaggatcttctgcttgccgctctcatactaatgattgcagacagtgacgaaaacgatgacctggcgctgcttatagctttggtatacatatttatggcataaaaaatagtgactattatcaaaataggataataaaaagtaattaaattgttatataacgccgttgacaataaattcgtttaataatataattaaaatagttaaataggcgtgttgtgtttttaggaatttattaaataatataagtgaaaatatagtttcagtattattttggaggttttatactaatgaaaaaggttttggggtgtgttttgctggcggcaatcctggtgatttgtctcggtatgagaggagttgttccggttgatgtcgaccaaaaggctgacgatactaaggtgacaatgtatgcggaagacggcaggagcgaacagtttgacccgtctgaggctgaagctcagaagagcgttggctggtatgataattttaatgacgtaataaccaccatgtggaaagatgacggaagcagtatagtagtgtttaaagctgatgtgtctaagtacgaaaaagacggatatactacaaatcatgattctatcttttcaaaggtttttaatccggctacagaggaagaaaaggacgttttgaaaagtgaagtgcagacatacattgataacggctggaagcgcggcaacggaaaagttgaccctgataagccaatggtgtgtctgacatttgatgacggaccgaatccggctaccactacaaaacttctgaaagctcttgaagaaaataacgcgagagcaacgttcttcatgctgggcaacctggttaaaaacgtcaagggcggaagcgatacaataaataaaatgaaggatatcggctgtgagctgggaagtcatacctatgaccatacacagcttactaaacttggaactgacgctttaaagaagcaggttcaggatacaaacgacaatattaacgacattgcaggtcaaggcgcaactgttcttcgtccgccgtacggctcatataatgataatgtcaaatcagtttgtcagagtttagaccagcctataatattgtggtctattgatactttggattggaagaccaaaaatgccgacacttcatttagaaatgttatggatcaggtgaaagacggagatataattttgttccatgatatttatgagccttctgttgaagctgctatcagacttataccggcactgcaggacgcaggataccagctggtaacagtatctgagatgggcgaagcgaagattggcggactaaaacccggagaggtttacaccgatttttgggacagcactgttaagaagctgacaaacagcagctcaagcagtgagaagagttccggtagctcggacagcgaaaagagttccggaagttcaaataatgataagaagtcaaacagttcaaacagtgacaagggaacaagttcttcaaaaagttctgattaatatatcttaaacgtaaaagtttatttcagactataatatgcaatgaatgagttttaaataccgcacaattacgtgcggtattttttgttaagcactgacaggggaagtaagtatattttgaattgaacttttgaaatttttattatagaatgaaaaaatttttagcgtatttattttagtattggaagataatttgaaatgtttttgccacgagttgatataaatgtatgagatttctattatgaagaggtaaactgtgtataatttttttagtaacatatttagaacaattctgcagtattaattgacagacaataaaaatataaataagaaatgcacataaataaggacttatctatatccggtatattatgtgcagcatttttaacattgaatgttcttagtttgattaattttttatttatatctcattgataattatcgaatatttttatgctaaaaaataaaaattaattattaaaaaacatatgacgcgttatgtcatttaatatgataatatagtcgtaacggaaaccggcttatttcctatttggagataaatatgagattggtctatgctgctgttgcatagataatgttatgaagaaacaccagacagattatagaataaatataaagtttaataaaaatagttaatatagttggtaagatagtaatcaagatagtaactaaggcagtagaccattatataaacaaaaccaaacaatactaaactaaactatacaaaacaaaacaaaactatttataaattatataattattttactttatattttcttttaaaatatgaagtgcacagaacaaatacataaaatagtagaataaaaaacttaatgatgaggatatagaataggtaattaatcttgcagaaagttataaatataataataaaagatattaacaaattcgtggctgcgcacctcgcaaggcgcataaatgcgtttgcgtattcaaattattatttgcgtattcatattattgtaggtaaatgaaaacaagttattttgaatcacacccaccatgctggtggggtcacagaccttgtaggtaaatgaaaacaagttattttgaatcacacccaccatactggtggggtcacagacattgaaggtttatcaaaacaagtatttaaggctcatacgcaccttttaggtgcggtcacatacattatggatttggtaaaacattttgttttgtatcacacctaccgatgtttgccaaaagaatagtttttataagatgaaattaataggaactcgaaaagcctgtattcacggttaaaaaattgtttgtcaaataataaggctcgatatgctgtgaaaaaggaataaaattctgaacaaaaagctgaatcacattaaagtgtaatgagtaaaataaaacatcagctttaacttaaaagtattcataggtttttattacatagaattgcataaacaaataattatgtatatttatggattatatactataagaaaacaaatttgtgttgactttctgatgtaagatatttataatttaattatgaaacagcgcacaatgtttttcgtgaaacattattgttctgtgcgaaaaataggatatggcgtcgtatgaaaaaattaattgggggtattcttatgagaaatgtaaacgatcaggataatagaccgtccggcggcggcaacggttttaacaccggccctgtaaatcaaaatccgccaaactatcacggcggacaggaaagggttggcggcaatgccaatattggcggaagcgttccgggatcgggagacggaaggtatacacctccgaatcagtttaacggatacaatcaatatgggggatataataacaatggatacggcggtcctccgaagaaaagcaatacgggtcttattgtggcaatttctattttatcaggtgtaattttgataagtattgcggttatgtgtcttatatttacaggggttttatcacccggcagacaggcggcaaatcaggcggtttccgttgtcgctactgaagctccaacaataagtccggctacagcggctccggctgctcaggcgcccgcagcgcctccggttcagaatgtaccgttccttcaactgaacttgcccatctctttgttgaaccctggtcaaacttcttttcctcttctgtatataccggcatacaacaaaagatactccgccgctcaaataaactgagcggcggaataaaaatttattcagttgttattattgcagtattagtagcttcgtcccactctacattatatcctaagttttcagataagaatctaagcggaaccattgttttgtcatttacaagtcttgccggtacatccattgtaattaatatcttcaaaacagtattttttggttaacatcggtagggtgtgcgtaagcacaccgcgttaggtgagcaaccatctcacacgaagcgtgaatatactaataacatttgacataatccttttataaaatctattccgagactgcgcgcctaacgaggcaaactacgtttgcacatcacaactaagtttgattgttgacattgtaggtttattaatacaaagtgatttgtatcacacacactttaaaaaagtgtggtcaattgacaagaagggtaagaatatgataagataataaagctttcggctgaggcaagaaaagctgaaagatagaatactgtgagagtaaaaaaggaaccggagaagacaaaaaggccggttaaaacttagagagataaaagaacagaaaaaaataaaaaagttcaaaaaaagtcttgacaagtaaaaacaaacatggtatactaataaagttgctgcggtgcagcgatgaagttttctgacaaagagatttgtttgagagctaagcatttatattaaataattaattctaattagttcctaaattacagatggttttatttttacaaatatatactcatataaaaaatattttctgcaagcttcggcagggcagatgtaatctgcctcgttaggcgcgcagccacaaattttatttatattaaataattaattcaatttagacctttaaatatatattaacgccatcaataacatcacttgctatttataattttaaataaaacaatattattttctcatatcagaaagtaaatttataaaataagataaatatggcaatattaaatattaaaagaaattaaaatattttaaatgtatcaaaagcccccctcagcgtcagcatcatccaaaccataatgcaatccaacatagcagatataataaataataaaatactccaaccatatacagtatgtgtttaaaatattaacaaatatattactcatgacataatcaggccatttagcctttgctaatcagcaaaaataaatataacacaaatatataatatcctgaaaggagcaaaaagaatgaaagaatatttacagattgaaaaagttataggaagagaaatccttgactcacgcggcaatcctactgttgaagctgaggttcatcttgccgacggcactatcggtcgcggaacagcgccgagcggcgcgtccaccggcgagtttgaagcgttagaacttcgtgatgacgataaagacaggtaccttggcaaaggcgttacaaaagctattaaaaacattaatacgataataaatgaaaccatatcaggaatggacgcttcagatatttacgcaatagacaaagccatgatagccgcagacggcacaaaagacaaatcaaaacttggcgccaatgcaatcctagccgtatcaatagcggcatccagagcggcgtcaatttcacttgatatacctctttacaaattttggggcggaatttccggcaatgttctgcctgtaccgatgatgaatattttaaacggcggagcacatgccgctaatactgttgatgttcaggaatttatgataatgcctgtaggagcaaaaagttttaaagaagccctgcgctggtgtgctgaagtatttcatgcccttgcgtcattgctcaaatcaaaaggcctaaccacatcagtgggtgatgagggtggatttgctcctaacctcgccagcgatgaggaagctattcagtatattctcgaagcagttaaagctgccggttatgaacctgaaaaagattttatgattgcgatggacgcggctacaagcgaatggaaaggttcaaaacccggagaatatattcttccgaaagcaggaacaaaatttacttctgaagaattaatagcacactggaaaaaacttgtggaaaaatatcctattatttcaattgaagacgctcttgacgaggaagattgggaaggctggcagaagctgacgcaagaactcgggaacaaggttcagttagtaggagacgacctttttgttaccaacacagagcgtctaaaaaagggaatcgaccttgcatgcggaaactcaatccttattaagctcaaccaaataggttcagtatcagaaactctggaagcaataaaaatggcccacaaatccggatacactgctatttcatcacatagatcaggcgagacagaagacacaacaattgcagatttggcggttgcccttaacacatgccaaatcaaaactggcgcgcccagccgttctgaaagagtcgcaaaatataaccagctgattcgtattgaggaggaactcggtgattccgccgtatatccgggactttcagcgtttaatataaaaaataagtaaaattatctgcccgcctagtacgggcaaatatacatataaaacattcagtaaataacaaaaaggataaaaggtatgagtattgtattaactggaggaaacgaccgtatggcaaccagatacaaagatatttgcaaatcatacaaatataaggctaaagtttttacgcagatgccgccctacttcgaaaataaggtaataaaacaggatttaatagtagtatttatcagtacatattcgcataaaatgattaacactgttaatcaaaaatctgcgaaacatacttcccgttcgttaaatctccgagtcctgttgtgacagctctaaaatcaattcttcagtaatactcgcgtaattatattttttcggccaatagttagcggaaactaactgccggccgaaactgtaatcctaaactatttatcttttatacttttacttgtagaatttgatttatttcatatatgttatagaacatcactagaaaataaattgaagaaatatatcgtattatatataaaataatataaataaatttttatatttcaaatttcaataactatatatttaaaccaaaatattttacctgaagataaagtttatcaaattacagtccatcataataaaaataatgtattatttttattatgatccaaacgactgatgacaaaaaattttggtctatgaagcagaaaataattacgctgaagttaaaaatttaagagcccaacttttcatttgagagagaaaatatttaccctttaatttataattattccattttttattaaaacactataattttcatcatgttatataatttccaaatactatttgacatatagtaaattaaatgataaaatatattaaaaatatataaggatgatgaatatgaaaaagtttatgttattatttctatcaattttatctatatcttttatattgtcatttccagtttgcgctgaaagctatgaagatttgacatatgaaagaaatggttatggaattacgattaccggctgcaacaaagacgctgcagatatagttattccatccgagattaatggatcgcctgttacaactataggtatggaggctttttacggcacgcacaatcttaacagtattattatacctgaaggcgtaactaagcttgactttaaagcttttgaaaactcagatgtaaaaaatgttaccttgccaagcacacttaagataataggaggtcaggcttttaattgttgttttgaccttacagaaataaatttaccatatggcttggaagttataggcggtcacgcttttgcaaactgtcaatcactaaaatatattgatattccggacagtgtatattttttaggtgaatatgcgtttagatattgtgaatcagcaacagagcttaaaatttccaacagtcttactgaacttaataactcttttcaaatctgttctagtctgagcagcataacaatacctgaaagcgttacatccataaaaggtgcatttttatgttgcctcggtcttactgaaattgttattcctgaaaatgtaactattcttgatgaatatgcatttgaaagctgctccaatctagcttccgtaaatatcccaagcggaataaccaaaataggtagagattgtttttcagggtgcaagaatctcaaggaaatcaatataccgcttaatgtgaatactattgataaaggagctttttccggctgttcatctttaacaaatctgtatattccaccttcaatcacatccattggtgattcggcgttttcatcctgtaccggtcttgagtctgttttggttcctgattcggtaacaactttaggaaaaaatgtattcagtggatgcacaggaattaaatctgcttcattgccaaattggttaacggaattggatggaacattcagcggatgcacatcgctaactgattttataatacctgagactgtaaccatcataggagggtttgcctttcataattgtgcgtctttggaaaatattataatacccaaaggagtaactgaaattgattcatatgcattttcaggatgttcttcactaaaacatatagatataccaaataatatagttaaaattgaagataacgcattttcaaactgctgcacactaaaagactttgttgtcccaaacgggattacagaaataaaatcatatacttttgaaaattgttcagaactagaaagcatatcattgccgaacagtttgatatcaataggaaataatgcttttaactgctgttcttccttaaaaagtattgaaataccggatactgtatctaatattgatgggtatgttttcaacggatgcacagcacttgaaaatattaatttacctccaaatataaaaaaaataagcggcaacatgttttctgaatgcagcagtcttaaaaatattataataaatgataatataattgaaattgaaaactgcgcatttagcaactgcactaatttagaatcaatccaattgcctgatagtttaacttcaatctcatatagtgctttcagcggttgcagttcccttataaaaattacaattccagataatataaaagaaattaggagtgacgcatttagcgactgtgttagtcttgtggaagtcaacttgccgcaaagtcttgaaaaaatcggttcatatatgtttgaaaattgcagttctcttataaaaattacaattccaaataatgtaaaagaacttgagaatggcatatttagcgactgtagcagccttgaggaagttaacttgcctcagggtcttaaagaaatcagctcatatatgtttgaaaattgcagctcccttactgaaatcattattcctaaagacgtagaatcaatatggtatcaagtatttaaaaattgtacttctctgaaaagtgttactttaaatgatggattaatgtatatatatgatgaagcattcggaaactgctcaagtttatcagatattgaacttcctgaaagtattcagaaagtatcaagcacaatttttttgaactgtgacagaataggaaatatgtatgaccattttgctgctttaaataatattaaaagaaaaatggtattaacaattgacaaaggtacggcaaaagttggaaatatagacataagtctaggttcggcgccgcagatagtaaacaacagaaccatgttacctgcacggcctgttgcagattttatcggcgctaaaactgattggagcgaactggatgagactgttacaattcactctaataacaataacataaaattaaaactcggctctaatattgcatatgtcaacaataaagctcaaacacttgattcaccgccatacctatataaagaccgcacatttgttccattgagatttcttgttgaaaacttggacgcaaaaatcacttgggacgaggaaagtcaaactgtgacaattgaatagtatttctgacctcgaaactttctgtattcgaggtcagattattttataaaatattgtataatgaactatattataaatatactcgcttcacaaaacatatataaaaaattaatataaaacgcgctgtgattatctcacagcgcgcaaaattaatgttgagttaattttaatatctaatcaattagattatttcatcattgaagcaacttcttcagcgaagttatcctgcttcttttccattccttcacccttttcaaaacgagcgaattttgcaatcttaatttctgttccaagtgtatttgcaacaccatcaacatacttctgaacactcatatcagggtccttaacatatgcctggtctacaagacaaacttccttgtaatatttctttatacggcctgcaaccatcttatcaacaattgcttcaggctttccttcattcaaagcctgctgtttcagaatttctgcttccttctcaactacctcagtcggaacagtttcctctgttaaatattcaggagcagcggcagctatctgcatagccacattcttagccatctcaacaaattcaggtgtttcagcctttgaagcgtctgctacttcaaaattaacaagaacgccgattcttccgccggcatgaacatatgactggttaactcccttatatgtctcaaaacgacgaatattcatattctcgccgatagtagcaatcttttcggtcaaagcgtcgccaactgtctggcttccgccgtcgattgtcaaagtcttaagctcttcaacatcagcaggagcgttattagcaattgtcttagctatatcttcaacaaacttctggaaatcagcattctttgcaacaaagtcagtttcagagttaacctcaacaacaacgcctgtgtctccataaacaaacgaaccaaccataccttctgcagcgattctgcctgcctttttggcagccttcgaaagacctttttctcttaaatattcaatagccttttcctgatcgccgtctgtttcagtaagagctttcttgcagtccatcattccgcagcctgtcatctctcttaatgtttttacatcttgtgctgtaaatgccatttttattcttcctttcgtaaaaaacttcttattatattattcgtcaagaacgtctagagtaacctcttcgttctgagtttcctccatctgctcgccctgcttgccttcaaggatagcgtttccgattgtagaaacaataagcttaacggcacggatagcatcgtcattgccggggataggataatcagcttcttcagggtcacagttagtatcaacaatagcgattaccgggataccaagtttgtgagcttcagctatagcattcttttcttttcttgggtcaacaacaaacatagctgacggtaagtcatgcatgtttttgataccgccgaggaacttttcaagtctttctttctcaagattcaacttgataacttccttcttaggaagaagttccatagttccgtcctcagccatcttgtcaagctggaacaatctgctgattctctttttaatagtcttaaagtttgtgagcataccgccgagccatcttgcatttacatagtacatgcctgttctctcagcttcctctttgattgcttcctgagcctgcttctttgttccaacaaaaagaacacttccgccctcggcagcaacatcacgggtaaagtaatatgcttcctcaatcatcttaactgtcttctgaagatcaatgatataaataccatttctctcagtgaaaatgtactcggccattttagggttccaacggcgagtttgatgtccaaaatgaacacctgcttccaataactgcttcatttgtactactcccatattttacacctccataaagttatacctccgccttgctcagctttcataagaaccggaatgggaataccggcacatcaaatgaaatcacaaagcgtgtgtattttatataatttggacaaacttagcccaaacaccgaaatagtatatcataaccaaattataaatgcaagacttttttctatattttttcaaaaatttatatatgtaaattgcaatatcaaatagacatttataaaaaccagtaaacacctcattagatatatgataattgataattgataatttttccgacagctcattaaacaagtatcatctttattgtttctataaaactataaaaaaggccgaaatcattacacagaaatgttaatgttatttaatataaaaatgaatataaaaaatgttcttttgctagcttcagcaggactttgtctacacctgtaagataggtgcacaccttcaaataatcattaaaacaacatataaaaaatatttctaaataaattataaaaagtgtggttttgtaagcttcggtaggacgtacgaagtacgtcgcgtaaggcgcgcagtcgtggaacagtttattataaaacggattatgacaaactgttctatgtatatttacgctccgcgtaagatgacagctcacctgaagcggcgcataaatgcgcaatacatcacaactaagtaatttattgacgtttaaggctatgacaaaaaaagtcacttttgtatcacacccaccagaggtgggaaacatcacaactaagtcatattattgacattgaaggtttaaggaataaagagatatttgggctcacacccaccatttaggtggggtcacagtcacacctcccgatgttcactaaaaacactctgtatacagaataatatttctaaaataaattattatatgaaatatggttttgcaagcatcggagggctgtgaataacttttttattataataataaatataaaactaaaaattttgcaataatctttttcaacaatatactatgtaatattttcttattataataagaaaatataaaaatccgcctacacaattgtaggcggatttaaataacttgctattttaccaaattgatactctgttctcaggagcaacgtacattccatcttcttcagttatgtcaaaagcttcgtaaaactcatcaaataatgcagcaagcctattcgctctgacaattccaaaagaatgaacatctattgtgctcagactctctaaatactgacgctgacctgttatcttccaaagcttagcattactttcaaaaaacagtttataatcaggattttcgagttttttcatggcgtcaagcgcacatgccattcctccaatatcagctacgttctcgcttattgtaagttcgccgtctgtttggattccgggagcggattcaaatccgttataatagttaacaacatcctggcaaagctgttcaaacacagctaaatcctcttcagtccaccaatttgcagcgtttccaaactcatcaaattttgcgccgttattatcaaaagcatgtgtaatctcatgcgctattactgtaccgatagaccccaaattttcctcaggctttccatcagaataataaaacggctcctgaagtattccggccgggaagttaatagagttatcagtttgcatatatccggcatttacggtatataccggaactacgctccaataatctgctttttctgcaggctttccctggctttcagctatatcagcatacgcggattttcttatactgttcatagtattaaaatatgcgtatttttcatttggagaataaaccgttatatcgtcaatataatcctcaaatgattcaggataaccaacgttaacagacattgcgtcgatttttcttattgctttctcttttgtggcttcacccatccaggttagatttgcaatcctgcttctgaaaatatctataaactcatttaccatattttcaacatcttttttagtctcatcagaaaaattccgttttatatattcttcactcaaatatgaagataaagtatttttggtagtagtcaaagctatatcctcagcaggacttgtaacgtccattccaaaataatccgactcaaaatcattcgctgcgtcaataaaacgtttatccagctgagaacccaaacttaaaacagaaattttaagtattgttttcaataaatcaatgtttttgtcattaacatatgaagcaaacgcttccataacctttggagttgtgactaaaacattatcttccggatgaagacctaatgcttccaaaagcttatcaaaatcaaatgcagggaacaaatcacacagctctgaataactataaagattataaatattatctatattagaagcttcttggtttgacattacatattgagataaatccttttcaaaagcgataaacttctcaacatcttctgcagctttagtgttgtcttcgccgccgagaaccaagatatttgtcaagtaatctttatagctgttcataatatcttcattttcataatctgctttggtacggctcggcgaatacgtcccaaaagcaagaatattctttgtattgtctttaaaatcagcgacaatcgcaaaagctgcaaaggtggtaactaaataatcttttacaatttttgttgacaaagcgtctaactcgtcaagcgattctattttatcaatttcatcaagatacggctttagcggttcaatatcctgttcagttccctcgccggtgtttaagtttttaacactggtataaaaatcagctattatctcaccattgctgccggcaggctgttcttctgacaaataattgttaataatatctgagattatttcatcatttctctcgtcaacttcatgaaacgatgaagttactacattgccttgagaaatttctgcagtgttataataatctttgttgatataagcctgaaagtcatcctttaaattagacccaaaaagataatataacctgcggataatcaaagtaacctcgtcctcggttataaaatcctcagaaccaagcaatccatcaccttttccaaccagtatcccgcggcttgccaaattattgacagcgtcttcagcccagtcaggaacatcagaaaatgttaaatcagtttcgctgatacgtttaaagttcttatcaggttcaggcatttttccaaaagcacggtcggccataacaacagcctcggaacgcgtaatatactggtcgtcttttgtgtcaccgtcgccatatccttttataatgtctcctctggttattcctgcattataatcatccgaaacagacaaaagcttatcggcaacatatccccttgttgcataacctgcgccgtcttcttctgcaatgacaataaacggcattgtgcttataagcatagagagagccagcattaaagatagcagttttttcttcattttctcacctcgtattataatattttttgttttttcatttttaattataccattggtaagtttttgtgtcaatcaaattagttaccgataaatatatatgtattatttcttttaacataaaagattaattattttaagcggttgaaaactaaaaccgtaccagcttaaaaatccggtcacaatttaagtataaatattattaactatgtttatataatcaaaacgcatattttataaaagtaaaattttacttaaaaatatattggcacggaattatgacataagctgtcaagctctgagaaaagacaggtaacctcgtataataaattcaagttgtctgcataaaaacagcgcagcagtcataaaactgctacgctttaaaaatctcttttttagtggtcacaccattgtctttttgtatatcttaaattttaaacaactttttataatatttattaaattctaacaaaatttaattttaaataatagtatttactttatttaaaaagctttttctaacctgtatttttataaataataatttatttattcagttcttgtgaaagcagcttatttaccactccagggtcgccttttccctttaactctttcatgcactgacccatcaaaaatcctatagctttcttgtttcctgaattataatcaacaacaggctgaggattattttcaataaccttcttaactatatcaagaaccaatccttcgtcgcttacctgctctagattattatctttaacatatttttctacatccaaatcttcattgaaagcgattccgaaaatttctttggctttgttacggttgattgttttcttatcaaccagctctatcagcttggcaagagctttggacgtgagcttcatatccttggcttctataccctcatcgctcagttttctcattagctcgcccataatccagtttgaaacttctttagggttattgcatatcgccgttgtctcctcaaagaagtcagccagcgctttctgacctgttatcatgttagcgtcatattccggcagtccaaagtcttttatataacgcgcctttttctcaggagcaagttccggcaaactgctttcaatagaattaaaccactcgtcgtctatatcaataggcggaatatccggctcaggaaaatatctgtaatcctgtgcgttttccttgcttctcatagcatagctcttgtctttattatcatcccagcgccttgtctcctgggtgacctttccgccgcgctccaataagtctatctggcgttttgcttcaaaagctatagcttttgaaatagctttaaacgagttaaggtttttcatttctgtccttgttccgaattcttcctcgccgacttttctgactgacaggttgacatcggcacgcattgacccctcctgcatcttacagtcagaaactccaaggtattccagagtggatttcagcttagacagatatgcgataacctcatcagcgcttctgaaatccggctcgcttactatttcgataagcggaacgccgcatctgttgtaatcacacttagtttcgtcgttaaactcatcatgtatcagttttccggcgtcctcttccatgtgaatttcatgaatccttatatcctttttaactccgctttctgtctcgataggaactcgtccattccgacagataggcagatacagctgggatatctgatacgccttaggcaggtcaggataaaaataattctttctgtcaaatttattgtatcgggtaatatcacaattcagcgctattcccgccttcatagcaaaatttactacctgtttgttaacaaccggcaaagtacccggcattcctgtgcatatagggcagcagtgagtgtttggctctccgccgaattcggttgtgcatgaacagaatatttttgatttggtcgcaagctcaacatgaacttcaagacccattacggtttcccatgccatattacttcgcctcctttacaaaactatccggtgactttttgtgaaagtctgttaaactctgataagtatacgccgcgttcaggattacatcgtctttaagcggcgcgccgaccagctgtgcgcctatcggcataccatcttcatcaaatccgcacggcacgctgattccgggaagcccggcaaggttaacagaaacggtataaatgtccgaaagatacatctttagagggtctgataaacttgaacccaatttaggagcagtagtcggagcggcagggaaaagtataacgtcatatttcttatacgcttcgtcaaatgcttgttttataagggctttaacctgcagagcttttttgtagtacgcatcataataccctgtagacaaggcaaaagttccgagaagtattcttctctttacctcttcgccgaatccctcgcttcttgttgacatatacaaatctgttaaatcatcaaaattttcagacctgaatccatacttaacgccgtcaaaccttgaaagatttgagcttgcctcagcagacgctataatataataggttggaacaacataatcaataatagtcatgtcaaactcttcaacagaagcgccgttttccttcaaagtctcagcaacagcaagaactgactttttcacatctttattaagaccgtcgccaaaacactgtttaggtattccaattctcaaaccgtcaacattacctgacagcgagttgagataccctttatgttcaacctccaaagaagttccgtccatttcgtcttttccgcaaataacatccataatagcggcacagtcggcagcgtccttagcaacaggaccaatttggtcaagtgaagaggcgtaagctataaggccatatctggaaacagctccataggtaggcttcattccggtaacgccgcagaatgatgccggctgtctgatacttcctcccgtatctgagcccaatgcgtatggagcttcctttgctgaaacagctgcagccgctccgcctgatgaacctcctggaaccttttcagtatcccacgggttttttgtcggcccataaaacgatgtttcagatgtgctgcccatagcaaactcatccatgttcagctttccgatgataacggcgccggccttgttcaatttatcaattacagcagcattatacggcggcttaaaatctcccagtatttttgaagcacagcttgtctttattccctttgtggaaatattatcctttattccgaccggaactcctgccagcggagaatcgctgagctcgcctgagtctatcattttctgaacttcttcagccctctccaaagcttcctgttccgtaactgtgatatacgcgttaacaaccccgtcttttgccttgatttcatcaaggaacgccctggttgcttcaacgactgtaatatcaccgctctttatctttttgcccagctcaagggcagtataatcagtaatattcatttatccgtttcctttccaaaataaatttctcaaacgtgatggctattccaccgtctttggaacgatgatagcctcgtcgtcagactttggagcgttagccaaaagctcttttctgtcggcgctttgcttaacaacgtcctcacgcataacattttttacggcaaacgcatgtgacataggctcgacgccttcagtgtcaatattattcaaaacgtccatatagcctataatctcgccaagaccctgcctggcattttcaatctgctcatcattcagttttaatctggaaagttccgccacatacgaaaccatatcttttgttacttccataatatcactcttttcgctataaagttgattacatattagtggtaattataccaaaccataaaatttttgtcaataacttactatatataatcattgacaattcaaacacagacaaaaccaataaatataatgttattaatatgaaaaaataattttgtgctaaactactctgcagcaatatatctgcaacatattgggaaatattttagcattattttcactgacatttttattaaaaaatattccattattttattataaaaccgtaacaaacgttttattctcgttgacaagactatgtttttctattataatattataatcattttaatattttatggattttcttccaaatagtaaatttttttgaaacggagattgatttatgggcattttcagcatgaaaaactataataaacccggtaagggtgtggaccctctcgaacccaagagcgagggcgctgttttattttttgaaatatttatccgaaagttctggaagttcatacaggtcaatttgcttttttgcctggcaaatatcccaacctttttaatcgtgttttttctttcaggtacagtttcaaacgcggtatacggaacgttctcaaaccaaattgccagtatggtcggactgagcgctcctgatttcagcaacagcgatttcagcgctatgtacataaccatagacctaggaatcagagcttttgttactatactatttacagttttttggggtatgggacctgtaagcgcaggtatgcactatatccttagaaattactctcgtgaagaaaactcttttatattaagtgacttttgggacgcaataaaagacaattttaaacagtctttggctgtttatataattgatttgatagcgcttttcgttttcttctacggtataaccttctactcgtctcaaaccaatttcctgaaatacggaaaatacctggtttattgcttgttccttttctacgcaatggttcatctgttcttgtatccgcttatggtgagatataagctgactatcggaaaactttacagaaatgccgcgctgttttgcttggtcagcctgccgtacagtattcttgttatagtattgcttcttttgatgacagtaggcgttggttatttaggaatatttatgctgtcaagcggttcatttacagtgcttttcacaatataccttatatttgccgtgctgctgctatattctttcacagggttcatcgtcagctataatgcggaatgccaaataagaaagcatattgacgaaaacgcagacgtagatgaaaaaccgaattatgaaaaagaagaaaaaccgtcaggaagaagattatattagattttttaagtaattttaagtaaatacagagagcttttatagtttatgaattatttttatcgttcttaactattttaggctcttttttattgcccattattaataaaatgttcaaacatactacaaaaatagttaaaaaacatcatatataattttatctaaaagctactcatggaggataatatgaaaaacattttagaattactggaaaactcagaaaagctttatcctgacaaaacagcagtatcagacggcaaaagaactattacatacagcaggtttaaaacagcagccatggaaacaggctcatatatagcctccaaatttaaattcaaacgccgtcctatcgccatatatatggaaaaaagtattgaaacgcttatttcaatgatgggcacagtctacagcggtaatttttatgtaatactggatataaaaatgccggcggaacggttaagccttataactaacaatcttgaacctgaactaataataacagacggttcgcacctttcaaagtctaaagaaatattccctgaaaccaaaataatctctattgacgccgttcctcataatataaacaacagcctgctctccgaaatcagaaataaaactatagataccgacttgctctacgtactgtatacctcgggttcaacaggaatacctaaaggggttgccgtcagccataaaaatgttatatcctacagcaaatgggtaatagatacttttaatataaacaatgaaaccgttttcggaaaccaaactccgttttatttcagtatgtcggttcttgatatttacgcgtcgcttaggacaggcgccgaactttgcattattccccaaagtctcttttcgtttccgcttgagctgttaaagtttattgacgaaaacaaaatcaacactatttattgggttccctctgcactggctttggttgcaaactggaaagcatttgactactgcgttccaaaaacattaaaaaaggttctcttcgccggagagacaatgcctatgaaacaactgaatgtttggcgcaaacatcttccgggcgtattgtttgccaatcttttcgggccgacagaagttacggatatatgcgcctactatatattagacagaagttttcaagacgatgaatcactgccgattggtaagccctgcgacaattgcgcgctggaacttataccggctgaaggcgataatacacaaacagaactttgtgtaagaggttctattgttgccatggggtattataataacccgaaaaaaactgccgaggcgtttgtgcaaaacccaaacaacacatgctatcctgaaattatatataaaaccggcgacttagtagaactgaacgataagggcgagttaatatacctaggcagaaaagaccatcaaattaagcatatgggataccgtattgagcttggagaaatagaaaatgcaattaattcaattccgaatgttcaggcttcctcctgcatatatgatgaagagcaggacaaaatagccgcttttcttcaaactgattctgaaattaaagagattaaaaaaattgtaaaagaaaaactgcccaaatacatgatacctgcaaagtgggtgtttctaaataaaatgttttacaattcaaacggaaaaattgacagaaacaaattaaaaaacctatatataaaaggagaggtataaaatgaatgaactgattgaaattttaagcggcatttgcagcggggaaggctttgagaactcagaggaccttatagccgatggttttttggattctttagatatagttcaggtatcggccgaactggaaaacaattttgatattgaaataactcctgttgacgtcacccatgacaactttaaatctgtaaacagcatttatgaaatgataaaaagactggaacaagaataagaaaagagagatcatatgcaatacaatatgcctatttatctatgcgtgtttcttccggctgttttgggcggatattatctgacaccaaaaaaataccgctgggcggttctattattggcaagctttgcgttttatttaataacgggcggagcgcttatagtattcattcttgcgtcttcactctttatatatgctgcaggactttggcttgagagaataaaccaaaaatacgccggtatcattgcagattcagataaaacacaaagaaaagcaataaaacagaaaatgaaccgtgagaaaaagattgtcacaggaatatcggcttctatacttataggagttctgcttttcttgaaatacttcaactttttcggctccaatataaacggactgataaacaatctgtttggtctaacccctattcctacgctttccctaatgctgcccctaggtatatcattttacactcttcaggcagtcagctatataacagacgtatacagaggcactgtcaaggctgataaaaacccattcagagtttgtttgttcttaacgtttttcccccagctaatcgaggggccgatttgcagatacagtcagactgccgaaagtttgtacaacggaaacgactatgattccaaaaacatagtttccggattccagctgataatttggggtctgtttaaaaaaataataatagccgacaggctcaacgtgctggttaatcaagtgttttctaattattcaaattacggcggagctataatagcaatatcagtgctatgctatacaattcagctctactgcgatttttcaggctgtatggatattgtgcgcggttcgggagaactgtttggaattataatacctaagaattttgaacgcccgtttttttccggcagtgtttctgagttctggagaaggtggcatatctcgctgggaacatggtttaaagactacttattctaccctgtttccctgtcgtctcctgtcaagaaacttggcaagttttcaagaaaccacttcggcaaccgtgccggaaaacttataccggcagtctgcgctttatttctcgtttggttcagcaccggtatgtggcacggcgccagctggaaatacgctgcatacggactgtattattttatccttataagcttaggaatggttttagaaccggaaattaataaaataaaaaacagcctgaatataaaaaaagaaagcaaactatataaagcatttaaaattttcagaacttttgtcctggtcaattttggaatgctgatattcagggcagataatcttcaagtctgtataaatatgtttacaaaactatttacagactttaatccggctcaggttttgagtttctttagcattaatctaaaagttgatattaacgatataattatattaatcatatcctgcacagtcctgctgactatggaaattttaagagagcgcggactggatattagaaaaaaactatctgaaaaaccaacggctgcacgctgggcggtttattatgcctgtgtgctggcaatcataattttcggcgcgtatggctggggatattcaccctctgcgctgatgtacgcctcatattaaaacgactggagaaataaaatgaaatggtttagacgtatactatttgcattaatcctcattatactgctttgtcttgccgcatacgtggtgtctccaaaaagtaatgccggtgaaatgggaatccatttaacagacgcggacgatatatatgctgagtgtaaaaacaccttagatattttcgcagttggaaacagcaacctttttgccgcaatgacgcccatgcagctatgggaagactatggctatacctcatatgcggcgggtgaatccaatcaaatgatttaccgctcatattttctgctgaaatcattgatagacaaacataaacctaaactgtgtattttagaaacggacgttgtttttcaataccgttcgaccgcaagcgacctgcaaagtataataagcgaatacataagtgaggattttccgctgtttgaatatcacaaccgctggaaaaaactcactgaaagggattttacaacagtaccctcccataaccgccccaatgttttaaagggttacgaatacgtcacttattccaatccatacaccgggggagaatatatgaatgaaacagaaaatattgaatcctttcataaaatacaaaagttctttttagacaaaataacagagttatgcaaagaaaatgatattgagcttttattgattgacgtgccgtcctctaaaagctggagttatgaaaaacataacgcaatacaagattatgcggatgaaaacggcttaaaattcatagactttaacataaacagagacagttttggcatagactggaacaccgacacccgggacggcggctggcatatgaaccacagcggcgcagtaaaagttacggaatacttagggaaatttttagatgagaactatcatctgcccgaccacaggggagaatacggatttgagcagtgggcaaacgatcttgcagaatataaaaaaacaataggtgaatagtttatttattatataatatttataggttaagctcataaatattatataaaataaaaacaaatattaataatataaaaccataaaaatacggattgacaaaaatattgtcaatccgtttatttttaaattttatctcagccggaatataacaaaccaatcccgtcccgatttaaggattaatacgtccaatatccctcgggaatgcggtaactgtccttatattatccactcccagcagcttcatcgccagtctctcaagacctatacccaatccaccgtgaggcggcataccatacttatgcatcattaaaaagtctgagaactcttcagggttcattcctctggacttaattttgtcaagctgcttttggtaatcatgtatcctctgaccgcctgtggttacctcggctccattcaaaagcaggtcaaaacttaacgtatattttggattttcagggtcgtccatagcatagaaaggacgctttttggaagggtaatgagtaacaaaaaccagcggcgagccatatgtttccattacatactcacctatcagacgttcttcctccggttccaaatcattagggtttctgaattccctattatatttgtcagcaatgatctcttttatctccataaatttaaactgcggaatgtcaggaatgtcaggaagctccactccaagctccttaagctccggagagtaattcgtcttaagatagtcaaacatatacttcataaaccttgcttcaacagccataatatcttcaaacgagtcaataaatcccatttcaaaatcaagaccctcaaattcatttatatgtcttgatgtgctgtgcttctcagctctgaaaacaggcgctacggtatatactttcttaaacactccaaccatcatttgtttatacatctgtgggctctgattgagcaatgctttttcaccgaaatagtcaacctcaaacatatcggctccgccttccgctcctgcggaaacgattttaggcggaacaaactcagtaaatccctctccgtgcataaatgacctaaaggcgtttatgataccgtcaactattttgagcgcggcgcgttcgtgtggatttctcagtgacaacgatctgtaatccaactttatgtccacattgcagtccagtttcttcttatttataacaataggcatattttcggcaggagatgacaaaacctctatactattgatatgaatctcaaaaccaagcgcgctcctgtcgtcctttttaatcgttccggtcagccttacgctgtcctcttctttaaagtccgcaatcggcttatcactgtctgatggttcataaacacactgaaccaaatttctctgtgttctcaaaacaaaaaacgcaaagcttttcatagcgcggatacggtgaatcattccctctatttcaacggtatccccgtccttaacggttcctttttcaaatccgtcaataacggtctcaatatcatattttccagtgtaacggctcaaatcaatcatttccataaaatataaccctttctattcctaaaaatatcctttgtattctatcatacaatattttctatgtcaagcccgtataataccgtatcatcttggaatatccccttatgttctactccttataaaactgttgcggctatctacattttgtgctataattactatattaatacattatttattattgaaatttggataaattttacttatctctacatttgggggaaaactatgatatacatagattttgacagagacagctccgaaccgctgtatatacaggcgttcaaccagcttgcaaaaaaaattaaccacaacgaaattaagggagggacacgtcttccctcaagcagacagatgtctaagcagatgaacgtctcggttaacactatcacaaatgcctataatctccttgtccaatacggatatatatcatctgaagagcgatccggatactatgttaacgatataacaaaaactgatgaaaatgtgcccgagcgcaaatggcacagcgacgctccgtacacttataacttcagcaggaacggttccgacctttcggttccggcaagcctaaaaaaatcatataaatactgtctcaagaattttattgaggacgcattctcctatcccgactatacaggaacatatgatttaagaaaacaaataagccttatgctcaacaaaaccctggatataaactgcagccctcttcaggttatagtaggctcgggtcttgaaaccctactcgactctctgtttcgtataatgggaaatgatatggtgttcggtcttgaaaacccggcttattatagaatagccagatatatgagactcggcggacgacaaatgtcatatctcaacatagagacagacggacctacacaaaaatcgttaaacaattttaacgctgatattttatttttaatgccgtttcatcattatccaatgtattatacaatgtcaaaagagcagaaatggatgattctcgattgggcaggaaaagacagatacataatcgagtatggttacgacatggattttgtatataaaaatcagtcaaagccgctcttttcgatgagccaaaataaaaacgtgatttttgccggagactttcagcggagcatagcacccaacatcagcacagcttacttaatcctgccggaacatcttgtcaatctttggcagaaagaatattatacctatcattcttacgtctcaaaagccgagcaagagtttatagccgagataattaaaaacggaagttattataccaacctaaaacggctcagaaaacaatatcaaaacaaacaggaacatttggtttcctgcctttgcaagcacccgctgggtcaaaaaatagaaataaaaaacacggacgcaggcaccacaatattaatggtgccaaagcccgatatatccgaggagaatttgattgtctcagctcataaaaaaggggtaaagctatcctatataaaaaatgcgctggagcaggaaaacccgaaagttcctcttaaaacatttattcttggatttggagagctttcaataccagaaatagaggcgggcgcaaaactgctgatggacacatggacgccgctcctaaacggttctttataacccaaaccatttttgaattgacttcataaccccgttctcatcattggacggggctatatgtttagccgcctttttcaaatcttcatgcgcatttgccatcgcaaaactttcaccgcattcaaacatcatctcgtaatcattcagatagtctccaaaacacatgcattcggacttatcccagccgcatatttcacgaacctttttaattgcagagccttttgatactccaatcttcatcacatcaacccattctctgccggacaggattatctgagcagattcagggtattcagggagctttttataaatattctcatatgcgtcgtttggagtatatactgcaaccttcagtatattctttgtatcacaataatcagtaaggtcgggcacaaattccagtctcctaaaatactgaccgacctcaacaggcttataaccgccgacagaactttccatatacgcgcagtcttcacagcacaatatggggtaaacactcggcaattttctcgttctttttataacatccaaagcaacggctcccgaaagacagtcacggacgattacctcaccatccttaatgacaaacgcgccgttttcggctatatacataaaatttctgctgataggctcaaactgttcaagaaccttataatactgtcttccgctggccggggcaaaggttactccaattttattcaggcgttcaactgtcgcacgcaaatcccgaggaagctctttggatgaattaagtaaagtcccgtcaaggtcgcaggcaataaactttatcatatatcacacactccgagtttgtttattttcatcaatagtatatccctataacacgtttataccacagctgttatcatgctgtcaaggaaataacttctgaaaataaactgcccgaaacagatttttttgtgtgttttattttcgttaaactctttaatccactattccctcgcccagctttgaaatggcctttttctctatcctggaaatataagacctggatattccgagcattttggcaatctcgcgctgagtgagacattttccgtctatcagtccatatctcagagtgattatcttgcgttctctcggcgtaaggttatatttaatgtttttatataaagtctttattctatcgcccgactgtatctcttcaaaaatatcctcgtcgtcattttctataacgtccataagcataatggcgttgccctctttatcagtaccgatagagtcgttgagcgacacgtcattttggttcttcttcctgcttcttaacatcataagtatctcattttcaacacatcgtgcagcgtatgttgcaagcttagtgccttttgaggcgtcaaaactgtttattcccttgataagccctatcgttcctatggacaataagtcttcgctgtcgctggcgcacgcggttgacgacgaatatttttttgccacatgagccaccagtctcaggttatgttcaataagtttattttttgcctcctcgtctccttccgccataagcctcaggcattccgcctcctcctctttggacagcggttttggaaaagagttgtggtttgaaatatatgatataagcaatattaatgactgtagtacagaatttataaaagcaagcataatatacctccataaaaaaagatgagtcaaggacgttaaagtctataactcatcatttggtttatattgttaaactataaaattatacaaatcaggccgccgctgccctcgttgataatacgctccaaagtttctctgagcttttgctgggcgtcgtcaggcattttcgacagtttattgtgcagaccctcgttaacaagttcatgcagcgactttccgaatatatttgactgccaaatctgttttgggtcgctctcaaactcgctcatcagatattctacaagttcttcagactgtctctctgttccgaccagcgggcttacctctgtctttatatcagcttttatcatatgaacagatgttgcgctcgccttgagtcttactccaaaccggcttccctgcttgattatttcaggctcgtcgagagtcagctcatctattgatgggtatacgattccatagccctttcggtctacttcgcccaaagcatacgcaactttctggtattcctttttcatctttgacagggcttctatctctttaagtaaagcctgcttatcattgatgtttaatcctgacctttcgttaagcgtcttatagaacagactgtcaggaaccgaaacctcaatccttgcctctccatatccagggttgatttcaacaatctgagctgaatccacaaactcgcattcttcctttaatattttaggaatcatatctacgtctgatatcttttcagcgttttcaatggcgctgtaaatatcttcagaaatatttgtgttatccatagaactaacccaagccggaactgacacagagagttccataagaggaaattcatacagcattttttccataatattgttgatatcttcttcatttaattctgaacaattcgccggtattactgtcgcattgtattttccctgcatttgttttgccaattcttttgtttcctttgcgtccggatgagcggaattaagaaggataacaaaaggcttgtttaaagcaagaagctcgtttataacacgctcctcggctccaacataatcttctctgggtatctcggttatgcttccgtctgtagtgacaacaacccctacagtcgagtgctccgatataaccttccgcgttcctatttcagctgcctgctcaaactgcataggattagcagaccacggcgtcatcaccattctcggcatctcgttttcaatatgacccaaagcgctgggaactatatatcccacgcagtcaatcattctgactttcagattggcgtggtctcccacggttatctgtgccgcctcatttggtatgaattttggttcagtggtcattatcatttttcccgctgccgattggggcagttcgtccattgcacgttcccttttgtagtcgtttccgatattgggcagaaccaacagatccataaaacgttttataaaggtggattttcccgttcttaccgggccaaccacccctatataaatatccccctgtgtcctgagtgcaatgtcattgtacaagttatctcgcattattgtttcctccttaaaactttggtagaccggcatgaatcatttgttagatgatatgcagaaacagacaagaatatgattgataaaattcaggttcgtaaccaaattttgatttttgaatatattatactgaggcaagttagagatgaggtgttaaaaatgttcagaaaaaggccctgctgcaaaaagaaaaacagcatatcaatactgggtccggttcttgtcgctctgggagtgggcgtattcttagcacaaataatcccgacctacctccttatagctttattcggtatcgcactcatttgtgcgggagttaaattcatatgcaaataaacaaaagaagtgaattcgttttataggttatcaaacctaaatatattataaaggagcaatacatatgcaaatcgttgttataaaacccccaaaggttatcagaggaatcctaaaactcatgtttggagtaaagaccatccgcgaagaggagtaaatattaaaccataatcataattcttctataactttctaaacaaaacaaacatattaagctccaccccctttcgtctttcaagcgtccggcgaaaggggtcctttctttttataatataaaaagccctcaaaaaccaaaacagtttttgaaggctgagtatttattttatatatttagtatctagtttccggcaaacgccagtatttttttcatcctgtgattaacgcccgatttggttagcggagggtttaaaagtccgccaagctcggttaagctcaaatccggattttccaaacgcagaatcgcaatctcgcgcaggtcgtcaggcaaactgtcaagacctgtcattttctgtattttctgaatcgcgcaaatctgttccacagacgcgtttatagtccttgacaaatttgacgtctccccgttggcgcttctgttaacatcgtttcttatctctttttctatcttaatattaataagctccatctgagacttatacgctcccaaaaatgagagtatgtctgctattatctcgctgtttttaacatatgcgacatacttgttttttctctctatcctatgaaacttaaaatccatttccataaacaggtttataagttcgtcacaaagcaaaaactttgaggtcacaatttcaaaattataatttttcatcgggtcgctgaccgtacccgctcccaaaaatgcacctcttaaaaattcccgtttacagcacggccttttcactatactgcggctgacatggtagttaacgtctcctgtaaggctgttcagcaaatccaaatcatataacaattgggctatttttacattatctgatattgaagctgtgtatttaaaatttttatcgcttacctgtttcacatcagcttctatcccaagcaggcgtgaaagctctacaaaactgcccataacatcctgattgtcggttacaaattttatctcgtttttgctgataatattcgctccgaatagaataaggcctgaaaatcttgccattatacagcactggtcaacaacctctgttctgtatatttcctctttaacacgtcttgaaaaagatttaacacaaccaaacttatccacaactatcacctccgccgtgttttagggttatataacaaaacgccttcagaactgactttaagcccctgctcgttcctgtttatattaattatatcaagcagcgtatccgccaaaacgtttatatcatggcggacaaaaccattgccgtccacagtggacaaatccctttctaccacggttatatctgtagaaccgaaacgttccttatcataagccacaggacacgagccgtcatcagcatacttttcgagaagcgctccgcttatttttcctgtgttcacaatacaataatcaataaagctgtcatatgtatgatccaatatagccagcacatggtcaaaagccgtatattcatcagtctcgccgggctgggtcattatattatttatatatacaacaggcgctttagactccattattgcgtcctttaaatcaccgattaccaaattcgggagcacactcgtatataaactgccgggacccagtgttataaggtccgctttccgcacctcgtctaaaatttctttcagcggctcaacaggcatcatataatcagatttagaacgcaaacgcactttttttatgtggctgttatggtcactcaccgaacttcctattctggactcccccaccacagtttgtccgttttcaagcgttgccaccaactctacgtcagaagccgtaaccgggaacacttttccggttatgttcagaaccttgcagacgtttcggacagcctcaacaaaatctccactgaagattcctgtcatagccgcaaccaaaaggttgccaaaactttgcccttcaagcagaccgctgtcaaacctgtacataagcattttttccattataggctcaacctctgagagggcgagaatacagtttcttatatctcccggcggaggcattttaagatcctccctcaaaacgccgcttccgccgccgtcatcagccacagtgactactgccgttatatcggaagtatatttttttatacctctcagcattgccgataatcctgtaccgccgccgacagaaactattttgggattaaacccggtgctgtttgtttttttgaaattttcatattttgaaaccgccataatacgatacatatagccgcggctatatccccttcttaatatctctgtgtgtaacagttacgttattaccgctcttttttaggaatttataaagctcttccgcaagggtaacgcttctgtggtgcccccctgtacagccgaccgatattaccagctgactctttccctctttgatatattcaggtatcagaaacgacaccatatccgtcagcattttcaaaaacttcttgctttcatcaaactccataacataatcgtgaacgcaggtttgaagacctgttttttctttcagctcaggaatataaaacggatttggaagaaaccttacgtcaaacaccaaatcagaatccataggcagaccatatttgaaaccaaatgacataacattaataatcagtcccaaatcctcttttgaactgaacatagattttatctgagctttcagctgggatgccgacaagtcggacgtatcaattatatgcgccgctttcgacttagcgtcgctcagcagaacgcgctctttgttaataccgtcaattatcctgcctccgccggcgctgggatgcaggcgcctagtttccttatacctttttatcaaagtctcgtttgaagcctctaaaaacagtatttcacactcaaacccaagctcctcgagctcgcctatagcttctgacagctcgccgaacatatcgccgcctctgatatcggtgacaatagctatattatccattttttctgtcgccttatggcatatctcagcaaactttggtataagctccggcggcatattgtcaacacaataaaaaccaatatcttcaagcgccttaatcacctgagtttttccggctccgctgagccctgtaacaattaaaattttcacttttctgctccttagactttagaattcacccaaaaacttaacctctgtatttaggtcaaccccaaacttttctttaactgttttctgaacatgttttattacattccgcacgtcttcagccgtagcatttccattgttaacaacaaatccggcatgtttctccgaaactgaagcgccgccgtacgaatatccttttagccccgattcttctatcagcgccgcggcatagtatccctcaggacgtttaaacgtgcttcctgcgctggctttgtctaccggctgtttctcaacccttctgcgggtaagttcctgcattcttgcctttatttcatcaatttcatcaggttcaagcctgagcgttccgcgcagtataatcttgccgctgtctgtaaacatactctttctgtagccaaaaccgcagtcttcgccgctcacggtgcaaattttacagttttcatcaagataaactacttctgttataatgtccttcatttcaccgccgtaagctccggcattcatgtatatagctccgccgaaagagccaggtatacccgacgcaaactcaagccctgcaagaccattgcctgccgccgaatttgcaagcctggaaagcagaactcccgactgtgcggttaccatatttttagaaacttcaatactgctcagatttcttcctatttcaataaccgctcccctgacgcccctgtctcccacaagaagatttgaaccgttgccgattacatgaaactcaaccttaaactgcctgaaaagcttgataagcgaagcaagctggctctcattctgaggagtaatatataaatccgccgctccgccaaccctgaaagtcgtgtgagagctcatcggctcatctgtcttaacatttgattccccgacgataccttttgccagggttataatcatgttattcatcgttccctccaatattatgtcttacaatacaatatcttttccaaccgaccttaaatagccgataaatctgtcagcacttgtgttcataaccaattcttcaggaaagtttatctcctccagcatctttatcccgttttcaacattcccaacatcaaacggactgtgcgcatctgagcttaaaacaatcctgcatccgacttccatacacttttcagcaatctttctgcaattctcagcgctgcctttgcgcaccgcatacgaatggttattaatctcaatacacttattattttctttggccgccctcacaacagcgtcaatatcatacggaaaacgcgggtcgccgctgtgtcccatgatattaacatacggattcttcaccacgttcagccatgtctcggtatggtccggcaagtctttagactcataacacggcggatgaattgaagcgacaacaacatccatagattttaaatactgaacaggcatatcaatctcaccgtcagaattcaggatatttgcctcgcagccgcaaagcagtctcacaccctcaatatattcgggcaattccttcattgtgttaaaatgccaaatatgaggggaatccggaatcgccggggcatggttggtcatacaaaccatttcaagcccctttgcctttgcgcacttcatattttcccatatagttccaaaagcatgattgctgcagtttgtgtgagtatgtgtatcaactaaaactttcaaatataattacctccatagcaatttatcaatcaaaatgactgatttgatcagttattcttctgttaagctcttcagccgcattataacccatacgtttctgtctgttattcatagccgcaacctcgaaaataacggctaagtttctgccgggctttaccggaatagtaagagacggaatatccaagcccagaatattggtgtattcatccacaagccccagccggtcatactgttttcccttttcccaggcctcaagatgtattatcatatcaattttttcagactccttgacagcgcccataccaaagatatttttaacatccacgattcctatacctcttatctcaataaagtgtctgattatatcaggagacacgccaatcagcgattttgaggaaaccttttttatctcaacggcgtcgtcagccacaagcctgtgccccctcttaataagctcaaccgcagtctcgctcttaccaactccgctttcacccaatataagcactccctgaccgtatacttcgaccaacacgccgtgccgagtgattctaggggcaagttccacgttaagatatgcgtttagcgaacttgtaaaagacgatgtaggctgagaagttctcagcaccggcgtttcaaactcctcagcaagtttcagcatctcggcagaagcattactgtttctagtcaaaatgacggctgatatttgtttttcaaaaagtcttttaagactattgtaacgaacctcagaagacaatccggcgagatacgtattctcgaccataccaaaaacctgaatacggctcgggtcaaaataatcgaaaaatcctgttatctgcaagccgggtctgttaaggtcggctgtatcaatcaaaacttctttatttggataataaagtctatccaatttcatttcacgtattactttttccaaattaacagtaaatacttctttttccataaggcaatacctctgattttcaaattaaatatcttaaacaaagtaattatactattattaaaaccattttgcaatagatttttcactttaaagcgagaggatataaacattttcggctattttgttaataaggcaaataatttattataaatatacttgcgcgccgcgcgctgctgtggttccaaattaatgattaaattataatatttatcattaatttacatcgagtttccagcgaatcacgtctggattgcgaccacatctgccgatgcttgccataccaaaattttatataattttttattttaaaatattttcttatatgctgagtttttttagtgaacttcgggaggacgcgcttgcgcgtctcgttaggtgagccatcatatcacgcgcagcgtgaacatatatgcaacaatttgttataatacctttatatttatcttttccgcgactgcgcgcatcccccactgctgcctcccgtaggagtctgggccgtgtctcagtcccaatgtggccgatcaacctctcagttcggctaccgatcgtcgccttggtaggcttttaccccaccaactagctaatcggacgcgagtccatctttaggcgataaatctttgattatcataccatgcgatacaatattttccgcgactgcgcgccttacgcggcgtacttcgcacgccctaccgatgcttgctataccacatttttataaaatttttatatttatttttattatacgaatggcagcctttgtcacgccgtgtttaaaagaatattcaattaatacttgcctaaatctcatagtttgtgttatagtgttcatatacggaagactcctttgtgtatgtgatattatggtgatataactataacacaatttatgagttttccgtattctttttttctctttgtaacacatctattgtaattttactccgtttcaattttttatgcgtactcttgtccaacttttttgttttaccggagggcgtaaatgatttacgccctcaaaatttacttactgaacattattttttaaagttatcttaatttattgttttattaggaacctttattctctatagccttttttccaatcatctatgtaatattgattaatatatcctccataagaatagctgctgtgctcctcaaaagcttctaaataccggaaacgtgaatattcgtcaatagctgtatactgatagaactttttaccattagcttcaccgacaatgcaagcttcaggaacaaacttaacgtctatctgtactctctgaccgggatagagcatttgctcgtaaggctttggtaagaatagctgctgtgctcctcaaaagcttctaaataccggaaacgtgaatattcgtcaatagctgtatactgatagaactttttaccattagctttaccgacaatgcaagcttcaggaacaaacttaacgtctatctgtactctctgaccgggatagagcatttgctcgtaaggctttggtatgtatttggatggtcgaggtgacaggatttgaacctggaacaaacaacgctatatacgtatatttaagaatatcgactgataattgactttaaaaactgaatgaatttaacttttccgctgtttcggattttcgttcttgtctaatgtgcgtgtagatatcttgagttaattttatgtctttgtgtcccattaattcttgagcgtcttttgcttctattccggcctcaaaaagtccttcacgcggcgttgctgcgtcagggtttcccccattgcgcaatatcccccactgctgcctcccgtaggagtctgggccgtgtctcagtcccaatgtggccgatcaacctctcagttcggctaccgatcgggactgccgaccaaacaaacggacaaaaatggaaatgaaacagtaaatacgtataatgcgtatggaagcgttctgacgagcaaggtgacaggagatgaagatataatcaatacatacagcaagaataatcttcttatatcaaccaaacaaggaaaggaagagataaaatatacctatgacgactatggctatatgaaaacagaaagccaagggaatattcagaatgtatatagttatgacgtaaacggaaacaggaaaaattatacacaaaaagcaggaacaaatacaatactgacagggtcatatacatatgacatattggtaccgcggctgctggcacgtagttagccgtggcttattctgtgtgtaccgtcattatcttccacacttaaagaagtttacaacccgaaggccttcttccttcacgcggcgttgctgcgtcagggtttcccccattgcgcaatgtaggtttgtcaatgatgtgttacaaaaaagattaaaagagttcaccgaaattgataaaagagttgatgtagtcaattggagctttccaattaagcggacgcatcgggaatttattgtagttacggttatgcacctttaaatatagttatgacgtaaacggaaacaggaaaaattatacacaaaaagcaggaacaaatacaatactgacagggtcatatacatatgacatattggacagacttatttttattaagtacaatatatatacgatatagttatgatatttttattaagtacaatatatatacgatatagttatgatatttttattaagtataatatatatacgatatagttatgatatttttattaagtacaatatatatgcatatttgtataacatttgtgtcatataagttgtgatatttgtatattgaacactgcgtgttcagatgatggttcacctaacgcggcaacctgcgtgcttgcagaaaatattttttatatgagtatatatttgtaaaaataaaaccatctgtaatttaggaactaattagaattaattatttaatataaataaaatttgctactgcgcgcctaacgaggcagattacataagctaatggtaaaaagttctatcagtatacagctattgacgaatattcacgtttccggtatttagaagcttttgaggagcacagcagctattcttctgcggtattcctcgaacaccttgtaaaagcctttaaattccctattgagtgcgttcagacattcccaaatatctacatatttcaaaaaattcgctcatggatggcattgcttttcctgatgttatatgatttatatatccttgtgaacgtcccatgtctaaactcatacatctttctgatacattttttctcattctcaattctgttattctttctcttataaaatcttcaaacatttatatcctctcctttttctatttttgttttataaaaattataataacatgaattggtcataaagtgtttttctgagtatttataagtactacaaataatttctaggaggaaatatgagggaacttgatacatttggaagaattttaatacctaaagaaataagaaaggaattaaatataaatgaaggagataaacttcatataagttgtatagataacactgtaatattgaagaaagttgataaaaatatttgtgataaatgcggagagaaatcatatacaaagcagttaaatttgtgtcaggaatgtatggaaaaattattaatataagtttgttatatattgaacactgcgtgttcagatgatagctcacctaacgcgcttgctatcgcaagcctaccgaagttcactgacccccaatttttttgtgttaaattaaattgaaaaatcaacttttttagtgagttaaataaataagaattcggaatatctattttcacggtagttcacaaagtcaacgggaaagtaacagggctttttcttttgtgcgtggagcacaaaagaaattagcgggggcgagcgccccttggagccgtaggcgacctaagcgagcaagcactttttctttggtgaagcgtttctttttcgtgccggaaaaagaaatggttcaaacaccctattatgtaataataaaatttttatatggggtcatatacaaagtatataaacagttttttagttaagtaaattaataaaaatttatatggtgtcatatgtaagaaacctttatatttgaataatacaattatatattgaacactatgtgttcagatgatagctcacctaacgcggcggccgatgccgccctaccgatgttcgctgaaccccaacttttttggtgaattaaattaatgggaactcggaacagctttttagtgaatcaaaataatcaaataaaatttgtattgtaatttataatataattctcgtattttcaagataagtgtgttacaattaacctatctacataaagtgggtgttaacacaacatataaataaaatatgagaacggagaaagagcatatgatgcgtgacgcagaaaaaactataggtaaccttattgataagcagggagtttcatatattgcgtctatttcagaagacggttttccaaatataaaggcaatgctgccgccccgcaagcggagaggtatcaaggaattttattttactacgaatacttcttctatgagagcagcacaatatagaaaaaatccaaacgccagcatttatttttgtgataagcgctttttcagaggggttatgcttgtcggcagtatggaagttttagaagattctgagaataaagaaatgatttggagagaaggcgacactatgtattatcctttgggagtaactgacccggattattgcgtgcttaaatttgtggcaaccggcggacgttattattccaactttaaatcggaaacgtttgaaattaattgatttgtatatttaaaatctaaccggcgaaaattatagctgaaggaagctttgtgtttgtttaaacctatcggagaaatatttaaattataaacgaaaacagctgactgacaaaaagagttttatatattaaattcatatttaaggagtaaaataatggttaaggttagaaatgaaacagaaaaagattataaaatagtagaagaaatcaccagaaaggctttttataatttatatgttccgggctgtgctgaacattacctggttcatattatgcgcccgcacaaagattttctgcctgagctggactttgttattgaacttgacggacaggttatcggaaatattatgtatacaaaagccgaactagttgacgaaaatggagaaaaaaaggaaattctgactttcggcccggttagtatattgcctgaataccaaagaatgggatatggaaaaatactaatggaacattcgtttgaaagagcgtccgagcttggatacgatgttattgtaatattcggaaatccgggcaattatgtagcccgtggatttaaaagctgtaaaaaatataacgtctgccttgaagacgggacatttccatcagcaatgctggtgaaagaattgaagcccggcgctttggacggaagaaaatgggtttatcatgacagcgaggttatgcagcttgatgagaaggaagctcagctctttgacgacggactggaaaaaatggagaagaagtatcagccaagccaggaagaattttatattcacagccgttcttttataaagtagccttttatagaagttaagaaaagtaataatctaactaaatttattttattaaaaaataggtcactttatattttagaattaaattagtaatgcttttaatatttactttttatataaacctatgattatctattaaaactttacacgttttgctatataactgatttaatagtaataattatagtcagcaataatttttttctgtgtgaattggtttgtaacttattcagttattataggatgtgtttcatatttaaagaatacaatataaacaattcagctcaaagagacagaatatattgttcatataagcatgagcaatgacatgaaatatctgtttaatatatctccataaagatatgtaaaatgttgatagtgttgtgcatttgacataaaaagcatgattaaaatatgatgtcggtttattatatagataatatcaggttataaaaaataaggatgtatagctgcaagggaaatatattgtacaattgggagaataaatcatatgccggaattaataaaagataagtattataattacaattcgttaagcgaattagcttttcgtttaaaagacgtatatccctcgtttcaggctgataaatttgtcagcgatgtcatggacgacgattgggacgcgttagagcttaaggcccgtgtgcgccggatttctatcaatttgggggtatatctgccgtcggaatatgaacaagcaatcggcgttattgataatgttgttgcaagttatcctgacgggtataacgactattctttagtatatttccctgacttcgttgaagtctatgggcaggatgagcgccattgggatttgtcaatatctgcattagagaggtataccatatgctcaacttccgaattcgcagttaggccgtttattataaataacgaagaacgtatgatgcggcaaatggctctttgggcaaaacatgacaatgagcacgtacgaaggcttgccagcgaagggtgccggcctcagcttccatggggacaagcgctgaccagttttaaaaatgacccgtctccggttattggtattttggaacagctgaaagccgacccgtcgctgtacgtccgcaaaagtgtggccaacaacctgaatgatatatccaaaacacatcctgatttggttgtaaaaatcgcacgggattggtatggcaagaatgaatatactgattggattgttaagcatggttgcagaactctgcttaaaaaggggaacaaggatgtgctgagcgttttcgggtttgcggataccgattgtataattgtcgacggttttgaactgggtgctcaatctgtttcgattggggaaaatatgaccttttattttagaatcaaagcgaaaagcgcggttagggtgaggctggagtattgtattcactatataaaggcaaacggcaggagaaaccgcaagatattccaaatatccgagacgtcattagaggagaatcaagaaaagaaatataaaaagacccattcatttgcagatttaagcacaagaagacataatccgggaattcattcaattacgcttattgttaatggcgctgaagccggaacactggattttgacctgttgcctgctaaataactgacgtctttggagctggtgcggcggcttaaaattaaattttaaatgtttattttagatgattttataaataaaaaatagaagcggcatatcacttgaatggtatacctcttctattttttgttattgattaaattccccagctcataatccatagcgctatattaaagaagataataacggagcatgtgtctacaattgtggtaataagaggcgatgccataagagcagggtcaagcttgcacagcttggcgagtatggggagcactcctccaagcatcttagctattactactgttgctatcagacttaatcctgtgactgccgaaaggaacagcgggtcctgaccgctgtacataatataaattctcagagtgttgactgctgcaagaataagtccgacaactactgctattcttatttctttaaacattattttcataatatcttttggggttatttcgtcaagcgccaaaccgcgtattatcattgtggagctttgcgctccgcagtttcctccggtgtccataagcattggtatgaatgcgacaagtatcggaagcgctgtaaaagccgcctcataattttcaattatgcttccggttattgtggccgagagcattaggagaagcagccaaactattctgtttttggcgtgtctccaaacaggcgtcttaagatatgtttcctcaatcggctgcaaggcacccatcttttgaatatcctcagtgttctcttcctggataacgtcgatagcgtcatcgaatgttacaataccaaccagccggttttctttatcaacaaccggcagagacataaaatcgtacttgtcgaacatgttggcaacttcttctttatcgtcaagggtttcaacactgattatatttttctccatgatagtgttgataaccgtattatacggtgacagcaaaagctctttaaccgtgaccaaaccaataagtttgcggtcggtgtcagtaacgtagcatgtgtaaatcgtctctttgtctactcctgtgcggcgtattctgtcaaatgcttcagaaacagtcatgtcttttttcaggctgacatattctgtggtcattatactgccggcgctgtcttttggataccggagtatctcattaatgctgttacgcatttcagagtccgtatgtctgagtatacgctttaccacgtttgccggcatttcttcaatgatgtcaacagcgtcgtcgacaaaaagttcttcaacgacgtcgtgaagttcccgctcactgaatgcgtttatcagaagctcctgctcgtcgctgtccatttcaacaaaggtttcagccgccagctcttttgggagtattctaaataatatagggaggcgctgttcatcaatctcgccgagcagttcggcaatatcggcaggctccatagcagtaaacaagactcgtattcgtccaaattccctgctgtctaaaagctcgttcacattgtttctcatttcgtccaaattaatctgttctgccatatgaagcacctctctttccgggtctcaaaatctatcattccgtgcaggcaaagctgtctgtcattttgcaaaaaacaattataacataactcgccggtcagttcaaggtaaaatcaaccaaagatttacgcagaaatatgacttattattaatctgagtctttttttaaattattatacagttttgtgataacagaggcgtatagccgtttaaaaaagccattgtgactgtcctgcgctgagttatacggctgaagagatacaatgctctgccgattaattttttcagagatagcttcccggagtaaaacctcctgacagttaattttgctctgaacattaggtttcatatcataagtcccgtcgctttgcagaacacgggctttgaccgtgtcgctgagacatatgcggatatagtggtttattgcgtcttttatatcttgtgaatatatggggcagccaacctcaactcggttatccatatttcttgtcattatatccgctgacgcaataaacaatttttgttcctcaccttttccaaagctgtatatgcgtgagtgttcaaggaatctcccgacaatactataaactttaatgttttcggtaagccccggaatcccaggcagtatacagcagattccgcgcaccagcatagtgatatctaccccggccttactcgcctcctgaagtttgcagattatttccttatctgtcacagagttgacctttataaatatctgaccgtcttttccctttttcatctcattgtctatatagctaattatacggtctttcattgcgttgggagcaacccacaaatgcttatattcgccgtcaagattagagatggatatattattaaaaaagtttactgcgtcttcgccgatttcatggttttcggttataaatgaaaaatcggtatacagtttggctgttttttcgttgtagtttccggttcctatctgtgtgatatatttcatttctccgtttacatttttggttataagacaaacttttgaatgaattttatagtcgtctaatccatagatgatattacaaccggcctgttccagccgttctgaccaatcaatattgttttgctcgtcaaatctggcgcgaagctcaataatgactaagacttctttgccgttttccgcggcggtacataaatgttctataagtttggcgtttttagccaaacggtatatggttatttttatagacacaacctgagggtcagccgccgaccttttaatcaaatcaacaaacgggtccatgctctcgtatgggtatgacagaataatgtcgtcgttgcgttttccgctcataatattcgtatgggttatctgcggttcaaaatcaggatagcataagctgtcgttctgatcctgattaaatttgctctgaagcccaaaaacatagccgagagacaacggggattttgtggcgaatatttggttgtcagtaacgctgagttttgtacacagaagattttttgtgtattcatcaaactcattcagcgattccagccgaactactgccagacgttttctttttttcagaagctttttcatcttgcttctaaaatcctcatttatttcataagcctcatcgtttggatttatatccgcgtttctggtggcgcagaatatatttttatcactcacggtataccgctcaaaaatattttcaaagtacataaatataatgtcttctatatgtatgtacctgatttttttgcccggcatatagagtatgggcggaagcgcaggcggaattgtcacaattcccagcgaaactgatttttttctctgaacttttccgactacgcatatttgttttgaggcaataaaaggaaacgggtggtgttcatcaaccaactggggggaaagtattggctgaacataatttgtaaagtattcttttacaaatttcagttcgtcagccgtcagcgcttcaggggtgagatgaacaataccatagtttttaagattttgagaaacagaggaataaatagcgtccttttctaaatataacggccgaacggcggagtatatttttgtcagctgttcagtcggcgtcataccggttttgttgtcggttgcctttttgtcggcaatagaaaggtcgaacagacttcccacccttaccataaaaaactcgtcgagattactgacaaagatagaaacaaattttaacttctcatacagcgggacctcatcgctgacagcttcatgcaggactcgctcattaaacctaagccaagatatttctcggttttgcataaatttatattccggtttagcagagttttgactcataaattatcaccccagcctattaaaaatagtttgtcgtttaaacggattattatgtatatattatacagcgaaaaaggccagattgtaaagtaaaatgtatgtaaaatattactaaaaaagtactgattaaaaaataaaggctccggcgaaaaaccgccggaaccgcaaggcatgtatttgcttaattagcagccgcatccacagccgttgtcgcagccgcagccgctgttgtcattgccgcagcagcagcaaattaagataataagaataattatccaaagacatccgccgcctccgccaaatccgttaccgaagcatcccatctgtgtgcacctccttctgtcctcgctgtcagtgggtggtgtgcaatatgctttccgccgtgaaataaaagcatactgcacaccgccccacatgacagtcaaaattaaaatcagttatataagtacattaatgttctgtggtaagaaacaaagccgggaatttattagcagcatccgcagccattgttgtcgtttccgcagcagcagcaaattatgattatcaatatgataatccaaagacatccgccgtttcctccaaagcatccattcatttaataagcacctcctaaagtgttttcactgtatactatgacaaaattaagaattggtgaaaagtttttaaaaaagatttacataatttcaatattatgatattatttcatgtagtgaaaaggatttttgcatatatgctcttacagagccgaacattatgcgatggcgtaaaatatgaaagcggagggatcagttaatgaaaaccgatattgaaatcgctcaggagtctgttatgcagcctattgctgagattgctgaaaaacttggcatgtctgcagatgatattgagctttatggaaagtataaagcgaaactcagcgaggattatattgaaagtttagaggacaagcctgaaggaaaacttgttttggtgacagctataaaccctacgccggctggcgaaggtaaaacgactgttacggtggggctgggagaagcaatgcccaagattggtgaaaacgctgtcattgctctccgtgagccgtcaatgggtccggttatggggattaagggcggcgcagccgggggcggctatgcccaggttgttcctatggaagatataaacctgcattttaccggggatatgcatgcaataacagccgcaaataatttgctgtcggccgcaatagataatcatatccaccagggaaataagctgatgatagacctgagacagataacctggaaacgctgtcttgatatgaatgacagggctttgagggaagttattatagggcttggcggaaaaattaacggatttccgcgtcaggatggttttaatattactgttgcaagtgaaataatggcgatattatgccttgctaaaaatattgatgatttaagagaaagaattggaagaattgttataggctataatttgtcaggcgagccggtaactgcaaaacaattggaggtagaaggcgcaatgactcttctgctccatgacgctataaagccgaacctggtgcaaacccttgaaaataccccatgtctaatgcatggaggtccgtttgccaatatagcgcacggatgcaattctatcagagcaaccagagcgggacttaaactggcggattactgtataactgaagccggattcggaagcgatttgggcgctgagaagttttttgacattaaatgtcgttttgccggattgaatcctgactgtgtggtgcttgtagctactgttaaggcgcttaaatacaacagcggtcagataaagggagaagcgctgaagtatgagaatctggaagccttgagcttaggtataaacaaccttggtaagcacatagaaaatatgcgtaagtatggggttcctgtagtggttgctattaacagatttgatactgatactgacgcggagcttgattttatagaaaattactgcgctgagaaaaatgtgaaatgttcaatgtgtgaagtgtttgcaaaaggcggagacggaggagtggatctcgcaaagaaagtcgttgagactataaagtctgagccttctgagtttaagccgatttataacgttaatctgcctataaaggaaaagattgagacaatagcacgggagatatacggagcggatggagtaacttataccgccaccgctaacaggcagatattgaatctgacaaatttggggtttgataaaatgccggtgtgtatggcgaagactcagtattcgctgtctgatgacccgtcacttttggggcgtccttccgggtttgatataacaatcagagaagtaaacgtatcgagcggagccggatttatagttgcgctgaccggagcggtaatgaccatgccggggctgccgaaagttccggctgcaaataatatggatattgacagaaacggaacaattgtaggattgttttaagcaataatatataggagttgaaatcagttgtttacatcaaaggatatatatgacgttatcgttgtgggcggaggccacgctgggattgaggccgggtttgcctcggcgcgtctcggaatgaaaacatgtattttctccataagtctagacgctgttgcgaatctgccgtgtaacccaagtattggggggacggcaaaggggcaccttgtcagggagatagacgccctgggcggtgagatggggaaagtcgctgacaaaacctttatacagtccagaatgctgaataagggtaaaggtcctgcggtgcattctctgagggctcaggtggacagacggaattatcagatggagatgaagcaccgcattgagcttgagccaaatctagatttgagacaaggcgaaatagttgaggtaaagacagacgataataataacgtgaaatctgttgtcacaagaaccggcgcagagtttttgtgcaaggccgcgattgtatcaaccggaacctatttaaaatcaagaatagtaataggcgagttttctcaggagagcggaccggatggagtgtttccggcaaccgagctttcaaaaaatctgcagaatatcggagttgagctaagacgttttaagaccggtacgccgcctagaataaataggcggagcatagattttgatgagcttgaagaacagattggcgatgatgtgataattcccttttcatttgagacgaatggagagggattggtcaataaagtttcttgttatattacctataccaataaagagacgcacaggataataaatgataatcttcacagatcaccgttatacggtggcggtggaatcgttggaataggaccgaggtactgcccgtcgattgaggataaggtggtgaggttcagtgacaaaaacagacaccaattatttgttgagcctatggggctggatacagaggaaatgtatttgcagggattttccagcagtatgccggaggatgtgcagatagatatgcttcattccctgccgggctttcataacgctcaggtcatgagaaacgcatatgctatagagtatgattgtgccgacccgcttcagctttacccaacgctggagtttaaaaaaataggcgggctttatggcgcaggacagtttaacggcacatcagggtatgaggaagctgccgcccagggcttgattgcaggaataaatgcggctctaaaaattaagggaaaggagccttttgttctggaccgctcagaggcttatattggaacgctcattgacgatttggttacaaagggaaccaacgagccgtatagaatgatgacctcaaggagcgaataccgtctgcttctaagacaggataatgctgatttgcgtttaaccccttacggttatgagctgggcttgatttcatcggagagatactcaaagtttttgaccaaaaggcgtatgatagaagaggagacggcaaggcttcaaaatttgatattcccgccgtcaaaagaggtcttaaattatttggaatctgtcggaagcactccgatttcaacaggggctcgtgcggcggaactgcttaaacgtcctaatataacgtatgagggtatgaaggagatagacaggggcagacctgatataccggacgacgttgccgaacaggttgaaataagtataaaatatgagggatatataaacaggcagattaaacaggcagaacagtttagaaaacttgagtctaaaaagctgccggaggatattgattacagcaaaatagacggtctgagaatagaagccagacaaaagctcgagaagataaaaccgtcatccttaggacaggcttccagaatatcgggagtaaatccggcagatattgccgttttaatggtttatttgaaaaaatagtaaaattgaaatagaaaaataatataaaatttataaaatgtttaaaatgcggacatagtataaaaatatttttgttttataatgtgtaaagtaatttgttttaaaatatagaataaaaggagaattgttatgaagaagatattatgtgcagctgtcgctgcagttttagcagtcggagcattaactgcctgcggaaataagccgagcgagccgtcgggtgctgacgccggtaaaaattcacagcagaatgtgactactgcagaaccggcttcgtcaccgtttgtgccggaggaggttccaagccagtttaaggcgaacggcagtaatattaccgaaaaggaaggcggaggcgtttctgtgtctgttgctccgagagaaggagacgagagatataagtttgaaaatgacgatttaggatttgttgacactgagagcggagctttgctgaaaatcggcatgtcatccgaggatgtggaaaaactcataggcgctccaagaacagttgaccgtgacggttttagaaaatacagcggaatcgttataaaatatgatgataacggaaacgcttcacaaatgattgttgcagccggcaatatggaaggcgatgataatccaaatagatttgtttcaccaagaggggttaagctttcaacaacacttgatgagtttaaatcagtatatggtgatgagtacaacgaaccaagccaagcagcggaaggcgatgaatctataaaatcgtctgctatgatggctgttagatattatgcaaagaacggtgatacttttaactatttgggcggaaactatactaaagaaaataagcctgaaaatgacgctgacttgataatgcagactttcttattctcaactgagacaaaaacagtcagcgttatgtcggtaggaaacggaacagcaaactaaaaaacagccggcttgttatttgtttcaagccggcctgttttttggccgaattttttgataagaagtttttttcgtatagtgtgcgacgtatttcgacaaaataatcgaaattattcacaaatagttaattttttctttacagattattcacttaccaatgcaaaaaggtggtataatatgtattgtaacaagaaattgttacagagttaaaacataactccctcccttttaatttgtaagaccgttcccccaaacggtcttatttttttgtttataattaaaaatatgatgcaaagtttagatattattaacggaaagaaagcgattcactgcaagagagtgattcacattctttaaagacgttatttttttgagtgctgcactcttgcaaaaacaatggttggcgacataatactttctgaattcataaaaatcacctcgtataattgcagtgtcattttgctcttgaataagagctgaattacttagactttgcggattggtttaaatttcctctccgcgatatggttttattggagagcctttttgcgtttttatacgggaaactatagttttcagaaaataatttgttccgcaaagagggcggcaaaattattgagaaatatcagacattctttttttgcataaaaagtttaattccttaatgttgattttatgatgtttaccaacccttttataataaaatatttgctgtaagtttcttttattattgacgtccatatatagtatcttatttaaatacactaatttaataattaatacaaggcttgaatttttcatgtttttgtggtaaggtaatgacataaaatgatataaatttttaaatattttacataaagctgtaaagcagaaaatgtatttgatttgaatatacgtattaatgatgtattgatttctccatatggtatagttcggttaatatatttcttctgaagttcactaaaaaaacactgtatatagaaaataactataaaaaaataaattataaaagatgtggttttgcaagcatcggagggcagatgaaatctgccacgtaaggcgcgcagtcacggaaaaatttaataattatattacaatgaactattctaagtatgttcacgctacgcgtgagatggcagctcacctaacgaggtgtgcataagcacacaatacatcacaactacgtaatttattgacattgaaggctataataaaacaaattactttgtatcacacccaccatactggtggggtcacacctaccgaagttcactaaaaaacaccgtgtatagaaaaataactataagataatagattataaaaaagattggtttagcaagcatcggagggcagatgaaatctgccacgtaaggcgcgcagccgcgggaaaatttaataatattattacaatgaactattctaagtatgttcacgctacgcgtaagaaggcagctcacctaacgaggtgtgcctacgcacacccttccgaagttcactaaaaacactgtgtatagaaaaataactataaaataataaaatataaaaacgagtggtatagcaagcatcggcaggtgtgattgtgaccacacctgccgatgttcactaacaaacatccttaatttttctgtatagctttctgtagaccttccggttatactaaaataagtaattaaatatcacccactttacaggtggggtcacaatttgagtgttcaaaactgatacatataactaaatcatattttatctgttttgagatatagtccgtaccggtaaaatttaagtttcatatattatgttgatttaagaaaggatgaaataaaatggctgataaaaagattaaaggcgtactttttgatatggacggcactatgtttgacacagaaacaatgtcaatttatatttgggcggcaactgctagatattacaatataaatatttccagagagtttatgatggaatgtatgggtctcagcacgaaggctataggagaaaaatttgataaggcgttcggagatgttctgaattatgagacatttcgcagcgctaaaaataaagttatggaagagattgtggaagaggacggagtgccacacaaaaagggtctgacggaaatccttgattatattaaggaaaacgggattaaagccgctattgctacttctacatctaacgagagagccgtgtataatcttgaggagggaaaagttatacagtattttgacgaagtcataagcggagatatggtggacaagagcaaaccggaacccgatatttatttgcttgccgccaagaaactcggtctaagacctgaggagtgtatggttttagaggattcaaaaaacggcataatctctgccaggagagcaaattgtttggcggtgcttgttccggatataataccggtcgatgatgaaatgattgaagccgccgattatgtctgcgaggatctattagaagttattgatttgattaagagaataaataaataataaataccagggcttaaaaaatatagttcaattgttatgtagaatgaaaatatttaaaaaccattgtaaaaggcttgttctgacgtgaacctaaaaatcggacttttttgggtttgttcattatagtcaaaacacaatggttttttgcttatttttaataataactcttttataacacattttatctaaaaaaataagaccgtttgggggaacggtcttacaaattaaaagggagggagttatgttttaactctgtaacaattccttgttacaatacatattataccaccttttcttgtttatgggtgaataatctgtaaaaatcaaattaacagtttgtgaacataaaaaaggcgttatttaacatattatagtaattttatattcattattaaacgtttgaaacgtgacgataataatagtttaattttgatgaaatttattaaaaaaataattggttgatttatgtaatgtattaagtcatataactttcttccgaaataataagttgttatgtaatataagtgtaaagtcgacagaaaactatacagaaaaattaaggatgttttttagtgaacatcggcagggtgtgaccccaccttcaggtggggtcacagacattgtaggtttatcaatacaaagtaatttgtattacacacacttttaaaaaaagtgtggtcacagccctgccgatgcttgctaaaccacagttttatataatttatttgttatagaattattttttatacttgaaccttaacatttgtggccgcttgattgtaaactttttatatttttgaaaaatatataacaagttatcggaaatatatttattctaaaaaaattttggaaatacttcaggaataaaattttaaaaactagaagtcagacggaaataaaatatcttttaaacaagtcgtacttaaatgcgtttgccggaaaaacaaaaagtccttagtttaagcgttagcttaattctaagaactttttttatttatattatttaaagttgtttgctgttaaacaatatagaagattatgataaaactgcgccggtgcttccggaacttacgagttttgaatatcttgcaagataaccggttttaatattcggctcttttggtttccagtttttgcgtctttcctcgagttcttcatcagaaacttcaagcttaatcttatagttcggaatgtcaatggttataatatcgccttcctcaaccaacgcaattgtgcctccatcggcagcttccggagaaacatgcccaatagctgcgcctctggttgcgccggagaatcttccgtctgttataagagccacgctgttgccgagaccgcttccaacaattgcagcagtggggtagagcatttctctcattccgggtccgcccttaggaccttcgtatctgataacgattacgtcaccgggatttattttgttatcataaatagcgtttactgcgtcttcctcacagtcaaagactcttgcttttcctgaatgtttcatcatctcatcacatacagccgagcgttttactacgcatccgtcctcggctatattgcctttgagaaccgccagtccgcctgttttgctgtatggattatcttttgagcgtattacttcgttgtctgtgatttcacatccgcttatgttttcaccgacagttttgccggttaccgtaatgggagatttatcaataagacccattttgtcaagttcattcataaccgcatatacgccgccggccttgttaaggtcgagcataaaatggtttcctgccggagccaaatggcaaaggttaggagtcttttctgaaacaacgtttatggtgtcaaacggcaggtctattccgcattcgtgagcaatggccgggagatgcaaggcgctgttggtgctgcatcccaaagccatatcgacggtaagcgcgttaataaacgcttcctttgtcatgatatctcttggttttatatcatctttaacgagttccatgatttgcataccgactttttttgcgaggcggagacgctcagaaaataccgccggtatagaaccgtttcctttaagacccattccaagcacctctgtcagacagttcatactgtttgcagtgaacattcctgaacatgaaccgcaggtaggacagcagttttcctcacagactttaagttcgttttcatttatttcgcctactttaaaacggcttatagcttcaatcatggtcgaatagcttgcagactcgccgttccagtctgaacctgaaagcataggtccgccgctgacaaaaattgaaggaacattaagtctggctgcagccatcaataatccgggcacgttcttgtcacagttgggaaccataaccaggccgtcaaaaggatgagctgttgccatggcttctgtagaatcggcaattaattcacgtgttacaagtgagtatttcattccctcatggcccattgctatgccgtcgcatactgcaatagccgggaatactataggaactccgcctgctaaagcaacgccctgcttcactgcgtcaacaaccttatctatattcgtgtgtcccggaactatatcgttcttcgagcttactatgccgataagcggcttgtttatctcttcctcggtcagtcccagtgcatagagcagagaacgctgaggcgctgcgttaacgcctttttttatcctgtcacttctcattttatttcaccctcctgtatgtatttgtatattaatcttctgaccttaaattatatcttagattaaagtttatgtcaacctgaaaatatcacaaaccgacctttttattgtaggattacaatagatgtgttacaaagagaaaaaaagaatacggaaaactcataaattgtgttatagttatatcaccataatatcacatatgctttgcaaaatcatcaaacgagtagaatttatgtgttgcataaaaatactcgttatccttacggtgtgaacgctctaccttgccgttatgtctaggtgtgtacggtcttatgagcttatgttgtattccaagttctttaagtcgcttttcaaacatagttagggtcggcttttgggagctgccaagcctcttggtaaactcttgtccgttatcggtctgaacgcactcaatagggaatttaaaggcttttacaaggtgttcgaggaataccgcagaagaatagctgctgtgctcctcaaaagcttctaactcctttgtgtatgtgatattatggtgatataactataacacaatttatgagttttccgtattctttttttctctttgtaacacatctattgtaatcctacaaccgacaatgcaagcttcaggaacaaacttaacgtctatctgtactctctgaccgggatagagcatttgctcgtaaggctttggtatgtatttgggattgggtggtttaacaggcatttgtccctgtttgcggataccgctgatgagttgaaattgattactgatatgcgccgccgtaatcccaatgctggacttgttgtgttttgggttaagcttcgtcaaagaggctctactcgttctattacaggtctttaccgcatactccgcaaacagggacaaatgcctgttaaaccacccaatcccaaatacgtaccaaagccttacgaagtcgtcatactttgccgaactctcatttttctttggatctattgtctttacttcctgacccagcatgttcttttccactctggtagaattattctctatatccgttgttgtcacatacgtcccgccgtctttggttccgtactctgttctgtatgtataaccttttccttcgcttttggctttcggtgttttggtgttcagcttgtttcccatataaagtcgtcatactttgccgaactctcatttttctttggatctattgtctttacttcctgacccagcatgttcttttccactctggtagaattattgtctatatccgttgttgtcacatacgttccgccgtctttggttccgtactctgttctgtatgtataaccttttccttcgcttttggctttcggtgttttggtgttcagcttgtttcccatatatatgtgatattatggtgatataactataacacaatttatgagttttccgtattctttttttctctttgtaacacatctattgtaatcctacaatataataaacaaaatttaaaattcagtcttgacatataaaaaaaatcatgttataatgtcaaagttgaatttaggggtatagctcagttggtagagcagcggtctccaaaaccgcgtgccgtgagttcaaatcttactacccctgccaataaatagcctgaaatgaaaatttcgggctttttttgtaaataaaaggagtttttatatgagttttacatttaaaaaagaaatgccttcagcggaacacttgaaagaacttttaccggtaccgtctaacagcgcagaaatccgtattaaacgcataagagaaatagaagccgttttgtccggcaaagacaacagaatacttcttataataggtccgtgctcggctgacaacgaagattctgtctgcgactacatatcacggctcgcctctgttcagaatgaagtgaatgataaaattcttttggtgccgagagtatacaccaataaacccagaaccaccggagagggttataaaggcatgatgcaccagcccgaccctaatgaagcgcccaacgcttttgaaggtataaaagcgatacgtcaaatgcaccttagagttcttagagagacaggttttgtatctgctgatgaaatgctctatccgggcaaccacccatatctagacgatcttttaggatatgttgctgtaggcgcccgctcagttgaaaaccaacagcataggcttgttgccagcggacttgatatgcccatcggtatgaaaaacggtaccggcggcgataccggagttatgtttaacgcaatttatgctgcgcagcatggtcatgacttcatataccaaaaccatgaggtgactacaaatgggaatccatacgctcacgctatcctcagaggcggaatagacgaacgcggcagaaacataccaaactatcattatgaagacctgcttagaatagccagcgagtatgatgagaaaggttttgaaaaccctgctgtaattattgataccaatcataataattctgcaaaacagtttaatcagcagcctcggatagcctcagaagttatgcacagtatggcgtacgaaccgcttcttaggaaaatgataaaaggctttatggttgaaagttacatcgaagagggtaatcaaaagattggagaaaacagcatttatggaaaatctattacagacccttgtttgggctggaaagataccgaaatgatgatttataaactggctgaccagcttatataataattttccaatcttatagatgtttatacaaattataaaatagtataagagcactcaacttattaataattaataacattatcagcaattcaaacaaaaaaagtaaaaattaacaatgacacaaaagaccgcttatgatataataaattataggcggttctttttatactgtcaaatcgttggcagcccattttctcacgaaaaatataccgcttttataaaccattttatattacgcttcaaattttctttacaagaaaaataacagagagtgataatcacatcttttatctgccttataaattcaacctttgaacggaaaactgattaatattatcctgataccagaaaataatatatgaacttatataaaatattacctctctttttcgtgcagataaagagaggacaaccattgcagcaaatattataattatcattgaaaaggagagaaaaggactgaatagaaagattaaacaattgaagtatatttgaaccatgccccgagaaaaacgcccaatataaagtatagatacttataactaaaaaataaggagttaaactatggataatcaatttatgttatttcttgaaacggttgatgagcgctttcaagattttgtaacccaaataaacaactatttaacagaacaaggatgtaagtgtgacataaaagaagctaaaagcggatatgttgtttcctatattttaaacaaaccaaaaaggactttagctaactttgtaacccgcaaaaccggtatgaagattagaatttatcctgaacacctaaataattaccaagactttttaaacacacttcctgagaaaatgaaaaaggatatacggaaggcgtctgtctgtaaacgactgctcaatcctgatgattgcaatccgaaatgtgtaaccggttattcttttgaactggacggcgagcaatatcaaaaatgccgttatatggcttttatgcccgttttaagcgaagaaaacaatccatatattaagcagttcttggaaagagaattatcatattgcggatgagcatcaaaggtttatttatttcaatgcaggttgatatagttttcggagaatgccaaaaatcattgtttctataagatacattatataaaattcttttaaaaaattatacagtaagttgatatataaaaataaaaaccgcttattccagttaataaggaacgtgcggtttttattaagcttttatatttaagcaacatttatatcgttttatatttggataaaaaatggcaaacaccttttgtgttcgccatctttttattatatcattttaaaatcgtcttttttaatacttactgtcaccggacgttttgttaaattaattcttatttctagctttggcacgaagctgattattcaatatcttttttctgattcttaaactttcaggtgtaacttcaagaagttcatcctccgccaaaaactctaagcaagcctcaaggctcatctgaacgggcggaaccagtttaagagcgtcatcgcttccggaagcacgggtatttgtcagctgttttttcttacaaacattaacgttcatatcctccgctttagggtttattccaacaaccataccttcgtatactttagttcccggagtaataaacagcgagcctctgtcctgaaccttaaacaaaccgtatcctacggcttcaccggtctcaaacgccaccaaagaaccagtgtgcctgctgcttatctcacccttatatggctgatactcataaaagactgagttcagtataccctcgccctttgtatcagttaaaaactcatttctgtatcccagcaacccgcgggcaggtattaaatattcaagtttcattcttccgccctgaggagccatcgaaaccatttcgcctttacgctgtccgattttatccattaccgcgcctacgctctcttcaggaacatcaataataagtctttctattggttcacattttactccgtcgacttccttatacagaactcttggagttccgactgaaaactcatatccctcgcggcgcatagtttcaatcaaaatagaaatgtgcatttcacctctaccagcaacattaaaactgtctgttgactctccttctgttaccctcaatgaaacatcctttaaaagttctctcatcaaacggtcgcgcagctggcgtgaagttacaaacttaccctccctgcccgcaaacggactgtcatttacagaaaacgtcatctcaatagtaggctcgcttatctttacaaacggaagaggagccggatcctcaggtgaagctattgtatctccgatagttatttcaggaatacccgaaaaacatataatatccccaacttttgcctcatcaacagcagttctgttaagaccgtctatctgataaagattaaccatttttgccttatatggttcatggttattatgatattcagataccataacttcctgattctgttttacacagcctctctcaattctgccgattccgattctgcccacataatcattataatctattgaagacaccagcatttgcatagggccatcagcatctccctctggcgccgggatataatcttttattgtttcaaacagcaccttaaggtcttttccctcttcatactgggaaagcgaagcggttcctgccctgcctgaacagaacagtatgggactttccaactgttcgtcattggcgtcaagctctataagaagatcaagaatttcatcagggatttcatcaagtctggcgtcggctctatctattttattaaccacaacaataacacgatggttcatttcaagagccttttgaagcacaaatctcgtttgaggcataggaccttcagcagcgtcaacaagcaaaataacaccgtttaccatcttcagaatacgctcaacctctccgctgaaatcagcgtgacccggcgtatcaattatattcatctttataccgtcgtaatatacagacgtgtttttagcaagtatagtgataccgcgttcacgttccaaatcgttgttatccataacgcgttcctcaacgacctggttctctctataaactccgccctgtttcagcatttcatcaactagcgtcgtcttaccatggtcaacgtgtgctattatcgcaatatttctcaaatcttctcttaccataaattttactccttctaacaagaaaatagacacggcactccgtgtctcttacattttaatattataccacagaaaaacatgttctgtaaacgtaaaatatattcaaaatttgcaaataatatgcaataaatcttgatatatttttactttttatataaaaagtttgttctcttttctgtcggcgcaaaccttatgaagttttaaagacaccatctttaaagcaagcttggaaacagctctggctccgttagggcaaacaggaacgcatctcatacaggcaatacactttttcgaatctgctttataatcttttcctatagctccaaccggacatttttcagcacatataccgcaagatacgcattgtttagttggctgaggtgaaaatggaaccccgccaaaatcacggaacttctcatttccgggtatattttttatcccaattatattatgtgaatttaaaagtttgtttttaaactctttcgcataatcttttatttctttaatatctttactatcaggtctgtcagccgctatatcagtaactatagaatgccttgaaactatggaagccgctcctgcaacaacaaatccgttgttttcagcaatgcttctcagctcagttaaagtatcatcataagacctgtttccatatgtagttaaaataaatgcaggagtattatttcccctaatatttttaattctttcggcggcaatagccggaacccttcctccaaatgacggaactccaataactgctaatgtatttttgtcaatctcacaaccatattcctcgttgtcggttacatccaaatattcagccggctcaccaaaagccttgcagaacaactcaataaccctttttgtattacccgtagcgctaaaataaattgctttcactccattaattttcatttcttctcctcttttctaagctagaatccaaattccatcaacgtcactatgtcttaatttaaactcattatatgcctttactgccaattccctatcatcaaacattccaaaaacagcacttccgcttccgctcatcatggcaatatcagctcccaaattcagcatttcagctttatatacattaacctgcggacaaatctgtaccgccgaattctcaagtatatttcccataaatggctgaatctttttcaaatctccagactttataccggaaataattttgtcaatatccaaatttacaggcttattattataatcaagatgctcatagacccactttgttgaaatactctgtatcggtttggctatcaaataacaaacttcaggaagttcgggcaaaaccgtcaatctttcaccaatgccctcagccaaagcacagcctcccataacacagaacggaacgtcagcgccaagcttttcacccattttcattctttcttccaaagataacggagaatccaaaagcttatttaacccgtttataactcctgcggcatcggaactgcctcctgccattccggctcccattggtatatgcttttctatatatatatcacagccgccatcaaattttatggctttaaaaaactcattggcagctttccatgctaaattgctctcatcaacgggcatatttatatcacttccggcaatttctatcccctcctcatcttttaaagatatggttatcacatcaaaaataccaacctgagtcattatcattctaacttcatgataaccattcggatattttccaagaacatctattgcaatatttattttggcgctgcatttttcagttatcgattttaccattacttacctccgcatttataccagccaactcttttcctgaattatactccttcaatgaataaatgtcaattatacaaaaaatacgtctccataaaagagacgtatttacaatattataatataaaataattaacttcaaaatttattttactgaacagaaagcaccaactgatctcttcttatatatccctgatttccatcataatctaccctggcataggtatcagaaacaatctccacaagaccaacaggcgtctcagccgcaagagttagaataatgcctgctccgcttcttggctggtcaagcatctctacagcgccggaacgccaaacatacctgacagcggaatattgtttcggcggagaataattcgataagtaaaacttagctacatatccatacatattgtcatattttacacgagcgtattcgctgtttgcatcctcaacatatcctatccgtgttccataaggaatggtagttataattgttgatgatgcgcttggtttctgtctaaaatttactgcattcgccacatttgtaacatatctatatccgacaacctcctgagaacgctcatacgctgcaatctcatcctcaatttctcccctaagtatttcagcggtattgcgcacgtcatcgcttagattcccttgctcaaggaaagcgttcactctggcataagctccataatagtcaccgttttctaccatttttctaatatcatttagagtacggtaaggcaaataattaatttgttccttaatatctgaaacaagttggttatattcgtcaaccaacgccggagtagttctgtacaaataaaaatcactcaaagcgtcagccgcctcataatacagtccctgattatacaaatttatagcattatcaagatatgctcttgtatcagccagctgctgttcaatctcgttaggcagtccattagccattagttggatatttcgctcagttgtttctttttgagtataaaactcagcaagaccaataggatttataattcttgcggattctatttcactatctgtcaccaaaccaattatagcttgtgcctgataaaaatcaccgttaaaattataattaataatattagttagcttatcctcaaacgatgctttatagtaaaccggtaagtttgttatattactataagatgaatcactgttaataaaaactgtggtggaagtctcgtcccatttcacactcattcccagcttctcagatacaaatctaaccgggaccattgtcacgctgtcatttaaaacaaaaggagcttcaggaagctggtatactgcatcttttccatccgtaacattgacgcttccaatagtcatatttaaaattatattttctttagtaatagtaacgcattgttctgcctcgttccattcaacattgcaccccaatgtctcagagacaattcttaccggaacaaaagtagtatcatttataactacgcccggttgcgaagactgaacaactttatcatttacataaatagttacattgttataatcagcaaacactgttccgcaaataagacaaaccattgctgcaaaccccaaaaagctaaaaaatacctttttcataacactgccccctttaatatattaccttccttttatactattattatacaataaaacttttgttccgtcaatcatatttacgcatttgttaagaacaaatattttattataaacatttatatatcaaacgaaataattcgacatttttcttaaaaattgttatatcgttgtaatttttatttttataaactatattgacataaatattttatcgtgttatactgtgctcgtacaaaattaaaggaggcaattatatgaaatttgtaaaaagattattagtcataacggcagcgtgtgcaatgatactaagcttagcgtcatgcggaaacggcgactcaaacaaagcgactgataccatgaagcaaactgaaccgacctcagcatcagattcggctgtaacaaatgaaccttcggcaagcgatgaaatcggaaataatgtcgatgatgtaaaaaaacaggccgaagctatcgaagagagccgcgaatccctcagagctcttattggaaaagcgtctactctcagttctgaagaggacatagccgcatggggcaaagaattttctgatattaaaaatgatttagaggaaaaaacaaaaactctctcagacactatagcaaacgcccccgaggaatatcaggaatcttacggaaaaatatcagatgctgccacagctgcttatgacgcaatggccggttttgaatctgctgttacttccgctgtcagcggagatgtatcagagtttaaatcaaaagtttcagactttttgggcaaaatgggagatgcagacaaactctgggataacgcagaagttagataacatcgtgttataatataaatattaagtaaaagttaaactattgatatgcaatagtttacgcggttacaattatttaaaattaatatatttttaaaagtagtataaaaataagcatagtcaaaagttttattaagctctgactatgcttatgttatattaaacgtgtgttatacaatattaacatattatactttaaatcatgtaaactaagacttggaataaaaagattacatttaaatcggactgaaatattaaatttaagtattataaacataaaaatatgatttagcaagtatcggagggctgtgaccacacttttttaaagtgtgtgttatacaaatcaattgttttgataaagttgtaatgtctgtgaccccatctgcaaggtgggcgtgatacaaagtgacctgttttaattagccttcaatgtcaattgtggctacacttttatttgaaagtgtatgttatacaaaccatataatgttatatatactttaaacgccaataattaacttagttgtcatatataaataacttggttgtgatatgcagatgaaatctgcctcgttaggcgcgcagttccggttacttttactataaaagaattatgataaactattctatttttattcacgcttcgcgtgagatgaatgttcacctaacgaggtgtgcaagcacacaatacatcacaactaagcaatttattgacattgaaggctaattaaaacaggtcactttgtatcacaccaacctttacaggtcgggtcacaccctgccgatgttcactataacacactatttatagaataatatttctaaaccaaatttattataaattgtggttttgcaagcatcggcagggcaaacgcagtttgccgcgttaggcgcgcagcttcagttatttttactataaaagatttatgacaaatttctctacttatattcacgcttcgcgtgagatgacagctcacctaacgaggtgtgcaagcacacaatacatcacaactaagcaatttattgacgttgaaggctataataaaacaagttactttgtatcacaccaacctttacaggtcgggtcacaccctgccgatgttcactataacacactatttatagaataatatttctaaaacaaatttattataaaatgtggttttgcaagcatcggcagagcaaacgcagtttgcctcgttaggcgcgcagttccggttacttttattatataagaattatgacaaactactccatgtgtgtttacgcatgcgcggtgtaaaataaaaattattgccgcaactgatcgcagagaacaaatacaaaccttaaacacacaaaatttagtatctgctcttaacaaaacgaacgccttttaatttgggcgtccgtttcgatctaattaatattatccgttctgcacaatcactttaaaaactttctaattatatttttggctataggaaccgcagactttcctcccgaagttgccgcattttcaagaaccaccgcaacacatatagtcggattttctacaggagcataacctacaaaccaagcatggtctttatcagtttcattctcagctgttcccgtcttgccggccactgttataccgctgatttgagcccctgtacctgttccatcctcaacaacgcctatcatcatatcttcgatatagtcagcacatgcagttccaatgctgtcatataaaactgaaggctttgtctgtcctataacagtcccgttctcggttgttacagtctccacgagatacggtttcatcatctttccattattagcaacagcgctcgccatcattgccacatgcagaggagtcataaccagcccaccctgtcctatagacaccaaggcgccgtctaaatctgtcatctttttatattgaatctgactttgtgaaaccggaatatcaaagtcaaatgatttgtttaccccaaacttttcagcttcagcttttaccgcgtccgcacccatctcataccctaaagtacaaaacacataattactggacacttcaaatgcggtctttatatctaattttccaaaagattctttattataattatatactgttacgtcgtcttttttaaataatccttcatcgtcaaaagtttcagtggtcattccgttgtcatacactcctgcagctgtaacaattttatatgtcgaacccggcggatataacccctgtgttgcccttgctaaaaacggtgaattctcatcctccatcattgacggccaatccttttcaattgtttccggattaaagtcgggcagactcaccattgccaagatttgtccggtagtaggttccatagccacaatagctccatcccttccgtcgagctgttcatatgcgtactcctgaagttcatcgtttatagtaagattgagattattaccgtgctttatctcattcaaagtcaagcttattgtgccttttccaataaggtcatcatcatggctcatttcaagctgagtttttccatacacctgagaacaatatccgattatgtgagaatataatcttccctttggatacttcctgattctagcgtcaccgtctatctccgtttcggcaagcagcaccccgtcctgagaatatatctctccgcgctgaacctgctgttcactctcccactggcgtttattatatgagtttgtatacacatccttggcacgaaacatattaaaccacaataaataagttaccagcgccaaaaaaagcagcgagatggcaatcaggacgcgtatgattcttttattcgtcctcattttcggtcatctccccctttctttctgtcttcgcggatattgcctgaactattcccaacgaagcaaaacttataactatagacgtacctccatagctgacaaacggcagtgtaattcccgtcagaggtatcatttttgtaactccgcctataatgataaatgtttgaatagcaaacataaccgtaacgccaaagctaacagctttatcataagggtcgctggccataattgaaatcttaaaacatctgtacgcaattaagaaaaacaataggattactgcaactcctccgaaaactcccatttcttcacagatagcagcaaatataaaatctgagtgaacttcgggtatataatacggcgaaccgtttcctaatccgcgtccaaaataaccgcctgacgcaatagcaaaaagcgactgtgtaatttgatagcccttactggctatatcagaccatgggtcaagccatgttgatattctgacctgtatatgatacaaaaacttatatcccaaaataccgataattccaagcgcacctatatttaaaaatagtaattttttgtctttctcatatacatacaccataaacaaatagatagagaaaagaaccaatatagttccccaatctctttgaagcaccaaaaatcccacaaaaatataagtaatagccaaagttatccacttcggagaaagttttcccagcacaggcttagaccatgctcccgagtaatagcacgctaagcacattatatacataattttagttatctctgagggctgaaaagtaataggtccaaatgatacccaattctttgagccgtttatagtagttcccaaaaccagggtgaacaaaaacaatcctacaccgattgcaaaataaatataccaaaatctgtcccatattttaatattataataaataaaataagctacaaaaaaagctgcgccgcctactagtatccaaatgatttgcctgaaaccgtaatcgaggtttatgcggcagagcaataataccccaatagacataagcataaacgccataagcattataaacttgtcccccatacggcatatcactaaaactgtatacatgacaagaaaaagaacaagaacggctatcccggtatataccacgttcatattataactttttgatatatacagcagtccgaatccgagtatatccaataaaatcaaaagataagccggctttctgtaattagccgatttaatacgttctgttcccattttctcaccgccaattcttaaaaatataatttatgtctcaaatataaaattcaagccgccgaccgtaatctgatcctcggtatcaagtataacctcctgccggattctctgcccgttaacatatgtgccgttccggctccctaaatcctcaagataccattcgccgtcttcataccaaataattaaatgcttctgagaaataaatttctcatttataattatatcacactcacggcttcggcctaaaattgcttctccataaatattatacctatgtttaagaggcgctgaaagttcaacctttgattttatcggtctcaggcttgaacacgccgcatcatttatactattgtcctcaaaccggctcatttttttgacatccagatagatcagcctgatgacaaaaataataaacacatatattataactgtaaaaacatagcttaatatcgtggaaataaaactatatatagtcatgttgcaatctcccttcagtcaaacctagtattcattccaataatcatcgtcgccgccggcgtcggccgcgttttcattaacaatcttatgctttttctccataaaccaaagaagaagcgcaaaaattaatccgacagcaaaacaccccaagtataaataaacaattggcggaggatcaaatctcattgttgcaagcggattataaaaagcggcgcttgatttatacccggattcccctgcgtcaaattttgccggcgcaacctcgcacatacgttcaaaaagtctatataaaaactcagcggcagaactccggtcaaatctattttcagtttttgtaagcgacattccgtcattaataataccttctcttgcaccaagagcaagttttcccaatgatgcttttttcatatactgaatatcaggataattcaaatatatacttgcatacggtctgtctgtatcattccctaaatcaggaagataatatcccttatagtcaacaagcaatgccaagctcattgtaaacgtgtcttcgagacccacagcggaattaccgttaaatctaaggccaccctggtcggaataaagctttatccccgcctcttctatagacgccacatacatagactgtgggtccgactcgtcaacgtcattatattgcgccctcgcttcagtatccaccgtaaacaatattccggaaaccgctctggcggcatcataattggtatattggtcatagggtctaaaacgcccgcctaccgtagcaaagtaatcttttgagaccaacagttttatatgcttctgctcatcttcacttaaatcaccaatgtcagaaatctcaggaacacttgctttcactttaaatagaccggaagtgtttgtcttaaactcaagagctttattactggagtcaaatattcctcctatattaaagtccctgccgtcgctggttgtaaacacgctgtcataagcgttttcagcggggatagaaaagttgactttagccggcagtttttctatcctctcattattttgatcaaaaaagtttattatatatccgccgccgattgcggaacccatttcaacagtaaattcaccattatcatcaattatcctattacaagttgctttgtccatgataacactgtgactgttatcgcctataagtatacgcatgttagatattcccaaatcatcatcttttaaatcactgtcaaaaataatttttggaggcaaagcgtcatttaattcttttataactatctgtataggaacaacaatatttttgttaggtttgatatccttttctcctgcaattttccataattcctgactggttgcagcagctgcaacagccgagtctctgatattagtcaaattaatatttacggtattattctcagctttaagctcaattttagaatttctcagacaagccgctgatatatacgccgcaatatcgtttacacccggaccattcggagaattttctccaagtcctgcgagaatttctgttaaataatcgccatactcttttatggttgtaaacccgccggtacgctcatagtcaatatttatattagacaaagcctccgaacccttatcggcagcgtctaaaaatcccattttaatgtatttatcatcaattgccgaaacagtaccgagctccgttgcaacatatcctgagctagtatcagcagttttcagttttgcataatataatgaaccattgtgcataccttcagctgattccaaatattccggaatataatgtactaaaaacgttccgtctttcaacttaacaaagtactgtattttacagctttccggagatcttgtccacatagttccgctcgggtcctgctgcggcggatgatagtttccgtctgtatggtctatgtaataatcatcagccacactgcgcaccgcgtcaggagtatctgacaccgcaaaagtattcttaacgcagagccgaagagttgatggagtaaccgttttagtatttccgtctataggagcgttagggttttgcctgtcgcgcttgctgtaagccaaaaactgccaccaaattatctcagacatctttttagtccatttaccaggatccaatacaattttgccgccgttctctccctcaaaatctgttgtataacacgcgccgaacctacaaagataatcactaagagaatttctctgctcattgcttaatgaatgcgttatatcagtataatcttctgtcgcctcatcagcaaatgccggtacctgaaccgtcacacaagagaagacaactgcagtcagtatcagataatatataaattttctaatcatgtttttattccctcatcctagaatactttattacaaaacataaaaaactaattacaccaaatatttataacgcatagttttttaatcaactgttataaattaaaatcttcttacacaaaacaaaaataattattgtgcaattataaaaacactattgcttttactgcattaaaaaatatatttttacaagagtatatccctatatttaaaaaattaatatggtacattaatcttaaaaacaaaaagagtatacagcactaggataattataccacattttttataaaattcaacaacagtttaattttttgtataagttttcagaaacaatatttttctaaattcgaacttatacgtttttataaacttttaaggcccctcaatatccaccgtggtattctcaaagttaaaaatttaagctttcattaattagaatcatgagcggcttaaaattatttacaaaaaccgtttaaagtcaataccagaattcatacagaccctaaaatgagaaactgaccttcctaaataatttactaagtataactttttatgactttaagcaaccggtcacgtataattaccttttttatctacttatttctgttgtcagttaacggatctaagaatatctaatctgtccagccagtttatattctcctaactggtttttgatgtagtcaaatattaacttctatcacttcatactgtatctacataatattctatacatctaacatgtctactaacatatttgtaatttaaattttcatgttcatataatatcactaatgagctctttttcctttagatattacataaactatatcatagtcaaatttgtgaatgttcatcagcatataaaaatgattggaatatgtctatgcttctatgtttctatgtttctatgtttctatgcttctatgtttctatgcttgctaaaccttcttcaacgttccgcctgtaaccttctttaacttaccatagatttatttggagctattttttagcacaatgctattaaatatttgcatctattttttaaaatgaactatggttttaacttctatcaattttttcttttttattttgaactttcttaatactctttcattgtgtttttttatatctttactgattatgctattgtgaatttctagtttttgccaaaacttttatccacatataactaacggaattccaacgctttaaagcgctaaacaaaaatatccggcggaataccgccggatataagtttaaacaaattttataaatacatcaatattcaataatcttattcagctgtatttgatgtacgaactcttgaaagcaacgctgctgattccgcccttgtagcagtcgcctgtggtctgaacattccactgtcgtcacctgtaagataacctgcctctgtcaaacctgttacatatcctaaagcataatccgcaatggtatctgcatcagtatattcagaagcagtttcagatataagattgagctttcttcctatgattgttgccatttgttcacgtgtaactgtttcatccggtgagaatgttgtttcgcttgtacctgttactatacctgcctcagcagccgcagcaacatattcagcataccattcatctgccggaacatctgtaaacgctgattcagtactcgaagactctatttcaaataacgaaactgccattttagtaaattcagcacgtgtaacattattctcaggataaaaattgccgtctttatccccatttactatattattagcatacaaatccataatatagctgtaagcccagtagccttcggttacatccccaaatatctgacctgaaggtgacgctgtaggagcaacagttacttcaggtgttgaagtaggcacaggactttctgatactgccggagttgctgttggagtcgatgttggatcagtactattatttgtatttcctgatggtttagatgttggcttagcagttggagcctctgttggctctgccgttggattaggcgttggcacaatatcgcttactacgctaatttgaattgttggaagagacgcttcaagattgttcagttcactatctacaccattaaatttttcaatctttattgtttgtgttccatattcatccttgtcttttactctaaaaaagatttttgcaacagtattagaggtgttttctccttctgcataaacagtggttcctaatgttccaaaaacaaaatgtcttgtagtttcattatagcccgataattcttcccaatcgcttgaattgttaccaagttcgtctatgcttgtataaaaatttacatcactatattcaaatatatttgaattaaatgataagtcaaatccaattattcccgaatgaaacgactcatttgatgataaattaacgtccacctcaaacgtatctccgggctgtacagtatctgtcgatgatatcatatttatagttatagatttatcagaattgtcagcaaatacgggaataacaactaaattaaaaatcataactatagaaacaaatatagataattttttcatgcttctcataagtggttctcctctcgcagttaaattaattgtatatagcaaaatagcaaaattttaaaaaggagacccgaggttcgggtctcccttatagctaacttaacctcaaattacttagaaggtgttgcagtagcttccggtgctgctgttgctgtagccactggctcagcactggcagtagcttccggctctgcgctagcagttgcttccggagcagctgttttctctggtgctgctgtctcttcaggagttgacattgttgcctttactcttgaaagaagtgcagcggcttcagaacgtgctgctgaagcagccggtctaaatgtaccgtcttcttcaccggttaacagacccttttctgttaaaccagatacatacggaactgcataatctgaaatagctgcagaatctgtatacttcatagctgctttagatgttatatcaagataacgtccgattattgctgccatctgctcacgtgttacatcatcattcggagcaaactctgtttcagatatacctgtaacgattccagcttctgttgctgctactacatacttagcgtaccattcatttgcaggaacatcagtgaactgagattcagttgatttagaatcaagtccgaagagtacaactgccatcttagtaaattcagcacgtgttacattgttctcaggatagaacattgtagcagaagcaccgtttacgatacctgcatcatagagatccatgatgtagctgtaagcccagtatgttgacggaacatcttcaaatacctgcttacctggctctgttgtaggtgttggagcctttgtcggagccggtgttgctgtagctttacctgtattgcctgtgtctggaccgctaggaccgctgcttgagcccttcttagatgtcttagcaaactcatatgttacaactgctgtcttaccatcagcgctaactgtgatactgtcagcatcataagaatttactgttgcaactgcatctgcgctaattgtgcagttttcatcagctgtagcggtaaatgtaattgtataaactgtattataagcatatcttgactctacagccggattccaagaaacgtcgctaagtttataacgtgcgccttcaggtgcagtgatatcataagataccgctctatttgaagccggggcagttatagaaccagcaattgttgttatagtagccggatcagcagaaggtgtcggcactgaacctccgaatactacatcaactgaagcattctgctcaggcattacaaacttactgtctgatactggaatatctgtaccgtctgcagctttaacagttactactgctgttgcaccagcgatattagatactgcattaattgttactgtatcaccggcaggaatgatgtactgagcgcctgctgtatcagcagcaacacttgcagcttttactgctggtgtgtaaactaatttagctaaagcgacattgccgtcacaagaaatcttaacttcgctgtttgcaactacaggtacagtctgaacaacaaacttcttatctgtaccaatagtttccacgatagtcttctcgctaccttgttcaactattaagttacgaatatcagtattaggtttatcaggactaccatgttttacatatactgttatagcaccatctgctgacggtgtgtaagttaagtatctagccgcagcagtagtcttaccgccaaacttaagagcgccagttacagtctcagttgtgccattctctaaagtaaattctgtgtcagtttttctatcaacttcaaatgcatccttatactctatcttattctcatcaattgttccatttgaataggacattagactattgcctaaatccacattacctacataccactctttttcagcgccacctttattaacaagctttgttcctgcaggagcatcagcgaatgtccattctactgatttaccaggaacaggtgcttctgtaacaattggtttttctgtcggaacaggtgcatctgtaactactggtttgtcagtaacaaccggtgcgtctgtaacgataggtgcatctgttggaacaggagcttctgttgccggggcaactgtcggataaacctctccgcttgcatttgtaagagtacctgtaccatttgttacattcaaagtagcaatatagttttcaaccggtgcagttgtagctgttggaacaggaacagctgtagctgttggaactactgctccgccaatagtaacacttgtagaattcattgttgccccaaccttatccaagttagcgtcaacaccattgaatgttgtcaaattaatagcctgagcgccgtcaggtgcattatctttaaccttcaaagtaacaacagctatcggctgatgttttgcatggtcagctgtatatacagttgttccaagcgttccaaatacaaaatgatttgttgaagcattaaagcctgagtttgcttcccaatctgatgtttggttacccaaatcatcttcataataagcaaatttaacaccttgatattcaaatacatttgtatcaaatactaaatcaaatccgattatacctgatttaaatgcctttgcagaagtcatatcaactgtcatatcaactgttccaccttgtgcaacattttctgcagatggtgtaacatcaatcttaacagtctgtgccggtgctttacctatctcaacttttgcagaatttaaagtgcttgaaaccaaatccaagttactgtcagctccgttaaaagtctcaatagatatattctgaactccgtctttagcagtatcttttacttttaaagtaactttagccagtgactgacgttttgcattgtcagctgtgtatactgttgtgccgagagttccaaacacaaatttatttgttgaagtattaaaacctgagtttgcttcccaatctgatgccttattaccaagatcatcatcatagtatgtaaactcaacattttgatattcaaatacatctgtatcgaataccaaattaaatccgattatacctgatttaaatgcctttgcagttgtcaaatcaacagtgacatctacagttccgccttgttctacaaactctgcagatggtgttgcgcttacaactactgaattatcatattctgcagcgaaaactgaaccaaatgacataaggctgagaaccatggctaccacaacagtaattgctgtgatctttcgtaaatttctcattaattaaaactccttccatgaaaataacatatttcaagtagtattgtataactgactctcgacagattgccgggagtcagttattaaataaatttctcttattgttctacggggaaatttgtgatttttccagcagcgtattgcattataaggattgcatcccctgcattgataccatcggtaccactaacatcagcagcagtcttctgatcatcgctgagctctgttttaccagctgcatactgcataacaagtattgcgtcacctgcattaatatcagtatccatatttacatcaccatacacaactccaggagctgtttttaatgaatatgacttagcgtcaggtgttgaaacaccggttcctccgatttttacaataataattgaatcatcattgtagtcagtctgtgacagcttaaatgaatatgtaccagaagcctgaccgtcatactggttgatataacctacaggtgttgtagatgtaaaaccaactgtattgttctgatcgcctgtgatacttgtgatatcatatacaaagaatgtcatctgacttggtacctctgtaccggaagcaattgtaaacggaacgtttacattatagtatccgttagcatcgtcttttgaagctgaaattttacctatctcaactactgaaccagtgtcaacgtcatcaatcttagattcaagattaacatcgccttctgtaaccggcgctgtgtcaagcggtatgtttacttcttctgaatctacaggagcttctgtaggaacaggagcatctgtatcctcagcaggagccttaacgtcttcttcaggtgcttccacatcttcaggcatagctgtaggctttggagcttcaactgtatctgtaacagatgcgtctgcattattgtcaacaacatctccctcagcgaaagctaaactagctgttgctgaaaacatcattaatgcagctgtaagagctgcgccaaacttaaaaattctcttcttcatttaattttcctcctaattttgtttgtttataaaatcgtcgatttcttcccaattaaatctgcaattttaaactacaatctcaaaattcgaggttatcctcctttccccaaaaatgtgtaagaaatgcggatcacagaacataacctttaagtcttaggcaaacacccaaaacaaccggaaatgtgcatccggctaataggttcaaactgataaataacgcattttatttatttttcactattatgatacgttagtattatacaacgaatgttcaaaaaaatcaacccctttttaaaaaataataaaagtttttctgaaaatacaaaagtaattgactttttatgtaaatcgtatataattgtgcttatgaagaatacaaagaaacataaaataataaaatacatgacatatatattgttaatagttatcataataactatgttttcaggctgctcggcccagtatcaaaccatatctgacacccaatttatattagataccgtatgtaccataaccgccggcggtgtgaaaaatacaaaagaattgatttcaggcgcctttgatgtcgtatataaaattcaaagcaatataagctattatgattccggctctaccgtctccatatttaacagttcgcctgctggtgttcctgcagcgcttgatccggacacatatactattgtagaaaaggctcttgaagtttccaaagcttcgaacggagcctttgatataacaattgctccggttgaggaactatgggatttcaaatcagaaagtccggttcctcctgaacagaatttgataaatgaaaatttaaaatatgtcgggtataacaacttgatacttgattctgaaaacaaaactcttactaaaaccattgacggtgtaaaaattgatttgggcggatgcggcaaaggttacgcttgtcaaaaagctttggaatatatagaagaaaactatcccgattcatacgctatactggattttggcggtaacgtaagcgtttacggtcaaaatcccaaaaaaataaacggaagttttacggttggaatccaggaaccttttgcggcaaacggaacttattctgaaatggttgatataacttccggggagagtatagttacaagcggcacatatcaaaggcacttttattataacaacaaaaactatcatcatattctcgacccatcgaccggaacgccttctgacagcggttttgacagtgtcagtgttatttcttcatcatcacttgaagcggactgtttgtctaccgcctgtctggttctcggagaaactgacggcacgaagcttgcaaataaatttaacgcaaaaacgtattggataaaacaaaggagcaattaatattaatgaaaataattaaaaatgccaacctaataaccatgagtgaaaaatatggcaatatagaaaacggatatgttaaaattcaagaccataaaattatagaagttggaaaaatgtctgacttttcagatagcaatattgatgccgagataattgaagccgaggggagaattacaactcccggtttggttgacgcacactcacacctgggaatgtgggaggacggtttggattttgagggtgatgacgggaacgaagataccgatccctgtactcctcagctccgggcgatagacgctataaatccaatggaggcgtcttttagagaagcttttgcttccggtataacgactgttataaccggcccgggaagcgctaatcctatcggcggacagctggcggcaatcaaaacatacgggaagcgtatagatgatatgataataaaagctcctgttgggataaaaattgcttttggtgaaaacccaaaggctacctataacgacaagagccagtcgcccagtaccagaatggcaacagcagcattgataagggagacgtttaaaaaagctcaggaataccaaaggcaggttgagcagtaccaaaataactctgatgaggaagaccctcccgaatatgacataaagtcagaatcgctgttaccgcttttaaatggtgatatacccctgcatgcgcatgtgcacagagcggatgatatattcacggccgttcgaattgccagagaatttaatcttaatttgatattggtacactgcacagaagggcatttaatagctgagcagctggcagatgatggttacccggttctgctgggcccaatactcactgaccgaagtaagccggaactgaaaaatcaaagtgaaataactcctgccgtattatcagaggctggactgaaaatctcaataataactgatcaccccgaaacgcctgaaaagtatttaaccctatgcgcggctatggctgtcaagcatgggcttagaagggatgaagcattaagggcaataactataaatccagctgtttcctgcgggattggagacagagttggttctatagatgacggaaaggattcggatattgttatatgggacggtgatccgctcgacataatgggcagtccgtatgggatagttatataaaacatgccgttttatcgcaataatataggttttgctccgcatataatttttgcggagcttttttattttgtttataataacacatattatgatgataaatttttatctatatttaatattttattttaagaactaagtgttatttttttatttatgcctaaacgattttaaatactctgtaatatatttgatttatagaaaataatattacaaaatctaaggctgcggacaatattatccgcagcctttaagcataattttatcatttatcagttcttaaatagtcgtttatttcattgacaaaaagttccccatacctttgaagcttcgcgcttcctacacctgatactgtctcgaactcatccaaagtctttggaagtatcctgcacatatcacggagcgatgcatctgaaaatataacataagccggaacgctgcctcgctcagccagctcttttctgagatccctcagctttgagaacagaccctcgttaactgtttcagcctgcaccggcttcttcttagcctttttctccttcggtgctttcatcgaaagccgatctccgccaaataatatgctttttgacttctcagtcggtactaaaatattaaaattatcctcgtcttttattatataaccgctctgaaccaaaaattcaattatattcataactctggtcttggtcataccggacattattccatacgtagttaactcgtctaaatgcctggaaataacattatcgttttttgaaccgcacaaaacatcagccaccatgtttttgccgaaagcgcgtccttgacgttttatcctatatatacagcttagaatcttctgcgcttcctcggttatatccactgtttcaaacctagtgttgcagtttgagcagctgtcacagcatatcggcgctgtctcaccgaaatactttaaaataaaacctctgagacaatcatatgtagtgcaataaaacgtcatatgcttcagcagttctaaatccttttttataacctgccggcgcatttcctctgtcatttctaaattttcgtttccgttttctatcagaaacttattgattctgacgtctttcggggcgtaaagcaatacgcactcagccggttcgccgtctcttcctgcccttccggcttcctggtaataactttcaatattcttcggcatattatagtgaacaacatatgaaacgttggacttgtctattcccataccgaacgcattagtggcaaccataactgtttttctgtcatatataaagtcgtcctgatttatgcgcctttcctcatcatccaaacctgcgtgatacctggtagccgcaaaacctctggagatcagttcgtcacatacttcctcaacgccttttctgcttatgcaataaactattccgcttttttccttattctgcggacggttgagtatatccaccaaagcattaagcttatactttggattctgaacctcaaaatataaattttttctgtcaaatccggtaaccatcctaaacgggttatcgagttttagaatattgcagatatccacgcttacccttttagtagccgtcgccgtaaaagcggaaaccacaggcctatacgacaaagtatcgataaactctgaaatttttaaataacttggtctgaaatcctgaccccactgggacacgcaatgagcctcgtcgacggttaccatagatatttttgagttttctgcaaaatccaaaaaatcatcagtcacaagccgctcgggggcaacataaattattttatactgcatctccgccgctctcttaaacacctcacacagctggcggtaacttaaagagctattaatatatgcagaaggtatacccgattccgtaagagaccttacctggtctttcataagggatataagcggagaaataacaatggttattccgtccatcaacatagccggaacctgataacaaaccgattttcccgctcctgtcggcattattcccagcacatcttttccggacagtatattgtcaataatatcttcctgtccgctcctgaacttctcatgtccaaaatattgttttaaaacttcaagttttgtcatatctttctccgccgttattttatactttcgataaactcagccaaaattccctcttttaatccggcagaggatactatcacttcctcagagcctattttgtttataagctccacaatcggcagcactccggcaattatagtgtctgttctagaagcttctatcccggcgtcgcctctttcagtttcattcatttcaaggatattgccgaacgcatcagcgacgcagtcgcctgccattacacagccgtgaagctggcttctgtctgctcccggaacattattttcaactatcgcaagattatatatgctgccgcccattccaactatcggaagctgataagcgtcctccagccagtgtattttgtcaagctggctgtcaatataatcagtcagcgcactaagcgcctcctcagtttctcctctaaacaaaaactgttcagtcatgtttacggctccgacaggtatacttgttcttgccagcggctctccgtcatttaccaatattatctcggtgcttccgccgcctgtgtctactattacacagtcctctatatcaagcgaactggtcacgccaagaaaatcatattcggcctcctgctcgccttttatcactctcacgattattccggtctcatcctcaacctgttttatgaactcctggctgttgcccgctttcctgactgctgctgtcgccacagtgataacgtcatcagtattattttctttcataatttttttgaactcactaagcgccgcgatagtcctgtctatagcttcgggctggagattcccgtccatgttcataccctcgctcagccgcgccatatcacggcacctctctatatatctatgagatccggttttttcatcaatttcaactatatccattctgatagaattggagcccaaatctattatcgctaaaaccatttttatccgccttcctatgccaatatcaaattcaatagctatcttgtccatcacaaaaatttcagcggcggcttatgccgcagctgaaatattaaacattcgccgccggctagacacccggcagacattatatcattattctaacacaagtgtaaggaataatacttcttcctctcctctatactcaacagttccctgtccgcaaatattgttaacatatgcttcctccgcattctcggctgttttaacagaatgcggaccgcttgttaaagttaattttattattccatcttcattggatgtaaactctccaaaagcttctccgtctacataaaccgtaacggtcttatcagtcaaaaggtttccgtttatatctttaagatataggctggcggtataatccttagccgtatatccgctcatttcaactatacgcccttctgtgttgtctacctcaagcggttttactccattatcagtaagcttcaatatataatcgcagactatctgctcaacatcggttccctgcattatctcaggcaggccaggcaccatatcataatcgtttccgcccattgccacaaaatcatttgttgcaagcagaatcttcgtttcgaaatcagtcctgtcaagcggttctgtttgaccgcctaatgttacagaaataaccttttcgccctctttgcctgacgggtcatactttacgctcattccgcctatctgcaaaaaacctccgtctggataaaggtcaagcagtcccgtctcctcgtcctgggcggttgcatttttaacgcttctctccataactgaatataaaatgtttggcgttatttccttaacaaacagcgtgtttccgaaaggcagaacattaaatatactgccaaccgttatatcgccgttcttaacagaagcgcgaacccctccgccattttgaacgctgacaatcggcaggccgctgtattcggcgcttatattatttttaacctcgtctatcattgcgtcgcatataagatttcccaaatttgtctcaaccgcacgcggcacagcaaaattatttacataaccgccccagagagtggtctttgtctcggcaattttattgtcaagcagtttcgactgctcagccgttaccttttctaaatattcagtaacctcagggtcaggagtgacttttgctttaacctcagcactgctgagcatattttctttaactcctattacctctccgtcctttaccgaaactgacataatacctatgttctctgaatatgagcctgtctgagcaattaatacgccgttttcagtattattatacacagtatggctgtgaccgtctatgaccgcgtcaagacctgacgtatccaaaagcccgtctacaatagccggagtagtgacggatgacgcttgagaaacaccgacatggaacaagcctataaccacatctgctccctggttttgaagctcctcaacctgtctttttgcggtctctgtctcatcttcaaaagaaatgcccaagatgcccgatggttttgttgaagacgctgtatctgacgttaatatgccaaaaaatccgactttcactccgtctatttctataattgtattttctccattattctcttttgttccatcggcataactgcctttaaaaaacggatgaccgtcttttagggtgttcgccgatataatcgggaaatcagcggctgccgcatttttctttgctgtctcctgtccgtagtcaaactcatggtttccgcacgccatcacatcataaccggctaaattcatagcctcaatggcgctcgcccccttatccagcgagacaaaagctattccctgagtagcgtcccctgcgtctgccaaaacagcattatccgtctgcttcttcagagcagatatttcatccattccaatcacagatttatcgcccacgtcatagccgtgaatatcatttgtatgaataatatttatggtcaaagaatccgcattcaggtattccgccaaacgcatagccacagcggcaagctcagagcgggtcatatatcccgacgggtcaaaggtttggttctccttgcccgacataatattgttcaccgagcaccaagctactgctgtataacactcagaagaaatattctccgcgtcagaataggctactgcaatatcctcagtattagcagaacctccggccgcatacacaagaaccgccatatcctccctttcaaccggctcagaccatatataactgtcaaagtcaacagagggcactaacctctgcagcacagtttttgccataacatcactgacaattccgtccggctggaattctgattcattcacaccattcatcaagccgttttgtatacaatactcaatgtacggataagcccagctgtccccgctcaaatcttcaaattgtgtatccgctgcaaaaacagaaactcctgccgccgcaaataccattataacggctgtcaaagcacacaacacacgctttaaacttctaaattgattattgttcatgaaaactcctccaatatatttatttaaaatcaaactctttatttaatctcccaaaaccgcgtcttttagaatctgcagacggtttggcacaccaaactcaggctgtatagtcatcgttacaaatctttcaagagttctggagcctgatgacaaaatcgccttcgcctgaatcgtctttgcatcctcaaagaatgccggagggtttatttgaccggaatttgttattacactctttctgaatcccagtatatttcccaatgaataattatcattaaaatcccactttattgttactctctctccgttttcagctatatagctgctcggcaaatcgctcgtgacattatcaaatgaactgttgtttccctttaactccataatagcctcacgaattgcagtcatatttttatcgtctgttacagatactgaaaggcttggggcaaactcatgagagtatgacgaatagagttccagactgtctgttgaagccgggtcggtttgtgttccgtctatcaaaaagctggcagtatatttgcctgatttgaccagcttataaactaaatccgttacatccacgctgaaaccccctgaaacttcaagtccgttataggacttaatcagggacagttcaccttccggacggttattgtaagataattctccactgttccagccgtcattttccaaataatatatatcgatttttgtattcacagatttaccgataggcctgagaaaaatccgcgcgtcctcaacagcgccgagaatatttttaggttcgatattaaattttaagtatacggccgaaccattgtcaaccgcaagccttccgttatttttataaagcagctcgtttgagtttgtatttggttccgcctttgatacataaccgttggtatccaaataacttttgtttaacgtcttggtatcagtatccacagcgtcacccaccaatatttttaaatacggccggtatgacgggtcagagtatcttgttgaggctatttgaaccggcgcagtattgctcacgctcggactaagctttaacgtaaaaactttttcatcattgccaacagcctttcttataaactctgacaaatcaatttcaagtatgctgtccgaaccattgcccgcagctgtgcaaagatattgttcctcaccgcccggtttggttgaccaggtcatgttatctccccagttattattatcaaggtagctgacgttaaacgaacagtctgtttcatccggttcatttctcccgtcccaggttaccgcaagtctcagttttgcttgacttatatcgctcttttttgcgtttccgattgccgacaagtcgaaccggaaataagtgttccagtaattaccgaccagcaggttatcctcatccagtctggatttgttcttatttttggcgtcactgtatacaaaggtctcagcgcccggcgaaattttaaccactcgtccctcagcaactaccggcgttgtaaagtagagaaggccgacaggaactatacccaaaaccaataaaacagccagggcacagccgataatctttctgatgattccaacctgcaacagttccaccgtcctttcagacagatatttactaaattatagcataaataagttcattgggcaagtacaatacaggctttgattttaaaaatataatataatctgcagcatgtataaaaaggtcggtttgtgatatttttgtaggtttgtcaatgatgtgttacaaaaaagattaaaagagttcaccgaaattgataaaagagttgatgtagtcaattggagctttccaattaatacgacggtacgctcgcctccttagccgataaatcacataaacctcaccatcatcccaatcagcataccgctgatgagttgaaattgattactgatatgcgccgccgtaatcctctcagatggttgaaaaacaaatagtgaaaaagtcttttgaaattgagtttcctcaatcatcgaccttaggatttcttggctaacttccgttacttccttccgcttccttcttccataattttcaggctcaatgccttactctcttacttccgctctccgcttccgttactcttctcagaaccaaggggtctccttagaaaggaggtgatccagccgcaccttccgatacggctaccttgttacgacttcaccctaattatcaatcccaccttcgactgcgctctccctaaggttaagctacaggcttcgggtgttatcgactctcatggtgtgacgggcggtgtgtacaaggcccgggaacgtattcaccgcagcatgctgatctgcgattactagcaattccgacttcatataggcgagtttcagcctacaatctgaactgagactgctttttgtgttttgctccacatcactgctttgcttcactctgttaacagccattgtagtacgtgtgtagcccaggacataaggggcatgatgatttgacgtcgtccccaccttcctccgatttgtcaccggcagtcctgccagagtccccaacttaatgatggtaactgacagtaagggttgcgctcgttgcgggacttaacccaacatctcacgacacgagctgacgacaaccatgcaccacctgtctccacgtcccgtaggacttcacctatctctaggctatgcgtgggatgtcaagtcctggtaaggttcttcgcgttgcttcgaattaaaccacatactccactgcttgtgcgggcccccgtcaattcctttgagtttcaatcttgcgaccgtactccccaggtgggatacttattgtgttaactgcggcacagaaggggtcgatacctcctacacctagtatccatcgtttacggcgtggactaccagggtatctaatcctgtttgctccccacgctttcgcgcctcagcgtcagttatcgtccagaaagccgccttcgccactggtgttcctcctaatatctacgcatttcaccgctacactaggaattccgctttcctctccgacactcaagatatacagtttcaaatgcagccccggagttgagccccggtatttcacatctgacttgtctacccgcctacacgccctttacacccagtaaatccggacaacgcttgccacctacgtattaccgcggctgctggcacgtagttagccgtggcttattctgtgtgtaccgtcattatcttccacacttaaagaagtttacaacccgaaggccttcatttatattaaataattaattctaattagttcctaaattacagatggttttatttttacaaatatatactcatataaaaaatattttctgcaagcaacggcagggcaaatgtaatctgcctcgttaggcgcgcagtagcaaattttatttatattaaataattaattctaattagttcctaaattacagatggttttatttttacccaaaacacaacaagtccagcattgggattacggcggcgcatatcagtaatcaatttcaactcatcagcggtatgctgattgggatgatggtggggtttatgtgatttatcggctaaggaggcgagcgtaccgtcgtagcgttttcgccagcgatagacatactgacgatttaccttatagcgcgccttggtaggcttttaccccaccaactagctaatcggacgcgagtccatctttaggcgataaatctttgattatcataccatgcgatacaataattttatgcggtattagcatccctttcggaatgttgtccccctcctaaaggcaggttactcacgcgttactcacccgtccgccgctttccatccttatcttctccccgaaggtttaaatattttcttatatgcggagttttttagtgaacatcggaaggacgcgcttgcgcgtctcgttaggtgagcagacatctcacgcgtagcgtgaacatataggtgaatccacatcgcacgcttgcgtgcacaacccaaaaacaaatttataaaacataaaaactcaaataaaaaataaaaatcaatgaacaacggcaggtaagcggagcgaacgcgtgaggtgaatcccaccgcacgcttgcgtgcacaacccaaaaacaaccttataaattccagtttataattattttataaaattttaataaaaattcaggaacaaaatagtattaaactgagtcatattataaagtgttaagaacttaaaggcaaaatataaagtccagataaaatataaaacataattaataataaaaatatacaatttgacggaccataaattacctttgtttcttttacataacatttgccgatttttcttgacttgtgacggcatatgtggtaaaacataatagaattttattttataatggaggaaaaaacatgagacatttaaaagacatagcgttagcagtggctttatgcatgattatatcaattgtgccaatagtatcttttgcggacgttatagacggtacaaattctgatatcgttacggcagcggatacaacagacccggaggcaacagcaacagcagaaccttcagcaactcctgattcagcagatccaacaagttcgcctgaagcttctgaggctcctgattcatcagaaagcccggttcctaccgctactgctacagcttcgaattcaagctcaactccggcgccgacttcaacggctaagccgaatggaaagtatagcataaacgttaataagacagaaaagtcaacaatagttccatcgccttcagcagcggcttccggctcaaaagtaataattaaaggaaacgctgacagaggatataaatatacagacgcttattatgtagattctaaagagaataagacttctttaataagtaatgacagcaactcattctctaagacgattactatgccggcgtctgatattacggtttattcaacagtagaggaaatgtcagcgagcgagctttacgaggacgcagttgatcagtatgacactgttactgccgacataaatagttatactaagacatatattaataattcttctgattataattccagtgatatatcagatatgaaaaaacttattacatcagctaaggcatatttgtctgatttaaaatcaaattataatgtgcttaaagaagaaattgatgacaaaaatcccacaaagagcactatgagtgatgttatttattcacaggaagaccttgatgatgtctcagctgagcttaaagaattatctgattctatgggcggtgaggatgtcgactattttgacatgacagttactgttggaaaaggcggaaagctcactttatctggacttgtttcaggaacagtaaatggttttagctcaaagactacagatacatttgacgaaatatataacgacggctcaagttctattacatttaagataaatactcagaatggatattcactttctagttttaaaataaatggaaaaacagtaacagtttcaggaaacaccgttacaattaagcagtcagctctatcaaattatatttcaggcggtacaatgtccgttgtagctaattttggatattcaaacggcagcggtagtggcggaacaggcggaaatacttataatcctgttataaaagatcccgctacacctaccccggctccaggaaataattctgtgtttaccgacttaggttcagtaagctgggcagaacagtcaatcatggctctttataatatgggtattgtaaacggaatgggcgatggattgtttgaaccaagcgcgcctgttacccgtgaacagtttgcaaagatgattgttggtgttatgggataccaggttgatcagaacgcaaccacagaattcagcgacgctaacggagactggtatacaccttatattgcggcggctgttgaacatggaataattacaggccgtgatgacggcacatttggcgttggacagaatattacgcgtgaagatattgccgttataatattcagaactcaaggttcacctgcagctgagatgcacgagttcccggattcagaccaaataagcgactatgctgaaggcgctgtgtcttatctgtacagcacaggtatagccaggggtgatgataatggatacttcaatccgaagaattcggctacaagggctgaagcatcaaagatgctctttggactgtatggaataatcaattccaaataaattttttaaaaagcatggcgccgccttatttttaggcggcgctattttatgttttatatatttataattactataatataaataataaaaatatatacataattgccaaaatggtcgttttttaattagtattttttcttgtttattgaaattcaggaacttttatgctatactaaaagtctaatgagaaatggatttactgagtataattaaatgataatgttaacaagccgttaaagttatagattatatttattttttattgcggtttcaattaacattttgaatgtgggtcaaagacatatatttgtattcaggagtacgattgtttggttgaaaatttgttataaaggaatgtgaatttgttttgaaaagattttgtttaaatttgtttcttctcattggaatattaataatttgcggtacatataccatatccgtatacgcatatgttgatgacagccagcttgagcttgcaacagatgcttttggcgaagtgggtgcaacaattgaatataagtatccggaggacactttaactgttgaaaaagacggtcaggttgctgttatgaagttaaggagccgtcttatatatagagacggtgaatattttccgcttgaacgagaggttgttgtatataacgacagggcttatgtttcaccggatgccgttgaaaaagcatttggtcttcagccggaaagaacaattgatccttcaaaacctatggtgtgtttaacttttgatgacggaccttattctccggtaaccgattctatattggatattttggagacatataattcaaaggctacgttttttgtggtaggaaatatgatatggcagtaccctcagaccttgaaaagagctcaggagcttggtatgggactgggaaaccatacatattatcatcctcatcttccaaaatgttcgtgggatcaggtggttaatgaaataaatatgactaatctcgatgctaaaattgttttaggagacgatttgaaaatggttcgccctcctcatggtgaaacaaatgatatggtgaggtcggccataggtcagccgataataaaatggtctttggacactttggattggtcaaacctgaattcagggacaatttattggacggttatgaataatgttaccgacggtgacataatattgatgcatgacctgcttgactgcacaaaagaagctgtttcgtggatggttcctgatttgttggaaagaggatatcagattgttactgttgaagaaatgataagggctaaaggatggactttggaccctggtgttgaatattattcagttaaaccttagtttataaaaaatataaaaatacatataggaagaatattatgaataatgaagattacgtaagtcaaaatgataaaatttatggacgaaacccggttattgaagctcttgaatccggtcgtacaatagacaggctgtatatacaggaaaagttaaaccatcccgtaattggaaaaatcagaaatatagcgaaagagcaaggtgtccgttatcagtttaccgctaagcaaaagctggataaaatgactgacggcgctaatcaccaaggggtggtggcagtgactgcttttcacgattatgtgagcgttgaagaaattcttaaacgtgcggaagaacgtggagaatccccttttatagttatatgcgaggggctgagcgaccctcataatttgggtagcataataagaactgctaacgctgcaggcgcccacggagttataatacccaagaacagaagcgttgctcttaactcaactgtggcgaaagtgagcgcaggagcagtagaatatacttatgtggcaaaagtgtcaaatatttctcagacattggataagctgaaaaagaaaggcttgtggattgttgggactgacatttctgcggctcagaatcattatgaatgcgaccttaaaggcccgcttggaatagtcataggcagcgagggaagcggtatgagcagaatagtaagagagtcgtgcgattttttggttaagattcctatgataggagagattgaatcgttaaacgcgtctgtggctgccggaattttaatgtatgaagcattaagacagcgcagaaattagtagatttgttttgaggagaaatatttatgagaatacttgccataggagatatagttggaaaacccggaagagagtatgtttatcagaatttgggaagaatccgaagcaaatataatatagattttgttattgcaaacggagagaattcagctgcaacaaacggtataacgcctattatagctgatgagctggttaatgccggggccgatgtgataaccatggggaatcataccttcggtactaaatcagcagcacaggcgcttgaagaaaatcccaggctgattcgtcctctgaactatccgccggaatttgaagggagcggatatataatacaggatttggggtacgcaaaagttgcggttatcaatcttatcggcagagtaaatatgtctcctgcaaactgtcctttcagagctgtagagaatctcttaaagcggattgaaagtgatattatagttgttgatatgcatgcagagacaacaagtgagcgtttggctatgggcaattttttggacggtaaagttcaagttgtttttggcactcatacacatgttcagacggcagatgaacatattttgcccggcgggaccggatatatttcagatttagggatgaccggtataatggactctattttaggggttaagaaagaaattattttaaattattactataatgcaggaaagcattatcgttttgaaaaagaagaaaacggagacgtatggtttaacggttgtgtttttgagatagataataagacaaaaagtgtcgtagatattgaaagacttaggttcagcagaatttgaggtgtttgaatgaacagtgaatttaaagttttggaaaaggatgaacggagctatcttgtggcggagccttttgaaaagctgggtgttataaatggattttcacgcaggcttggtggggttagcagcggaaaaatcagcggtttaaattttggattcagagtaggcgacgattctgatgcggttttagaaaactatagactgcttgctgaagacttaggttttgatatacgccttggagtttgcgcaagacagatgcacacggataatatacgtattgttactgaaaatgactgtggaaagggaatttttcagcaggagagcgatattcgtgacacagacggtctgataacaaaccaaagaggtattgctttaataatattttcagccgattgcgtccctttgcttttttatgacccgattaaacaagttgttgcggcttcacatgccggttggcggggaactgttaaacaaatcggcggtaagactgtgcgtttaatgaaggaaaaatttggctcagaccctaaagatataattgccgctatcggaccgagtataggcaagtgctgttttgaggtggaccgtgataccgcttcattgtttgacgaaaaatattgtgtttcaaagccgaatagtaagtttcatgttgatttgtggtccgttaatagagataatttggtttcagaagggttagaacctataaatatttatatatcggatgagtgcacaatatgcaattcggataaatattactcatatcgtgtgcataaagaaaaaaccggacggcaggtggcggttattgctctgccttaatttttagatataggctataggcttcattttttgaaattcctaatatctcagaggcagtgcgggagagttcttttcctttcatgccgtcatttatcagtttaagtataaccgtttcagcatcgggcaaatccgctcggtgtttttcttttatttcctcagggtcagcgccttttattattagaacaaactcacctttgggaggattgttttcaaaatgttcaactgcgccttctaaagtagttcttatatattcctcatatttttttgttatttccctcgcggcggttatttgacgttcccctccgaatgtttcaagcatatcggcaagggtcgctttgagtttatgcggcgcttcatagaatatcatagttctcgtttcgttctttaaactgaggaggtgatctctgcggctttttttgtttaccgacaaaaatccttcaaaagtaaaccgtcctgttggaagtccggaagccacaagtgcagtggaaaaggcgcatggacccggaagagcttctactttgatttcattttgtacgcaaagcataacgatatcctctcccgggtctgagattccgggcattccggcgtctgtgaccacagctatattacatccgtctaaaagtttttcaattaaatgggcgcctttttcttttttgttatgttcataatagctggttattggcttttttattcccaaatgattcaataacttcatactgacccttgtgtcttcagctgcaatcaaatctacggattcaagtgttttaatagttctcagtgttatatcgtcaagatttccgattggggtcggacataaatataatttacctttcataactttctccttcgcttttatctttttattcggcggttctttcatatattaaattaatttcatcggtatattttgcgcctgtttcttcatatatatataaagggggctccaggacaagttttggccttccgcagtaggttccttctaaaagtatcattgtggcagtttttttataagaaggatgtacaaatctgagtcgtttaggttcaattttatagtttcgcataagtgtaacaaggtctatcaatcgttcaggacgatgtatcatagcaagctttccgccgggcattagcagttcagatgagctttttataatatcctcagcattacacagtatctcgtgcctggcaatcgccgcagaattgtgtttacttataagccctccgccatattctttgtatggaggattgcagactatattattgaaagaactttttccaaatatatcgctggcaaactttaagtctccgcagaccatattaatttttttagataaattatttaggattacagagcgtgatgccatatctgatacatctttttgaatttccaggccgattatttcttctgcggcagatttgtgagataatagtattgaaattataccgttaccggcacacatatccattgttctggaaccggattttatcccttttgaggcgaaatgtgccagcaatactgcgtccacgccaaaacaaaactgatttggattctgtatcagttttaaattatttaaatgaaggtcgtcaattctttcgtttttgtttaataaagtgttattcattgtattttaattccttttttgagttcatagaatattcatatttgcgcgtttatgttcataaaatgttaacatgtgcaaactgtataataaaaattgattttcattgtgcaaaataaacaaaagagtagtttgtttcagaaatataacaaaataaaatcaacgcaaattcggtgtttacgaaagctttatcttaaaatatttcttaatattacaactctgttacatttgtgttacaatgcaaaaaatgagttttttcgctataatttcctgatataatgccataaaaatagtataacagaaaagtggattgagcacaataaccaaaattggcaatcgtcaggaaaaaagaagagtaaataaaagaaaaaagctaaaattattagaatataagagaaaacatttgattttgtgccggtgctggatttaaacttgacttagacgatttgagacaattttgaaggtttgacggattttctaagtcaatatataatagccagcgtgacagagataaggaatattgttttattccaaaaatttatttgaggtgattcgatgtttacaagactgatgagaaagttacacttatcagccaaaaattgtgcagcagctgctttatgttcaacttttattgtggcaacatgctgtagttttgcatatgcaactccgagtaccgttacgatttgtgacggagacaatactccgattacggtaaaaacaagtgataccagcgttggtaaagttttagcaaagcaaggtatatcacttaatgagggcgacgaaacaaatgttgctttaaatgatacggtttcaaataattcagtaattcagattaacagagctataccggttagagttactataaacggtgttactaacgagtatagcacaacaaaaaagcttgtttcagatgttcttgctgatgttggcgttgaggcttccgatgatgaggtcacaccaagaatgacagatgttattgaagccggtgacgaaatcattgtaaaccaggaagagagccagatagtaacagtatctgaaagaatctcgtatcaaacagaagaagttgaaaatgtgaatttagctccgggtcagagagttgttacaagagaaggctctgacggagaaagagaaatcacatataagatttattatcaggacggcgctgagatatcaagagaaagaatcggtgaaattgtattagcagagccggtaaatgagatagttgaatattcaccgcaggaagaatttgaagttggaaaaatacctgcttctagacctacaaattattcaagagtagaaacatttacagcgacagcatatgacgcgtcttatgaagacaacggtccttgggccggcgttacatcaacaggtatgcctatgggatatggtgtaatcgcagttgacccgacggttattccttacggaacaaagatgtatattgagtctgctgatggaaaatatatttatggttacgccattgcaggagactgcggcggagctataaaaggcaagagagtagatttattctactggtctaaggctcagtgtaatgagtttggaagacgcgcagtaaatatttatttcttagattaataaaacatgaccgcctaagcttaggcggtctttttattttgattacaaaacctgaatattacttgacctttaatactaaaagtgttatcattatataaatttattgatggaggtatgacttatgtctaattattcaaaccaggataaaatacttgaaatactgcacaacgactgcagactgcccttagaagagatttcggtaatgaccggaatcgccgcacaagaagtcgccgccatcatcgacgatttagaaaaagacggtactattttaggttatggcgctaaaattaattgggataaagcggcaggcccggattctgttaccgcttatatagagcttcgcgttactccgcagagaaaccagggttttgatagaatagctgagagaatataccaatatcctgaggttaaatccgtcaaccttatgagcggaagttatgattttggaattactgttgaaggttctaatataaaagaaatttcgctttttgtgtcgcagcatttggctcctatggaatctgtagttggaaccgccactcattttgtcttaaaacgctataaatttgacggtatagtatgctcgcagccggagaaggatgaaagggaggtaatatccctatgagttttaatcctgaaaaaatgataaataaaacggtaagcagtatgccgccgtccggtataagacgtttttttgacgttgcggccgagatggaggactgcatatctttaggagttggagagcctgactttgtcactccgtggcatattagggacgagggaatttattctctggaaaagggacatacgcattatacttcaaattcgggattaaaagaacttagggttgaaatctgcaactatatgaaacgcagattttctttgaattataatcctgatgaccaggttgtggttactgtcggcggaagtgaggctatcgacctttttatacgttctatagttgagccgggcgatgaaattttggtatgtgagcctagctttgtgtgttacaaacctatagtatcattagccggaggaataccggtggttatagagacaaaggcagagaatgattttagattgacgcctgaggagctaaaatcggctataacagacagaaccagggccgttgtgcttccgtttccaaacaacccaaccggagctgttatgactaaggaagaccttgaaggaatagctgacgttttaagaggaacagatataatggtcttatcagatgaaatatatgctgaacttacatatggtgataaaagacatgtatctattgctgaaattgacggtatgtatgaaagaactgttgttgtcagcggtttttcaaaagcgtatgctatgacaggttggcggcttggatacgcggtaggtcatccggccttgataaaagctatgacaaaggttcatcagtatgcgataatgtctgcgcctacaaccgctcagtatgccgcaatagaggcgttaaaaaacggtgacagtgacatagaaacgatgagggatgaatataattaccgcagacaggttatagtcgcaggttttaacaagctagggcttagctgttttgagccgaagggcgcgttttattgtttcccatgcattaagagcacaggtatggattcaaatactttctgcgaaaacttattatacagcaagagactcgctgtagtgccgggcactgcatttggcgagagcggagaaggctttattaggtgttcatatgcttattcaataaaaaatataaatgaggctttaagcagaacagaagcatttttgaaagaaattaaaagatgattttccatactaaaattatggattattcgaaatgtactgtgataaaaataaatataaataacaaaactgattccttttaattgaggaatcagtttttgttttattgtgtattttataaaatgctaatttagatttttgtttttatctcgctttcatgggaaagaaatcaaatctcggctcaagaaattttaatctgtgttctgtttcgccgttagcttttgctaaatctgtaagggtgtcaaaaacatgctcccagttccatatgtctttgccaaatcctaaatattcacagagcagttcagtaccttttggagcgacagggtgcattagcaccatagcggtttttaccatatgcaaggtatctatcagcacttggtttctcttttccgtatcagcttccgcgtctttaatgttttttgcccaaaacttgtttgcgtctcttatatatgtgtccattaggttcataactgtgtggaactcaaacttatacatagcgtgttcatattttaatatggtctcttttgcagcgtgcagcacttcttcggaaacctgacccataggcataattggttctccgtatttttgaatggtataaaagcatgagcgcgctactctgttaaaaacattagataacattttgccttcacgctcaaccggatccgcgtctttttcgccggccgcaggattaagaggctttggctggaagctaacgctttttaagcttagtcctaaacctaaaaaatgcgctctcagctgttccgcagtataatactccagcaaatcctcagccattggaggcttaatatctccgctgctgcttgcttttttgttaagaaacaaaatatggttgttggcaacaagcgtggggagcgtatactgtccgtcagacgggaatgctgtcagattttccttgccttgaagcgctatgaacattgccatttcagctattccgtaaaaatatatattatcttgaccaatgaactggaacacttcagaatccgtgcttttccaatatttttcccattcatcttcgggttttccctgctgttttaaatatgtctttgtaaacgaaatcggcgcccataatgattcgggccatacccaaattgtcagcccatcttcgccatccagtacaggagctggaacgccccattcgatgttgcctgtaaggcggaacggaaccaaagttttgccggcgcggaaccggatattattgtcgcttaacagttcttttgctttgtcgcggtcattcaaatttttaaattcgatagaaaatgaggtcttgttgtcctccaaattcagaatatgctccggcatttgtgacttgattgcagtgtattcgtctataaagtcttttttaatgtaaatcatcggaggaagcataaattcttttattgtgttgtatacaagcggccgtgaattgcctttttcaggaaggctgtcaacatattcgttcatcagttcattaaactttgttatgtcaatgtaccaattcacaacgtcacgcatttcaggagtttcgcctgttaatgtgcttttggggttaatcaggtcggccggcatatattggtgccccagcgaacactcgtctgcatatgctttgtcgctctggcatttatcaacaggacattttcctatgacctgtctgccgtttaaaaattgtcctgctttagcatcatagaattgagaggttaccatcttttcaagatgtccgttttcgtaccattgatgcattaattcactgcttacgtcagcatgtacatctttggactctccaagtcctgaagcggcaaagagatttaagcttatatcatatttgccaagaacttctttctgactttcatggtttattctgacaaaatcctcaatgcttccgtcgaatttccctgtttcgcaaagttttctgtaactttcaacaataggtgagccgtaacagtcagtacctgaaacaaatataacgttctcttctccaatacggtcgcgcagaaaacgcgcaaaacagtctgcctgaacaaatacgccgcctacatgtccaaaatgaagttttttgttgccgtaaggcatacctcctgtcacaactgcccttttgggaaatgatggtctaggtaggtcaaatacacttatttttttaggtctgtactgctcattattttgattgtttttacccatgttttttctccttctatataaaaacagaatcttttgtagtttatattttaacctgcaatagccaaattaatccttcttgtcatttcgtcttcgccgattatttgacatatctcccaaaggtcgggcgagttagtgcgtcctgttatagctacacgtataactccgctgacgtcgctgacgctgcccttatacatatcgggattttttttgaaatcttttggtttcacggcataacccattgattcggtaatatctctgattttttgaaaccattcggaattgtcgtcttttatattaaacgaggttaaatattgttttagaattttatatcggtcttccttagataccctttcaggaaattcatcttcaactttaaacgtttcagggaagtagaatgagaagaaatcgcgtgcctgtttccagcttgtcaggtcttttctcggcctgtttccgtttctgccaacgtctatgattttttcagaataatttttgtctcgggtaaacagcttataaaattcagggtcatattctttgagccaatcagaaaattcgtcataaatcttatttgccggcgttctaagaagaacctctcggctgacatcctcgaatttcataatatcaaacagcgctcccgaattgctcattttgtctaaactaaatttaaagtcatcaatcggggcgtcgggattttctaatctccactcttcaaaattggaatttaaaacagtcatgagatattcccaaacggctctcggcgcatatccttcacttcggtaatattcgagaccaagctcagggtcttttctctttgaaagttttctttttgtgtcaccgtccattttcatcagaaccgctgtgtggcagtatataggtctgtcaaagcctaaggcgtcaaataactgaacgtgtatcggcagagttgaaagccattcctcgcctcttaccacatgggttgttctcattaaatgatcgtctataacatgagcgaaatgataagttggtataccatcggatttgagcagaacaaaatcctgatagttttcagaaacgttcagcattcctcgaatcccgtcatatacttcaacgtggttattttcgtctccgtttgacttaaatctcagaacatatttatcgccgttttcaatccgtttcttaatatcatctatagaaaggtcacggcactttgcccatttaccgtaatatccgaaattgagcttgtccgaaatctgttgctcgcgcatttttgaaaggtcgtcctccgaacagaaacaagggtacgccatacccttcttaaccagctctttggcgtagcattgataaacttcttttcttaaacgctggcggtatggtccataagctccattatcaccgtcgacagaggcgccctcgtcaaagtgaataccaaaaaagtccatagctgatataaccagctcaactgcgccttcaacctcgcgtttggcgtctgtatcctcaattctgagaaagaacgtgccgccgttttgatgagcgagtctctctcctattattgcgttgtatagattacctaaatgcacaaatcctgtggggcttgggcctatacgcgtgaccggcgcgccttccggaaggctgcgtttgggatatttttcttcataatattcaggtgttttatcaataccgccgaaaagaagttcggcaagctgctcatttttattcattacaaaatctcctaaaccaattaataatataataccaagtattttactattttttcctaaataagtcaagtattcgctggttttattatatggttgatttcagaagtttcatacttaaaaaatctgtgcgagcagtactgacataaccattccgcacaaatccgcacttagcgcggcaaataacgtgtagcgtatattttttattccaacgcttccaaagtatacagctattgtataaaaagtggtttcagtagagcccatcattattgacgctattttgccctgcatagagtcaggtcccaggtgttcaaatatatcagttaccgtagccagcgccgcactgccggaaatcggtcttaaaaaactaagcggaactacttccggcggcatatgtatcaggttggtaacaggagagattgcgttggtgattagttcaagacatccgctttcacggaacatagctattgccaccataagtcctataagtgacggaactatgttaaatgtggattcaagccccattttggctccggatacaaagcaatcatagatatcaaccttttttacaaatccaaaaatcagaaaaataaatataaaaaatgggactgagtacatagatactatttccatagtttatgccccctgtctttttgatgcgtctgaaatagtttggcgacagtgattccaacagccagcgcacataattcacatatccaaataggcagaatgacctcgcctgggtttgccgagccatagctttgacgaagtgatattagggtagttggtatcagctgcaaagaggctgtgtttaataccacaaacatacacatttcatcagtggcggattttttgcatttgttaagcttatccagttctcctacagctttgattcctaagggagttgccgcgttgcccattccgagcaggtttgctaccacattcataaccacgcttccgaacgcgcttgattttgggtcaagttttggaaatataaattttaatattggatttaaggctttggctataatttttattaagccgccttcttcacctattttagatatacctgtccatagacacattatacctaaaagtgaaatgcaaagagtgacagcgtctccggctccgctgacagccgccgccgcggtctgctcaacccgtccggtaaataccgatactataagtgatattattatcattccgccccatatgtagttcatcataagcattacctctcttgtatagtgcgatagaattattgttttgtaatataagttttactaaattgtaaacagcattcttcatgattctccataaatattggccgaatgtatgtataatactgtatggtaatatttgtaaataaatgttttgaccatagtatttaagggaaacacgaaaattttgtcacttaggcaactcgtatatattgtataatatattggctcagtgcactatatattccggttttgatttgattataaacctctcttttcgacaaaatacgattatattgtccacttttcaaaatcgttaaaattattataaaaaacgcttgcataaagcaagggcttgtagtagaatatacgtggtgggggaaagtgtactaaagtgtattgatatgccgtgaaagtggtacgaaatgacttaagtgtggagcacattgccctaaaaccaaaaaaagttggttgaaaggaggcggcaaaatgttaataggtgaatatatgcaaactgtggacgctaagttcagggttaacattccatctaagtttagaaccgatttgggtcagacttttgtcgtcgctaaaggaatcaactgtatttcgatatatccgaaagatgaatggatacggtttttggaaagtttgaaagatatgaaaaaacttaggtttttctctgccggttcaagcgagtgtgaacttgatacgcagggaaggatagttgttccggtcagtcttcgtgaatatattggtcttcagaaagaaatagcggttataggtgcgttcaagcatgttgagatatggaatagggataagtggtcggagtattttgacgacgacgcttataaggccgaaaatatagagtcaattatggagcaggaagattttatatagaaatttgaacgcagaggaagcttctatgaaatttaatcatatttcagttttgttgaatgaaagcgttgaagcgctgaacgtaaagcctgaaggagtgtatcttgacggcacgcttggcggcggcggacattcgtctcttatatgtgaaaaacttggcgaatccggaactcttatcggtattgaccgagatactgccgcacttaatgcagccggtaaaaaacttgaaaaatataagtgcaggaaattaactgttcacgataatttttttaatgtaaaaaatattttagaaagtcttaaaatccctaatattgatggagcaattctagatttgggcgtgtcatctccgcagcttgatgaggcagaacgcggattcagctataattccgatgcacggcttgatatgagaatgaacagggacgacaaactgacggcatatgatgttgttaacaattatacttttgatgaactgaaacaattgctgttcaggtttggagaggaaaagaatgcctcaaaaatagccgctaatatagtgaaagaaagagaaagaaagacaatagaaacaacgcgggagctaagtgaaattataaagaggtcatttcctccgaaaaaaaggtatggggacaagcatcctgccaagagaagttttcaggctattagaatagaggtcaatcatgaacttgatggtctgaaagaagcaatttgtgattttatagaatgtttgaagccgggcggacgtttggctgtgataacctttcattcgctggaggatagaattgtaaagactgcttttgcagaattggccagaggatgtacctgcccgaaagaatttccggtttgtgtttgcggaaactcgccgaagataaagataataaacagaaaaccaatagttgccggaaaagatgaacttgaaaaaaataacagagcccatagtgcaaaattacgaatagcagaaaaaatataatcgaatgttaaaaagtttaattgaaagggatggtaaagtgcctgagaaacaaaagacagcatatagaagacaagcacctttgtcgcaaagcaggaattaccgggcggaaacaagaggcacttcatcatatggcggtgcttatggtgctccgcgttatcaggagaacatgaattataggtatcccggaataaacagcactgaaatcagaaacactcagtatgcaggtacagaaagactaagaacaggcagttatgagagcagaaaatcttatagagcccaaagcggtgtatatcaggaaaagagaccgagttcgaatcggagaggtaattcaactgttaatattcaggataaatcatatatgagggggtattatccacctgtgtatacggctccgtcagaaaggcctatggcaaacggaatgcggacatcatcagtttccgtttatgaaaggccgctgggatataccggcggaaccacggtgactgttccgggcagagaggttcagagaaaaattctgacccgtgaggagcggttagaaaataaaagaaaattaaaggctcgtgtattatctattttaggcatagcagtgatatttttaatgtgtgtgctgatgctttacagacagagtgcaatatttggtaaaaatcaggaaatagaaacgttgaattcagaatatagtaaaattcttgtcacaaacgaaggaatacagtcaagtatagataaatcaattgaactgggaaaccttgaatcagtcgctaaaaatcaactgggaatggttaatccggattcgtctcagatattttatatagatatgggaataaaggatgaagtagttaaatcttcttcttcaaaataaaatgaaatacaaaatgggtataaaagttattaaaatatgttctattttataattttatataataaactttccacaaagaacggcggcctaaatttggtcgccttgttgtaattaatggaggaataaatatggcagagcataagggtaaaaaaaagggcgggaaagttaccaggcttatgactgtattaatagtattttcagtgatgtttatagcactgatatttcgcgtcggctggcttcagacggttagggggaaggacttgtcaagacaggctttagaccagcagacaagtgataatacggtcagcgccaaacgcggaaatatatatgacaggaactataaagtgcttgcaaccaacactacggttgagactataagtataactcctgaaacgctgcgtacatctatcagtaaaaaaaatatgactattgatgaggttgctcagagatttgccgatattttggaacttgaaaaagacgcggtaaaggataaaatatcaaaaaagattcaaaatgagactttaaagaaaaaagtggataagacggttgccgacacccttagagagtatgtaaatgcttcgggactcagcggtgtagctttcacagaggacgttaaacgatactatccgtataataattttgcagcgcaggttattggtttctgcggtacggacaatcagggccttgaaggtgttgagagtatttacgatgaagaactcagcggtgtgccgggaagggtagtgtcggctcaaaaatcaaccggtcttgaggataataacggatatgagaattatatagctgctcaggatggaaatagtgttgttttgactattgacgaaacaatacagagctatgttcagaaaaatttagaagccgcagccgcagataataaagttaacgagggagcggcggctattgtaatggatgttaacacaggcgaaatacttgctatgtgtacagagccggattataatcttaatgctccgtttgaaataacagaagcaatcgaacaaaaatatccgggtataaaagaagaacttgaaaatttagacgggcaggaatataatgcgaagctgggagaagtaatgcagacggttaggcgtaacaaagcggtagtcgattcttatgaaccgggttccacttttaagtctgttgtcgcttcgatagctttagacactggttcatgtacactgaatgactcgttcacctgcggcggttcatttgtggttgcggacagagcaataaaatgcgccaatactaacggtcatggattgcaaaactttactcaggcagtacaaaactcgtgtaaccctgcttttatacaaattggtcaaaagacaggaaaagaaaagtttttgacaggtgttgaggcattcggattctttaagaaaaccggaatagagattcccggtgaagcaacgggtcttggatttacaaaagacaatatgacagatgtcgatttggcaacatcgtcattcggacagtctataacagtaacgcctcttcaaatggtagctgcagtcagtgctgtcgctaacggcggaacattaatgaaacctcatatagtaaaacaaatagttaattccgatatgggaatagttgagaacaccgagcctgaaatggtaagacaggtgatttcaaaagaaacaagtaaagaaatgtgcagtatacttgaatcagttgtatcagtcggcggaggtaaaaatgcgtatctagcaggatatagaatagcaggaaagaccggtacgtcagagaaatacccccgcggaaacagtaagtatgtagcgtcatttatagggtttgctccggcggatgaccctcaggttgtttgtcttgtaattttggatgagccaaatggcgattcatattatggcggtactattgcggcaccggtagttcgcgatattctgggcgaaacattgcagtatttgggggttgagccgaaatataacagttctgaggaagaatatgttgatgttgaaattcccgatgttacaggaatgagtaagtctgacgcagggatagcaattgatgagagcggccttgaggttaagttcagcggcgagagtgaccttatagttgaccaaataccaaaagcgcacactagagtgactcagggaagcacagttgttttgtataccgagggcaataaggcaactcgttctgttgcggtgccgaatgttgtaggaaagacgccggcggaagcaaattcaactttagtcagcgagggtttgaacgcaaaaatcaaaggagtttcaaaatcgggtaaaaatgcaacgtgtatcggtcaatcaccggttgaaggaactatggtagaacccggaacagtggtttcgcttaactttagatatgatgaatctgagactacaaatgattaaaatttataattttaaggtttatttttggcatgaattataaaaaagtgatttaatcattttggaggttaaaataaaattttatataatttgtttaggcaaaaaagcgtttatagcaaagggtgctgaggtataaaatctcaataagataataatgcagagtttgccggctaaatatgcaaatatatacacaaatcaaacaaaagtgtaacaaaataatttatttataaaataagagtaatttatggcaaacaacggcagggcggtcaaagaccgccgggtaaggtgagcagctgcaaataagcagatatattaaaataaatctaaaaaaacatagcaaggtaattgccagcaaaataaaaatagagataaaataagagtaatttatggcaaacaacggcaggacggtcaaagaccgccgcgcaaggtgcgcagccgcaaataagcagatatattaaaataaatcaaaaaaacataacaaggtaattgccaacaaaataaaaataacgcaaaaaaagtgatttatagcaaacaacggcagggcggtcgaagaccgccacgtaaggtgcgcagctgcaaataagcagatatattaaaataaatcaaaaaaacataacaaggtaattgccaacaaaataaaaatagcgctaaaataagagtaatttatagcaaacaacggtagggcggtcaaagaccgccacgtaaggtgcgcagccgcaaacaagcaaagaaatttacataaatttctactaaatcataataactaattgactttttatttatattagctatataatataaataactataatcaacattataacagtaaaataatcacaaaaagtgtgcgccataaaatatattttatataaattataagtaatcatatttaatcaaaaagattatgtaatgggataaagcgaaaaatacataattctaaaggttctaataaatatttataaattaaaaatctaagcttataacttttacaaataaattgagttttaaaagtatatagtagaataagaaaagttttattgatattacacaggaggaataataatgacactttcagaattgttgaaggatgtaaatattaaaaaaatagatggcggcggaagcatgaaaataagcggtatagcctgtgattccagaaaagtaaaacctggaaacgtttttgtttgcataacaggttatgagactgatggacataaatatgctaagtctgctgttgaaaacggtgcggtggctgtggtagccgaacatgaccttcctacagttgacgtcccctgtgttatcgttgacaacacaagaaaggctatgtctgaaatggcggcaactttttatgattatccttataaaaagtttaagcttataggaataaccggaacaaacggaaaaactacgactacttatttgattaaatcaattcttgaacatcttggaaagaaagttgggcttatcggcacaaatcaaaatatgataggcgatatgataatggaaacctcaagaacaacgccagactctttggagttgatgcagctgtttgatatgattgcctctcataatgtggattatgttgtgatggaagtttcttctcatgcgctggctcttgacagagtgacggcgtgtacgtttgatgtaggggcgtttaccaatataacccaggaccatttagattttcataagactatggaggaatatttggcggcaaaaagcatattgtttaatatttgcaataccggcgtagtcaataaagatgacgcccgcagcgaatatcttattgaaaatgcaaggtgccggaatatgataacatacggtataaatcaggattgtgatttaaaagcgtctaatataattctgaatgaagacggtgtaaaatttgatataaattacggtggtatggaagaacacgtcgacttgccgatacccggtgaattttcggtatataacgcgcttacagcgataggctgctgcatggctgagaacatacctcttgatttggctgttgacggtcttcatagtgctaaaggcgttaagggaagaatagaaatagtaagaacgccgggtacaaattatacagttataattgattatgcgcacactccggacggacttttgaatgttataaacgccatacgtggatttgcaaaaggacgaatagtcacactatttgggtgcggcggtgacagggacgcctcaaaaagaccaataatgggcaagatagcaggagaactctcggatttttgtatagttacaagtgataacccgagaactgaggatcctgaaaagataataaagcaggtagttgaaggagtaaaacagacagactgtgattacgaggttataacaaatagattctccgcaattgaatatgcacttgaccacgcgaaaaaaaatgatataatattattggccggtaaaggtcatgagacttaccaggttttaggaaaagatactataaagtttgatgaaagggaaatagttcaaaaacttttagggtgttacgataaataataacaagctgttttaacggcaatattgtaacaaaatattatgaatttgattgtgattgtgtggaagtcagtggattactaaggagatagttttatgaaatggtgtatgaatatcaacaaacttgctgaaatcaccggaggaatagcttacaattgcagcggagatgagatagttaaaaacgtagtcagagatgacagagaagtatccgacggaactgtttttgttgctcttaaaggagaaaataataacggtcatagatttgttcagagagccgtaaataacggtgctgcatgctgtgtggttgacaaagaggaaggaagcttcggaaatcttcctgttgttgctgtagacgacacattcaaagcgctgagagatatagcggcgttttatagagaacaatttaatattccggtagtcggaatcacaggaagcgttggaaagacttcaacaaaaggtatgatagcctctgtattgggcaacgaatatgttacgctgaagacggagggtaattataataatgaggtcggagttccgcttactatttttagacttacggataacgacgaagcggcagttatagaaatgggtatgagcgcttttggtgaaatttcaaggctttctaaaatagttaagccggatactgcggtaatcaccaatattggtatttcacatatggaacatttgggcagtcaagagggaatatgcaaggctaaatttgagattcttgatggtttgtctatagacggaaccattatcttgaatggagacgatgaatttctctgggagaaaaatggagagctggattatgaaaccttatattatggtatagaaaataaatcctgtgacgttgtagcgacggatataaaattatactcgtgcggcagtgagtttaacgtaaaaatagatggtgttgactataaatttgagactaatgcaccaggtatacatcatatatataatgcgctggccgcgatacttgtaggatataggtataaccttaaagtggaaagcatgataaagggagttcacgattttgtgccggagggattaagacaagttaagacaaattatcctaagtttacagtaataaatgattgttataacgcatgccctgattctatgggctccgggcttgacgttttggttttaacggctgaagaaaacggcggaaacagcagaaaagttgcttgtttggctgatatgctggagcttggagagacttcggcgcaggaacattataaagtgggtctgatgtgcgccgagaaggggattgactgtttgataacaataggcgatatggccggaaacatagccaaaggcgcaatagacggcggtattaactcaagcgatgtatatgaattcggagataacgaatcggctatatcgcgtcttggaggaataataaaaaataatgatgttatatggataaaaggctcaagaggtatgcatcttgagaaagttgcggaagcgcttgataagatgggaaattcatagtattgagagctaaaactgttttgattggagagggtaattatgaattacttgatttggggagttatagcattagtattgtcagtattatttggaatatttataataccaatgctgaggagattaaaattcggtcaggaaatacgtgaggaaggcccggcgtggcatgcaagcaaatcagggacgccgacaatgggcggaataatatttattttgagtattattgtaaccctcgttgcaatgtttgtttggacagcgtccgacgggatttctatgggaaatacagtggatttagttttggtaattttactttcactggcatttggagctataggatttattgatgattacataaaagtggtaaaaaagagaaatttaggccttaccgccgcccagaaatttagtcttcagttcgttgctgctctgattttcgctactgttgtggcgattgggggaagtaccggaacggtgattgaccttccgtttacttcggtggattttgatctgagctggttttacataccatttgtgatttttgtaatgcttgcaaccgttaacagtgtgaatttaacagatgggcttgatggtttagcgacttctataacaattgttatttcaatattttatatgctgatttctacaagtatgggcaatcatgctatgtcgttgctggcagtagttttgtgtggttctttggtaggatttttgctttttaactggaaaccggcaaaagtttttatgggtgatacaggttcattgtttttgggcggcgctgtgtgcggtcttgctataatgctgaaacagcctataacgcttttaattgttggatttgtgtatgttatggaaacgttgtcagtaattatgcaggtaacgtcatataaactgaccggaaagcgtatatttaaaatgtcaccaatacatcatcattttgaaatgtgcgggtggagtgaagtaacaattgtgtgtgtattctcagcagtgacggttttgctttgcgcgctgatgtattattttggttaattttatttatgtgcagataggaggagtatcgacttgtcagatgaaagaaatccgagaaaaaaagccggaaacaataatataggccggcgtgcttcaagtaaatatagtaaaacgccgagaaactccgaaaatagaaacaacggacattattataaaagcatcagtcataatgaacctgtgcaaaacagagcgcagagcaaacattatgagagcagttacataaaaaaaacacagagcaggatacaggagccggttagaacgcaagttcctcgccgggaaaccgcgtcaaaaaatcaaggagtaaaatatactgctaaaaactttctcagggtaggcggaataaaaataagacgcggcgcgctcgattatcagtttttattgacaacgattatcttggttgcgtttggtatgattatgctgtatagtgccagcagttcaagggcctatgctgctaccggcgacagtatgtattttatgaaaagtcagtttggcggacttctagtaggtatagtggctatgattggctgtatgatggtggattatcatgttattgccaggttgtctccggtattgtatgcaatatgtattattcttttgatattggtattaatccccggagtgggaacaacctcaaacggagctacccgttggctgtttggttttcagccgtcagaaatagtaaaatttgcaacattactggttgtagctgtatatttggaaaaataccaggataaattgggtaacttcttccgaggatttttgccttgccttttgattttaggagtagtcggagcgctgctcatgatggagccgcatttcagcgctactatattgataacccttacaacattgcttatgatgtatgtgggcggagcgaaaataagacactttattattttggctattcctgcgtttattggcggagtggcaatgatatttgccgagccttacagactgcagagactgctgtctttcggtgatccgtttgccgataagcaaggagccggctggcagattgttcagtctctttatgccattggttcaggcggtgtgttcggcgttggatttggacagagcagacagaaatacatgtctctgccggaaccgcataatgactttattttctcagtattgtcagaagaattaggttgggtaggagctatagtggttatagttttatttctgttccttatatacagagggatacgtatagctcagaaggctccggacactttggggaaacttattgttattggatgtataggtctgataggatttcaggcgatgataaatatcggcgttgttacagcgtcgcttcccgtaacgggaatgccgcttcctttctttagttacggaggaacagcgctggctataactatgggtgaaatcggcttggtgcttaacgtctccaggcaggagaaggtgttataatgagaattttatttgctggcggcggcaccgcaggtcatattaatcctgctgtcgctatcgccaattatattgctgataaggaaagctcccaaatagccttcgttggagttgaggaagggcttgaggcggagcttattccacgtttgggatatgatttgtcacttataaagatacatggttttgaaagaaagcttaactttcagaatttcaaaaatttatttgaacttcctaaaagtattcatgattcaaaaaaaattataaagaagtttaatcctgacatagttatcggcaccggaggatatgtcgcagggcctgtgttatttgcggcggcaaaacttggtataccgacgcttatacacgagtcaaacgcatatccaggagtaactacaaaaattttgtctaaatatgtcgacacagttgctcttggttcaaaagccgccgagccatacataaaatcagctaaacatataatttactcgggtaatcctgttcgtccgtctatattatctacaagcgagtttgaggcccgccgcgtcttaaagcttgacgagcgtccgtttatagtcttttttggcggcagtatgggagctaaagattttaataagacagtggttgattggataagcggtgttataaaagataataagtatcaaatcatgatgggtaccggaaaatattttcaatatgatgatgttattgaaagatttaagaacaatggtatcgacctgaagaaataccgaagcgttagagtaagcgaatatatttatgatatgaatgttgtaatgtcggccgctgatttagttgtctgccgggccggggcgagcacactgagcgaattaactgcattgggaaaaccttcaatacttgtgccgtctccatatgttactgccaatcatcaggaacataatgccagggcaatagaaaaagaaggcggagcaagagttatattggaaaatgaatttactgctgaagttcttaataaaaatatagaaagtcttgtaagcagtaaagaaaagcttaaaaatatgagaagagccgctaaaagtgttggcactacagcggcaacagaagaaatttatcgtgaagcgaaacgtttgctgaagaataattagtatattcaataaccgcttttcacaaaccgtccttgactgcatactatattgtgaaagaatattaatgtagccagatggaggagattttggtgaccgacggttatttatctataaacggaagaaggcgtctttttggagagacctcagttcagggttcaaagaactcagctctgccatgtctgaccgcctgttgtatgtgtgagaaagggtgctgtaatttatgcagatgtccttacctttcagatgttgaaaatactttggagataatggagacgctagggtgccgatgtaattatgattctgaacgcgaattagcaaatatttcggcggagagtattttcggaagcacaatagagcctgaaatgatgaacaggatgcgttcttcaatattgtttctgggagttcttctgtctcgaatcggagaggcggacgttggttatcccggaggctgtgaattgggagcaagaccaattgatttgcatttaaaggcttttagaaagctgggagtacagatagaggaaagtcagggagttatacactgcagaataaaatctaaacttaaaccgtgttctgtatcgctgttatgccccagtgttggagcaaccgaaaatataatgctgcttatggcaaagtcggatggtgagacagttataagaaatgcggcaagagaacccgaaattgtggaccttcaagattttctgaatcttatgggagcggacataaaaggcgccggcagtgacgttattgttataaatggtgtaaaaaaacttcatggcgctgattttgaaataatgccggatagaattgttgcagttacatatatggccgctgttgcaggctgcggaggagagatactgttaaagggaatcaacttggagcattcttcaatgtgcaattcaattttaaaggatataggtgcagatataagaaaaaccggcgatggagccataatatctatgagcggccgtcccagggcggttaacaccattaaaactttatactatccgggatttccaactgatgcgcagccgccgtttatggctgttatgacggttgcggacggtactacggtgttcttagaatcaatttttgaaaatcgtttcagacatgcgtctgagctggcaaagctgggtgctgatattgatgtaaacatgtgtcaggcaaccgttaggggacgggagtttctaagcggtgcggatgtcaggtcatatgatttgagaggcgccgcggctatggtaataggcggattaatggcggaaggcacgacgagagtcggaggactgccgcatattgaaagaggatatcaggatatagtcagtgatttggaatctttgggtgctgacattcgtattgtatactaaactggagagccgttataggagaatatcatgcaaaagaaaagaaacattaaaaagagcagaatagacattgaaaaagcaagggcaagacggaaactaacagctatatctgtgctgtcagtagttgttttagcagttcttgccctttgttttttgcttatggcaccaatgtttaatataaaaaatatagtttgcgagggtaatgacaaaataagttatgataccattgttgatgcctcacaaattaaaacgggcggaaatatttttttgacaaatctgagttctccgaaaaaaaatgttgaatctttagagtatgtggaggattgtcaggtaagccgtgtttttcccgatactgttaaatttacaattactgaaagacagctggcggcttatttcagcatcggagattttcttactgttacagacacaaacgggcgggttgttgacaccgttactaacaatgatgatgtgtatcaaataacatcgtctaaaataaaagaggagatagttgaacccaccggcagtccggaacctgaagaagaggatacaaaaactgaggacgattccatttggggctacgatgatgacggagacccaatatacaaggtgaacggcggtcattacgagtttgacaatgacggcaatagatattttgttgatgattcacccaccagttctccggcggcagagaattcagaggagccaactgaattggaatcaggaaataattttgatgaattgaaccggacttcaaatggtgaaattatttacaacgctccgataatatatggagttggaataacaaaatatcaagttggacataggattcaaagtaatgatgaggacaagctggacaatgttatagaagctgtaaagtctttatcaaaaacgggacttttggaaagaaccaccaaaatagatgtaaataacataaatgatgtgaagttttgggtcgaagacagactggaagtatggtttggtacattcgataactttgattataaagtgaaattcgtaacttctgttattgacagtaacctatcaaagtatgaagaatcgatactggatttcagggattcaaaactgtatgtacgcagtattgaaacaggagaacctaaagtgctggaagttagtccggagccggatagtgatgaagaggattcaaaatcttcggcaaaaccgaaagcgtctcctattccgacagatgatgaggatgatgaaggtttagcggatgatgaagagcaggatgaagaaaatcccacatcaactccgaaaagtgataattctaaaaacgaatcaaaacatactcctactccaaagactcagagaaattgatagtcagtacagatttgagttagacagcattggtatggtattggtaaaaggtataaaagacaagggcgatattaaaaataatccaccgttagaagaagcgtttaatttaggtaagtgtttaatttagcaaaatccaatttgagagaccaatccatttcgctttttcgggataggagcatatacttttaagctgtttttaataccggcaagcaggacaaagcggttataatttgcaaaaaaaataggacttcattttgtttggagcggattccgaatgttagaccaagaatctaacaattggggttagctcacttaattgaagtcctatttttgttcgctttaacaatgaagtgaaaacagtgcctaagatttgaaaattacaaattctttaaaaatattttatacagtcttttgtatataagactatattcatttataagtctgttataaaatgcgttctctattatataaagcaagctatttgtcctaaatttttaaaatcttttttatagtttgtttatatcttagagaaagtaaaataggttatatataatattagttttggtgtgtgagagttatcttatttttccagccgccatatatgcgggtcttttctaaagattaagcatgtgataagtccgataaatcccagccataaaaacaaaaaagcggctccggcgccttttccttgcccaaataatgtaataaatatgcttgcggctgattgtgacgccatgaacggttcaaacactttgtcaaccaagaatcctcccataaagtaaccgattggtatagtgaaaaactgtaatgtgtttcttgcagaatatactctgccttgcatattaagagggatatggtttctgaaaagaacatccatgtttgcgttcataaacgggatggctatccatcctaaaaatgctccgatacaccaaacgggaacgctttttccaaatgcaaggaaaaagttttctgtgctcattgcaagcagaagagaattgcaaattatacgaacccggcttttgggtgatggaatcagtgatacgagtatgcttcctccaaccattgcgagacctgataccgcattgactattccgagtgcagactcactgccggagcttttggatagaaccatagccggaagcgctgcttcaaaaactgaagcggtaaaatttattgcagccaaaaatagtatgaggtctaaaattccacggttgtgtctcagataccgtattccgcttttggcggattcgagcacggattctgctttagcgttctcagttgatataacttttggtatttttacaaagaacagcagtgataagaaagctattccgaatgtaaataaatcaaacgcaataatcgtttgaatattgctcagcgccagaagtgcggtagatatgacgggagtcataacgtttaccaatgaatttgagaatgctctcataccgctcgccttttgataatgttttttaggtgtgagcagactgatagtaacatctgccgacggttgctgtattgagttcataagaccgtttagtgcattcaaacaatataaatgccatatttgcagtttgccaaacagcagcagaatcaggacagatacagtgcaaacagcagcaaaactgtcgcagacaagcatagttgcttttttattccatttgtcgcttaacgctcctgcaaatatgcttataatgacataaggcgcatatgaacatattgaaagcattgaggtttttaaagcggacccttgctgctgatatgaccatattattaacgcaaaatttgtcattgaactgccgagggttgaaaatgattgtgtgagccacagtataataaacgaatgcagctcatatattaatttttttattttattcatattgactttgctccttttaattttgaaattatctcataaaatgcaaagtcttttagggacattctgttttattgctctatgcggttcgtccctatttgaccttgcatagagcttcagcaatacaaagcttcatttttcctcctaagtatttatttaaaatataaaattttattctaagccgttcattacaaaatccacaagatcctgtgttgaatttggttttgctattgacttcattgcttcctgcataagtttcatccggtcatcgttaacaaacatttgataaaccgcttcatctattggatttgtgctgcttatccgcatggccgctccggcgtttaatagaaactctacgtttctgtcctcctgacccggaatcgggttattaataagcattggtatctgttttgcaagcgcttcgctggtggtaagccctccgggttttgttataatacagtcgcaggcgtccataaacacatcaacgttgttgatatacccataactgtatatttttttccgtgtttccatactgtctatttttgttttaagctttttattgtttccgctgacagatacaatttcaaaatccatatcaagcttatccaattcttcaatttctttatatacagctccaaaccccatacttccgctcataacaagtattgtatgtttactgtggagatttagaatctctttagccttacttttctcaatttttcttgagaatttagtaccgattggtattcccagcggtaaaaacttgttttctggaaagcccttttttattccctggatagtaagcctttcattagcgataatatagtaatcaagcaagctgtcttcccagtaaggatgtatagtgaagtctgttattactccaatagttttagcgttaagatgttctattgatgaaatataagtaaccagcagcgcagcgaatatgtgtgtgcaaataataaaatcaggtttttctttttgaataagttttatcagacttcttgacaaaactgaatttgttattctattcagtccgtgtatgccggcaccggactgtactccgcgtttttcgcacattctatatacgccgccgtagattttaggtatagctttggtggacataagataaatcttatttacagaatctgataaaatcgggtttataaatttgtatacatccagatatttgcattcgacgccgcactcgttgaaacgtttgctgatcaccatggctgtttggttgtgtccttgtcctgctgttatagataatactaaacctttcattggacttcctcctaattttgccggtttgtgtgttttcagtatttatcagggcttatatatttacagctgttccaggtttaagaaaaaatataatccgctcctttattttctttccaaatattgattcaatgccctttgtgtaataatccatttggattttgtatttttcagcttgtttaggcgcataaatggcagaacagttgtcagtcttataatccaataaaactatctcgttgtcttcgataaagaagcagtcggcgacgccttgaacaatgatttgagcgtttttggaatcagaacttactttatctccatatatttctgaagcgcttacaggaaacaagagtttaaattctcttttaagacttccttttaaatatgcgttccgcattcggcagccgatttcagaactgtaaaatttaatgattgaatctttatctattaaagaaatttgactgttggttaaaacattattggcataaagtgatgttatttgttcagttatttgctcttcagactgagtaaactccgggtttatgtgctgcattatgtagtgagtgatagttcctatttcggcggcgtctccgctggaggcagagtggaatgttctgtcggcgatactgcttaaaatcggagtatattcaccatcctgctcggttagactgtcctgcatgcttcttttaatttcactaactgaaagttttaaggggatacgggtcaattcctcattagggtataaataattaaggttgttatacaattcgtcagcgagctctttgcttatgggctcgtctgttggttttgaaatcgatatgttttcattgattgttttttcacagtctattgattctttttgtgataagtttatattttcatccgtataacttatatatttgaattgaatattctgagcttcatcaatttttagctcggatatgtcggattccattacctctctaagttcttctgcgttcttttgcggcaagtatcccaagactatccaatccctgaaaattttgctgttttcaaaatatggactgatgatttctccgcgtgtgttcaaaattggacgtttccagccttttgactggccgggagattcattggtgcaggaaattataagtttttcctttgccctggtcatggctacatataaaagacggatttcttccgcttttgattctttcgcttttttatatttgattaaatctaatgaaagacatgagtgttttatacgtttatctacatcaatatattccattcctataccgtatttttcatcgtaaagaacagaatcaccgccgggtctgccgtaagtagttccggctaaaattacaacaggatattcaagcccctttgacttgtgaactgtggtgattgataccgctgacgatgcgccgttggtgcttttggcttgtcccatacctgaagagctgtcgttaattttgttaagataatctacaaaactgaaaagacctttaaaagcgcgtctctcataatctcccgctctttgaagcaatattttcagattggcctgcctgatatttccgccgctcaatgatccggctaccgctagataatctaggtcatagcatattttatatatgagttcatccgtacccatatattttgaaaaaccgcgcattttatttaaaacatcaaaaaattttttggcttttgtattgtcgttttgcgcggcagttttaacacaataataaaagttgccgtgccggtttaaagttcttatttcggcaagttcatcggctgtaaagccaaagatagggcttctcatgacagcaattaagggtatgtcttgcagtggattgtctattatctctaaaaaacttaaaacagtttttatctcaatagtgtctaggtaaccttcgctgctgtcagaaataaccggtatattatattctcttaatacctgttcgaatataggagctgtattctttgtagagcggagaagaataacaatatcgccatattcaaccggtctttgttctcctgttttcgagtcgtatacatacagtttatcaaacgtcaccaattttgatattctttctgcaactgttcttgcttcaagctcatgtttgttttgaaacgcagtttcgcgcgtgtcagaacccgaagatttgtccagcacgtcagtcattatcagctctgttttataatctgagggatttttaacttccggataatctgcgccgctttgcagccgttcatcttctgtatagtctaattctgctgtagatttagacattacgtttttaaatagatagtttacgctgtctataacattcttgcggcttctgaaattgtctgacagacgtataagatgtccgttgttattttcaccggagtattcggtcagcttattaagaaacaattttggagacgcgtttctaaatccatatatgctttgttttagatctccaaccataaatatgtttctttttcctcctgatataagctgaaataacttgtcttgaatattatttgtgtcttgatattcgtcaacaaatattgctttgtatttattgctcaaagttttacaaaattctgtcggggagccgtcgctcttcattatcagcttaataagctgatgttctaaatcactgaagtcaagtgaggaacgcaaaagtttcagacgcgtatgtctgcgttccagcataagtatgatattttttaacgtttttatccgaggatacagaagacttatagagctgcttaaactatctatgctatcatatgaaaacagtctgttacttttaaattgtttttttgcttcttcccttatatccgctatatttttgaggatttcggcaagatacgcgtcttctttgtcttttttgctgattctgggtttggttaaaaattttatgttttgcctattctctatatattcttcaatattgccgcacttcattatattacgaaacatctctgcttctttttcaaaaaatactgcgtgtgtatgttcttcaggcagttccttttctgatatttcaataattgtattgtaatagtcaagaatttgtcttgttgaattctttatgcagcttagaaatatattttcccactctgtgccggatacagtacctgatttataaacttcaaaatacattttgacagagttgttcagccattttgatggttctgccaggcttcttgaaaacttgtatatattggtgattgcacgtctgagattatcatcattttttattccgccatgacctaaagtgagctccttaaaagatggcaatatgtcaaagcgttcatagtatctttccaaacaatcttctaaggcatctttaagcaaaagttcattttctgcttcgccgattagagagaaaccggccgggatatttgttagatgaatgttattgctgattattttttgggcaaacgaatggatggtggaaacatcggctgcggcaattttggtggtttgagacctgagatgctgattatcaggaatttcttttagctttttttctatagcggctgctattttgtttttcatttccctggctgcggcgttggtgaaagtcaaaacaagaatttcatcaacggaaacaggttcggtagggtctagtatttttctgattatgcgctcaactaaaacagctgtttttccgcttcctgcggctgcagcaacaagaatattctgtttgttttcatatgtaatagcctctttctgagctgcggtccaattcatataatccctccgggtctagtaccccatggtgccttcaagcgattcatcgttttcaatccatttatcaacagggataacttcatattctgtcggtgttcggcgtactattacctcttctataccggcgtttataaccagccttttgcacattgcacagcagtttgcgtcacctacaagctctcctgttttggcgtctctgcctgccaaatatagagtgccgccaatcatatcacggcgtgaggcgcttataatgcagttggcttccgcatgtacgcttcggcacatttcgtatctttcgccccggggaatgttaagcttgtcccgcatgcagaacccgaggtcagagcagttgttccgtcctcttggtgcgcctgtatatcctgtcgatataatctcatcatttctgacaattatagctccgaaattgcgccttagacaagttccgcgttcgataactgtttctgctatatccaaatagtagttcgctttgtcgactctttgcatattatagccctcccaaaaacaaatttatctatattataagttattttttaaaattattcaataggtttatattgactttgttgcataatgtcaatataatataataaagacttcattttattgaagaaactaaagatagaggtaaatatatgaaaatatataagtctaactcggttgaggatactgcgtcagctgccggtgaattggcggctgagcttaaaccgggcgatgttattgctttggttggagatttgggggcaggaaaaaccgctttcgttaagggaatagcaaaatactttcattctaaaaatgatgtattgagtccaacgtatactttggttaacgaatacggcggtgatattccaatatatcattttgacgtataccgtctcgccaaccccgcgcttgatgaatgctactggattgatgagtatttgtttggcaatggtataacaattattgagtgggctgacaatattaaaaatatcttgcccgaagggactatacgggttgaaataaaggcgtatcctgaaaagggtgaagattacagggagataaagatatgttagtgttagggatagacacatgttgtatgccggcgacgtccgcagtgtatgacggagaaaaattggttggagaagctatagttaactgcggtaaaacccactcgcaaaaaataatgcctcaaatagaagctttgctcaattcgctggaactaaaacctgcagatatagattgttttgctgttgcggcaggtcccggttcttttacaggtgtcagaataggaacggcaacgataaaagcgatggcgcatgctgcgggaaaaccgtgcgcagcggtttcaacgcttgaagcgctggccaataacgttccatactttgacgggataatttgcccgattttggatgccaggagaaatcaggtatatactgctgaatttttaggagacggtactctaacgcgtgtttgcgaagataaagccgttagtttagaatctcttttggacgagctgaaaaatttgaaaaaaaaggttttgtttttaggagacggggttttggtttacagagaagaaattttagaatatttaggagataatgcaaaatttgcaaagggaaacaacaatctcaatatggccggctctgtagcggaattagggtatgaggcggcgctttcgggagatacaataagttatgcgaaactcgcgccgaattatataaggctttcgcaagctgagcgtgaacgtttggagagaaaaaccgaaacaaaagaaatttaaaggagaacataagacgtgaaatttaaaagaattttttcagctattttaattttgttaatgagtgcagcaatttgtctttcacctgtattgatttattctgaaaacggaactttttcatcggattcatccactgtcaggacaaataaagaggataattcggacgaagaagataattcagatacaaattctgatgttaaatctgataagaagacaaatgatgacgatgatagggagagcggtaccataaggggaagcaaacctacatcaactccggccgcaaaatcttctaaatctgcttcttcaaaagctacagcaactccggaaccaaaggccgaaccaactaaaaatccgagagtcggcgacggcggaaaaccgattttggctgagcaggaggccgctatattagtaaactgtctgaatggagaagttatgtttgaacaaaattcagacaaacagatttatcctgccagcactactaagataatgaccgctttgctaactttagaagcaatagaccgcggcgagataaatttaaattctgcctttcttataaccccggatatgcttgaagacttacctgccgacggttccagtatgcagcttaaagagggcgaagccatgacggttcaatatctgctcgagggacttatggtggagtccggaaacgacgcagctcaagctttggctgtaattgtttgcggagatgttccaacttttgttgagagaatgaataacaaggctgaggaacttggtcttagcggaactcattatatgaatgttcatgggcttcatgacgaggagcattatacgactgctgcggatttatgtacgttatcaagagaagctatgaaaaataaaacttttaggagtattgttgctatgtcgcaggcaaatattccggcgacagataaagttggggcaagaacgctgataaacacgaacggattgttgtcaactttaaaatatcccaattatttttaccagtatgcgacaggtataaagaccgggcacacgagccaggctgggtattgtttggtgtcttcggcgcagaaaggcgatcttgaggttatcggtgtcgttatgaattgcaagacagaggacgacagacattacgattcaaaaaatatgctggcttatgctattgataattataaggctgtgacagccataacaaaaggagatatggtcggcgagataaaggtgcgtttcggaagcggcacagaccatacaacattatcaaccaacagcaatattatagttacggtgccagaggacacaaattccgaggatttgaagatagagacttctctgcctgaatatatggcggctcctgtaaacgagggggacaagataggaacagttaacgttgttcttaacggagaagttgttgggagcggagacttaatagctgatttttctgtaaagcgtcatccgcttggatttcttatgcagttttttagttatatatggagtttttggttcgtaaaaatattaatagtcattttggctgctgctttagttatatttataatttatatgataattaatataagaagaaatataaagctggctgaaatgcgcagaagaagttcgcgttcaaaacgtcctccaagaagataaagaattaaataacaattaaatagatagaattttaagtaaaatatgaacaaaaaagatgaattgttaacataaaatatcttgcctagtcagttatttcgtggtataatatctcaaatatattttgtatataatgataacggaatatttttatgtttcgaattctatgaaaacccagcgcttggctgttttatcggaggattatttcatgactgaacctataatgacttatatctggacttttatattggctgttatgcctatttcagagataagaggctcaataatttatggcttgtcacaagtcgatcacaactttttgaatattttatttatatacgttttatctgttattgctaattttttacctgttccgtttattctattagcgttccgccctattataaagtggttgaaaaagaccaaattgttgggcaagttcgctacatggcttgaagcaagaacacatagaaaggccggggatatatccagaaaaagctcaaaggcggcggctgttgcgatatatatatttgtttcaataccttttcccacaacgggagcgtggacaggttcaatgattgccgggcttcttgatatgagagcaaaatatgcattgccggcagtgcttttgggaataatgaccagcggagctataatgactttgcttgttaccggcgctcttaatttaggttcgttcggcgaatggcttacacattaaaaccgtttagtaaatttttatcgtaattatgatactatgaaaggaattttttgatgagtgatataaattctcagaaacaaaaaaaacagtcggctaaaggcaggaaatccatgcttattattggtattatactcttaaacatatcaatatttatggcggcatttgtgttttcatttaatatgataatcaatccaatagaaaagcgtgatatccaggtgcagacgctgactgacgagaatacaaaacttaaaagtgattctcagcttttgcaggaccagctggatgttgtacagtcagaacttgattcatataagaaaaagtatggaggttcctcaaattcaagcaaaagtaatgcctccggttcttcaagcagcagtaaaaacaactctgaaagcggagaaaaatcttcggacagaagcagttctaactcgtcaaacgaagacgatgatgaagacaacagttcctcaagaagcagaaatgtttctgggagcggatcaagcgagagagacttaaatatggataatgattagtcttaacgacttaaaatatagctgaaatacttgtttgaaaggggaatggaaatgaaaccgaaatacaaaagaataatgataaagttaagcggagaagcgatggctggagacgaaggctttggtcttgatcataataagattgacgctatagctaaagagataaaaaaatgttatgatatgggaacagagataggcatagtcatcggcggcggtaacttttggagaggccgcgacggcgagggtatggatcgttcaagagccgatcatatgggtatgcttgctactgttataaattgtctcgctatgcttgacgcgcttgaacagctgggcgttgaagccagggttcaaacggcgattgagatgagacagatagccgagccttacataagacttagagctggaagacatttggaaaagggaagagttgttatatttggctgcggaacaggtaatccgtttttctcaactgatacggcggcggctcttcgtgccgcagaaataggcgctgaggttatacttttagctaaaaagatagatggtgtttatgacagcgatcctaatataaacccggatgcaaagaaatttgataaattgtcatttatggacgttcttaataagggattaggagttatggacactacagcggcaacgctttgtatggataataatatacctttgctggtatttggacttgatgaacctgaaaatattgttaaggttttgtgcggcgagaatattggaactatagtatcttaaattataatataaaaagaaagggatgttagatatgaaggaatccgagaacaaaatgaagaaagcggttgacgctttagagagaaatttatctcaaattcgtgcagggcgtgcgaatcctgcaatattggatagggtaactgttgaatattatggtgctcccacacctttggcacaagtcggcactgtttcagttccggaagcaagaatgattgttattcagccttgggacgcaagtattttgggtgatattgaaaaagcgattaacgcgtcggatataggaattcatcctaataatgacggaaaggttattcgtttgaactttcctcctcttgatggtgaaagaagaaaagagttggttaaggaagtttcaaagcgcggcgaggaagctaaagttgctgtccgcggtgtgagacgtgattctatagagcgttttaagaaacagaagaaggccggagaaattaccgaagacggtcttcttgaccttgaggatgatattcaaaagctcactgacagatatattaagcttattgatacaatagttaaagaaaaagaagatgagattttagaagtatagacagttcggaaggggtatgactgtgttttttaaaatagggaggagaacagcccattccgggaagcttgatttaagccgtgtgccgaaacatattggtattattatggatggaaacggcagatgggcaaaaagaagaggtttgccaagaagggccggacataaagccggagctgataatcttgagagaatatgtgattattgcaactcaataggagttaaggctttaacagtatatgcgttttcaactgagaattggaatcgtcctaaagatgaagttgacgcgctgatggaactgctttataattatcttttgactgttgaagagaagtttaagaatagaaatatgaagcttcaaataagcggtgatattgctcctctttctcagaaaattaaagacgcgattgttcatgcggaagaagtcacttcaagcggtgatggacttatacttaatattgctttaaattatggcggcagagcggagatagttaatgctgccaggcttgccgctgctgcggtttctgaaagacaaattaccgttgaagatataacagaggagtattttggagggcttatgtatacttcgaatctgcctgaagtggatttgataatacggcccagcggcgaaaaaaggctgtcaaattttcttttatggcaggcggcatatgctgagttttggtacagtgatatatgctggcctgattttacaagtaaggatatggagcaggcgattatagattatcagaaccgtgacagacgttttgggcggatttgataaaaataaattgtaattatgagctttgttttaatttggattatttaagaaatttttgccggaaacgcattatttggagttggatagtttatttacggctttaggaggcgtggaatttgaaaccgagtttaaagatgagggttttaacagcggcggttggagtgccggttattgttttgattttattggctccgacttgggttatgctatgcacggttatattgtgttcgcttattggaatttatgaattctacgacgcagtgaatatgaaaaaagaagtgccgctgctttgtctgtttggttttttagggaccgttatactccctttgtgtgcgtttttgcttccgaaacaaatattaacatgcgcctatggatatcttgttattttatttttggcaatgctcggcagcaatcgtaaaataatgattacagacgtggcaatgctgattataagccttatctatattccttttatgctgtctcatctcctttttataagacgtttagattttggaaatatattggtttggcttgtgtttttaggtgcgtttatgactgattcgtgtgcattttttgccggaaagctctttggaaagcataagctttgcccaaatatcagccccaaaaagacaattgagggagctgtcggcggagttataggctgcggccttggatttttgctgtttgcttttattattaatacttttatttcagcatatataggcggagcagaaatgagttatatgcttatgtttattttgggtgtaatagcgtcttttgtagctcaaatcggcgaccttacagcgtcgcttattaagaggcagtttggaataaaagattttggaaaaatgttcccgggccatggaggaatgcttgacagatgcgacagtataataatggttgctccggttgtttttatttttgcagctcagataagtttgtttatataaaagtgtatgtttaataattttataactttaatttgaaagcggtaaagggatagggggatgtttgctgcctgtcccattatcgtttttcatttttgttggtattataatataaatatggtgatataatgaataaaagggaaaatttggatttaagagtttcaatattaggctcaacgggttctataggaacccaggcacttgaagtaatagatgatttaaaaggtataaaaaatattcacgttattggtatttccgggaataagaatataaggcttttggaggagcaggccagaaaatatcatccaaagctggttgctgttccgaatgaggatgacgcgaaacaattgaaaatatctcttgctgatacatctgtagaagttgtgtcaggttctgaagggctgtcaatggttgctgcagactcggatgtcgatatggttttgtcagctattgttggatttgcggggcttgttccgacaatgcaggctattaaatgcggcaaggacatagctcttgccaataaagagacgcttgtaaccgcaggtaatctttttatggaagcaatagccaaaaataatgtgcgtctgcttccggttgacagtgagcattctgcaatatttcaaagtatgcttgccggaaatcacagagaggtaaaaaaaatattgctcaccgcttcgggcggaccattttttggaaagacgagaactgaattagtgaatgtaacgaaaagtgacgcgctaaaacatcctaactgggatatgggagctaaaatcacaattgacagcgccacgcttatgaataaaggcctagaggttatagaggcaaaatggctgtttggcgtggatattgatgatattgaagtcgttgttcacagagagagcataatacattctatggtagaattttgtgataacagtataatagggcaaatgactctaccttctatgaagcatccaattcagtatgcgtttacgtatcctgaaagacttccgtctgctgatatgcaggttaattttaaggaattgggtaaaatgactttttatgagcctgaccgtaaaactttcaggtgtcttgatttagcagaaaaggcaggaaaaattggaggaaccatgccaactataattaacgcggcaaatgaagcggcagttaatggttttcttaatgggaaggtgaaatttttagagattgcagagattgcagagagcgctatgagcgagtttagttcgattcagaatccttccctaaacgatattattgagactgacagagaggtgcgtgagactatatgtcaacgtttttaacaattttagcggctattattatttttggagtaattattcttattcatgagcttggacattttataacagcccgtattttcggtgtgacagtaaacgagtttgctataggtatgggaccggttatttataagaaacaggggaaaaataccttatattctatacgtgcagtgccgatgggcggattttgcgccatggaagcagaggatgaggaaagcgacagtccgggggcctttactaataaaaagccgtggaagaggataatcgttcttgctgccggagcggctatgaatattattatgggatttattattgtaacaattatagttataagttcagcggcttcaacaggcggaataacctcaacgactattgacactgttgaatcccaaagcgacgccgcaaggtttttgcagccaggggataaaatagttggcattaacggaacaacagttcatataaagagagatatttcttttgaattgggtcagtacagcggtgagggagaatgcgaattaaaatataaacgtgacggaaaagtttatactgaaaaatttactcctatgcagaccaccttagaggatggaactccatattattatgtgggatttaccgttaagcagaattccataaatcctctgtctgttcttcatgaaggcttttatcaaacaatttggatggtaaaacttgtatttgtatcgcttggtatgctgctgaccggaggtgccagcgtaaccgatttatccggacctgtcggcgtggtgtctgctatgagcactgttgcaaaaacgggattggctgactttattttctttgccggtttccttgcagtaaatatcggtgttatgaatctccttccgctgccggcgcttgacggcggaagaattctgtttgtgcttattgaaatgatattcaggaagccgatacccagggataaggaaggatatgttcattttattggatttttgcttttaataggactaatgttatttgcaacttggaacgatattgtgagactgctgtccggatttttcgggtagcagcagataataatttaaatctcttacagcaacaagctgtgagagattttttaattaggagactaatagactatatgctttttatatttttaaaaaattatttatgacattaattctgccgccaattttgatgtatgataataatgcagaacagcagaacgtcacgcaaaataataaatttatattcttattgattattataagaaatcaaataccttataggtttctgctgtaacgtaaaaacaatatatttttaaaaaaacggataacctaaggagttatcggaccagatttggtgccaaacttgccgtacaagagcatgtgaatgcagtaaataatctgctaccataaaaataaacattaactgctactttacgttaattttttatgctgttataatacaaatataagagaaatgaaaaattaaaaggagtggcaattatgaaaactaatttgaaaagaagattgtgtttaattatttctctggtatttttactgagtgcagtaagtttttcagctgcagcgaatcaaaccactgtgtctttaattcacagtgagggctggcttgaaacagcatatgtgacttggaatgaatattcgggtgctgatggttacaatgtttactgcaaacaagccggaggggaatattttaagctggatgatgaattggttagaacatatccgggatatttcagggcggacgctttgggactgcctgagggtgaatatattctaaaagtggttccggtaaaaaacggcgctgagataactgatgcatcagccgaaacaggagcgctgtccgtgatgaaacatgcacgcgagggttttgctttttctaaaaattctccatacggaacatcaagcggcgcgtataatgatgacggcacacttagagaagacgcagatgttatctatgttacaaacgggaataaagataccgttacaataaacggcgatgaatcgttgggagttggtctttataatattttggcttatagggagtcaaagaagataaagacaactttgtgcataagacttatcggccgtgttgatgaaccggcgttaaccgacaatcatacagtgaggtttattaacacgggtaatataactttggaaggcgttggcgacgacgcgctaatatatggctggattatcacactaaaaagaagcagcaattttgagatgagaaatttcggaatgatgtacggcggtgaaggaaccacaggttcggctgttgttcttgatactgataataaaaacttttgggcgcacaactgtgactttttctacggtgcgccgggcaaggacgctgaccaaattaaaggcgacggagctatagatattaagtccaggtcagattatgtgactgttgcgtataaccatatgtgggatttgggcaagacttgtgtctcgggcggtccgtgggaaaacagcaatatgtatactgatgaagccaagatttatgctacatatcatcataactggtttgaccatacagactcaaggcatccgagatgcgtagttggcagcaaccatgtatataacaattattatgatggcaatgcactttatggaatcggtgcggcaatgaaaacatcggtattttcagaaaataattattatagaaattgtcaaagacctatgataatagcgtctcagggcagcgactgttacaactctgaaacaggaacatataatgataagggaactctttcaggacaaatgggcggtatgataaaatcctacggggacgtaattgttggagcaaaaaggttttatacatatcagaatactcctgacgagggagaatttgacgcatatatagcaaacagccgtgatgaggttgtgccggaaacggtaacagccaaaaaaggcgatgaagtaggaaaagggacatataataattttgataccgaccccagcattatgtatgagtacagtgtagataccgcggaagaagctgttgaaaaggtaaaaaaatatgcgggcagagtaaacggcggagactttaagtggacctttgataatgcggctgaggatacgaaccacgaaataattcctgaacttttggaggctataaagtcatataagtcaaaactcgttgctgttgcaggaggcgctgttccagtagaaccgccttatgtaacgcctacatctgagcccaccaaagacccggatgcaacctcggcgccaacggcaaaacctccgggagatataacaaaaataccaacgggcgtaaccagttatgcaaaggattggttcggcggagaaagtatgtctgccggagatatatcaaatgatggttatgtcggctgctataagggaaccggaaacagttataagacaaataagtttacggcaggagatgtatcaataacaagaggatatcaaactaaacaggtagattcacgttcattttattgtattcctgaaagtgaatgtttggtaacggtgtatttttattcaaacggctccaattatttagggttgtatactaccgatttaagcacaccggcagctacttttacacctgaggcaggaggggactgttcgttcgcctatcattttacagaagtgggatcgccattgtatatagccggacctgtcggagatataaatttggctggtatttctgtcacagaagcgggcagtaatccgacggaaagcccagcacctacatcggttccgtttgaatatcaaataaacagcgccgaatatattaacgggaatcttgaagttgagataaaatataataaaacagacaattcggaaaatgcaagtctaatcgctgctgaatacaataaatccggaatactaattggtattaagacggctgacgttttaggcagtggaaaatatgttataaatggattgcaggagacagcagaaaataaagttgtactttatatttggaatagtgctgataaaattacaccgctttcagacagttacgaagttaaataatagaaaataaattaaaagtaataaatttcttcccaattaaaaaactgcataggagatttatgacaaaaaataaaaattattagctgttctatgatccggtattataataccggatcagatttttttaaaatattagatgtaacatggtttgtaaatttcattttaatagtgaagataaaattaactaactttatttattaagtcttatgactttttttgttttatttaatgatttaaaatattaaaaaatatataaaaacaaaataataaacagctatgttattttgggttgtaaaaaaagtatttactataactttagtgttatggaaaataaatctgaaaaacttaaatttttcggataatataaattatataaatttttacttgacaaaatttttaagctatggtatattatatcggtaaccgcgcagaaggggttttattaagttgcggaagccaccccaatggcgagtcttgggtaataggaggtattacgattatgtacgcagttatagaaacaggcggaaagcagtataaggttgaacagggcgatacagtttttattgaaaagcttgatgttgaagccggagaaactgttacgtttgataaggtcttgattgtcggcggtgacgacgttaaagtcggcgctccttacgttagcggagcaagcgttacagctactgttgctaagaacggcaagtcaaagaaaattattgtttataagtacaagcctaaaaagcattatcacaagaagcagggacataggcaaccgtatacaaaggttgagatttcagcaatcaatgcgtaagtattgattttcataatttttgatagcaaggagtgattaagaatggctcataagaagggaatgggtagtaccaaaaacggaagagattccgagtccaaacgcctaggcgttaaaaagggcgatggtcagcctgttattgccggaaatatcctcgttagacagagaggaactaagatttaccccggagtgaacgttaaaaagggtagtgatgatactttgttcgcactcgttgacggaagagttaagtttgaacgtaagggcaagacaaagaaacaggtttctgtttacgaaattgttcagtaatttaaacagctatagtggggtggactttgtccgcccctttgtttttatatattaagtttaaaataattgtataggattattgttttaaacttaatatatagttagagctatatccagcgctcttagagcggaacaggaggaaaaatatgttttcagacagtgcgaaaatatttattaaagcgggtgacggcggaaacggagcggttacctttcatagggagaaatacgtggcggccggcggaccggacggcggcgacggaggaaaaggcggaaatgtcatttttgttgctgataagaacgttaatacgctggttgatttcagatacaaaagaaaatttgccgctgagaacggcggaaacggcagagacgcgaacaggaatggcaaaaacggcgagcatcttaggattaacgtccctgttggaactatagtcagagatgaaaaaacgggacttgttatatgtgatttgaaacaggacggcgaggagtttgttattgcaaaaggtggtataggaggctggggaaacgcccattttgcgaccgctaccagacaagtgccgagattttcaaaaccaggcgcgcctggcgatgagagaatggtaactttggaattaaaattaatcgctgatgttgggctgctgggatttcctaatgtgggaaaatctacattcctatccattgtcagtgacgcgagacctaaaatagctaattaccattttactactctgcagcctaatttgggtgtagtgaatatgggtgacggttcatttgttgtagctgatatacccggaattattgagggcgcacatgaaggagttgggcttggtcatgagtttttaaggcatgttgagagaacaaagctgcttctgcacgttgttgatgtttcaggaattgaaggcagaaacccgattgaagattttgatacaataaataatgaacttaaactgtatagtgaaaagttggctcaaaaacgtcagatagttttagctaataaatccgatataccggggtttgaagaaaattatgaggcgtttaagaaagagatggaggacagagggtatacggtctttaagatatcggcggctactaaagcagggataagcgaagttctgaaatacacctatgaaattctttctaaaattcctgatgaggagtttgaagaagaatacgaaatgtttgatttggagtcagacagaaaagctgacgatacgattacagtcagtgtggaagacggagtttatcatgttgagggcagacgggcacagtttattgtaggttctaccaatatggaagattatgaatccctgcagtatttccagcgtgcacttataaaaagcggtgtaatagacaagctaaaagaagccggaatccaggacggagaccctgttgaaatatatggatgtgaatttgactatgttgaataattttttaaattggcttagtatctcggggtttaataatttgcatatactggagtctgtaaaaatatatttgatgatgctgccttttattgtattggcgcagtgtttaatagctaaaaattcacataaattaggtaatgattataatctgcaccgtgtcattacggtgcagattttctgctttctatgcgtcggcattttaacaacaacaggtgttcctgatataaaatatattattgctcataaatattcactggacttagatattattaattatagcaaagcggcaatggaaaggttgtctcctattaccagcaaacttatttatctttttaatccggctgaaatacatattaatccgtatcgtatgtattttaatgaccaaatgagttatattctgaacgtcattttatttgttccctttggattcttattctctgttctgagtattgataaatcaaaaatcggatggaaaaggattgcagtaataggttttttgttttcattttcaattgaatttattcaattatttaataggagaaccacagatttagatgatttaatcaccaatacattcggagcggttttgggatttataatttatatgatattatataaaagaaaaagattgaattttattacgaatatgcggtgcagcggaagttttataactctttatgaatgtgaaatatatattgtattaatatatgttttatggttgttgaacccagtgtaaattcgtgtgaaattataaataaaaaagaaattatatggaaaatattgacatgaaatgtatttcatgttataatagcactaattcaatttgaatggtgctatttttttgttgtatttatataaatgtgaatttaaagaacaaattttggaggataatttatgaaaaaaagaatttgtttggcagtgtctgcagcgctgatttcatcttgttgtattggatatagtgttttttctttagaaaaaccaaatatattcgttaatggaaatcaaatagaaaccgacgcttttattcaggacggcgttacctatgttcctttgagggcggttagtgaaagtttgggcgcagatgttgcctggaatgaagaaacacaggaaattaatattagtcagtctcagtcaggcgcggatatttattcatatgctattaataaaatttcgcccagtactgttgctatagtggggaactataccggaaacactaccgcaacttatcaggataaatatgcggagggtatagctcatggtaccggagttgtaattacgtcggggggagaaatactgacaaacgctcatgttgttgaggatatgtcgtcaataattgtgattttgtcaaacggcgaaggttatgaagggaaagttaagtatatcgacagtgaccttgatttagctgttgttaagattgaaaaattgggtcttacggtagctcagtttgctgatgaaagttcgatttatccaggaaatcaagtagttgctgtcggaactccggtatcaatgtcactgcggaactcggtttcagccgggattatcagcggtgtaaaccgaagcacttcgagcgattataagcttattcagaccgacgctgcaattaatcccggcaacagcggaggtccgctggttaatttaaacggagaggttttgggtatatgttcttccgggtatgttggaacaggaattgaagggctcagctttgcgatacctatatcggacgtaaaatatgcaataaatcaatttcaaacatacggcaaagtaaaaagaccaagctttggaggggagttccaggagagcgcagctgcgaaatatggactgccaagtaatgaaggcctcacgttctcgggaatagttccgggcggagccgcagcaaatgccggaatacagaatggcgatatattaatctctgtcgacggcgtttatgtaaattctaaaatagactggaacgaactatcaaaaaactatttgcccggaagcggtgccggcgtgcaggtaaagcgaggggatagttttatagatacatatataacttttgatgaaaaataaaaatataagaattaaaagcggaggaaaataagatgaaaaatatttttaaaaaattattggctatggggattgcgctgatgatggtgtcagcatgtgtttatctgccggcatttgcggcttccggagacaatgaagaaaacaatgaaaatatagttgtaggcgatattttagacgagataggcaatgaaaattcagataacaatgaagtaactgaaaagaaaattacaattgcgtttaaaattggagacagtattttaaaaatcaatgatcaggatgttgctgtaacaacaccatatgagcagaatggcacaacgcttgtgccgcttagggttataaccgaggcgtttggagccactgtagaatggaacgacgctgatatgggcgttacacttacatatgaggatgttgtaataaatatatggatagacaggacggatgctttggttaatggtcaaaagactacattgcttttggctcctcagctgacaaacgatactacaatggtacctcttagatttattactgaaaattttggcgccgatgtttcatacgatgacgctacagaagctattttagtggagaaaactatagttgaggaaggagctgtaacagattattcttctatactgcataatacggacaaagagtatataggagacagctattacggatggtctatgaaagcgtcaaaaagtttaagcgtagcagaccgtgcgtttgatggaagaaatactgtttttgcttatggagataaagcggctataggaatatttataacaagattaaacggtataacaaaagatgaagtgtttacattatttaaagagactgcaggtaacaaaactattacaaaacagtcggaaagcaaagattctcaaggtaatgattgtcttataatagaaacaaaatcatctactataaaagaatatcagaagcatattatatctgacggactgctttatacagttttagttgaagtcagtctggacggtggagacatggattctatttctcttgctgagacattttccataaacgtaaaggattttaaaaacgctgtggatttgtcagacgttgtaaatggcaagagaacttatgagaataaaaacttaaagttcaaattagatatgcccgccgactggtatgagtcatcaaataaagatatagaaaatgttataacttttacaaacagagaaagttacagtgataactcatacagctatgttggagtatctattcaatccgtagataatatttcttctattgatagctgggctagacatgactatgagggaaataaagaattatataatttggattacgcagaattcagtgacagcgtgaaaactaaatcatttttaggaaacgatgcaaagtattacacatacagtgttaagaatagtgatggcaaagtggttgaaactatggaagacattttctttgttcagggtgattatgcttataattttgcattcaaggttgttggaaacggcgacgctgatatagaggcgataaagaagtctgttactgttaaagatattgacaagtctaaagttggaagtttgttggttaaacaagaggatgatattacatatacaacagtaaatgggtcagctaacgtagaatactccgcaccgatgacatggaatataaaccgtgatgctgggagcaactcttcaatggtaaataatggcgtagatacgtctgttattgtttttgcaattgatggaaactatcgtattgaggatgctttgaattcaatgcttaaagattattcaaaaaagagtaaaaactataagttaataaagccggcctcttatactgctgtaggaagcaagaaaggataccgtgcggttttctcttatgaagataatcaaggtttggcttatataatggatatttttatttgcaatgacggtaataattgcgttcaatgtatgcttgatactccgatagagtattatggagcaaagaatataaagatttttgaaacagttattgattcggttaatgtaaaataatttcaagtttgaaaagggtttgcaagtaaacacctctttcaaaaatacttcacaaaaaacggtactctttttatggctaaaagtctgaagagagcgccgttttttcacgataatagaatattttgtgatttgctgtcataattttgtgttttgcatccccttttgtttaatactattataattagttatattttacaaattttaaaaatactcttgacaagcggggtaaaataagttaaaatatcagagttgtaaagttaatttgctttacaagaggttttatagactgagagcggactgaggtattatggagaaaaatgttaaagtcgcattattgtttgacttttatagaaatatgctcacttcaagacaggctgagagcatagatttatattataacgaggatttatcgctggctgaaataagcgaacatatggggataacccgccagggcgtcagagataatattaaacgggcggagaacaccttgtttgatactgaggatagacttgggcttgcatccagatttcttaaaataaaatctgatttgttgaaaattgatgatataatccgtgatattgaagcttctcctaatgtgaaatctctgtcagatgatataaaacataagattaatgatatattgattataatacatgatataaataatattgagacggaatagttttttgtgaattcggtggttttagagaatttattgaggtgtatatatggcatttgaaagtttatctgaaaaacttcagaacacatttaagaagctcaggggaaaaggaaaagtatctgagaaagatttaaaggcagcaatgcgtgaagttaagctggcgcttcttgaggctgacgtaaactttaaggttgtaaaagactttgtcagggatgtttctgagcgtgccggcggagcggaagtaatggaatcattaactccggctcagcaggtaataaaaatagtaaatgaagaattaataaaattaatgggcggtgaagctgagaagctgaatattgcttcaaaacctcccacaattatcatgatggcaggtctgcagggagccggaaagactactactgcggcgaaactcggcggactgctgaagaagcagggaaagcggcctttgctgtgtgcgtgtgacgtttatcgcccggcggcagtaaagcagctccaggttgtgggcggtcagctggaacttccggtttatgctgaagagggcgttaccgacgctgttggcatagctaagcgcggtcttgaacatgcggttcagcattctaacgacgtattcattattgatactgccggacgtcttcatatagatgaacagcttatggatgaattgaaagagattgtcagagaagtaagccctactgaaattcttttggtagttgacgctatgaccggacaggacgcggtaaacgttgctgataagtttaacagtgagcttgaaatttcaggcgttgttttgactaagcttgacggtgataccaggggcggtgcagcattatctgtaagagctgtaacgcagaagcctatcaagttttgcggtatgggagagaaactcacagaccttgaacagttttatccggatagaatggcttcaagaattttgggcatgggagatatgctcagccttattgaaaaggctgaacaggctttagatttaaagaaagccgaagaactagaaaagaagctgatgacccaaaagtttactttctcggattttcttgaccaaatggaacaaatgaaaagtatgggtcctattcaaaacgttttgggtatgattcccggagtgaatgcaaaagctcttaaaaacgcaagtgttgatgagaaaaaaatggctcatatagaggcaattataacatctatgacgactgaggagagagagcttaaagataagcttactccgtcgagaaaagagagaattgcaaaaggaagcggtacttctatagttgaggtaaacgcattgcttaaacaatttgagcagatgcagaaaatggttaaacagctttccggcggcaatatgaataaaaagtttaaaagaaaagggctcggcggaatgatgggcggcccgggaatgggcagcaaaggcggatttccgttttaagcttcagagctttacagcagtataaatcaatagaaaaataataaaatttatatacattaagaattaatttggaggatttaaaaaatggcagtaaagattcgtttaaagagaatgggagcaaagaaggcacctttttaccgtgtagttgtagcagactcaagatttcctagagacggaaggtttattgagcaggtaggaacatataatcctatggtagaaccggccgctgttgagtttgacgcagaaaaggtacagaagtggattggaaacggcgctcagccaactgatacagttaagagacttttaaagaacaagggtattatcgactaattttaaatagtttcccttgcgggaggatgaaaaaatgaaagaactgttggaatttatagctaagtcaatggttactgaccctgagtctgttcaggttgaggttgtcgagaaagaaaaccttacagttctgaagctccatgtcgctgaaagcgatatgggtaaagttataggaaagcagggaagaattgctaaggctataagaactgttataaagagtgcgggcagccgcgagaataaaaaagttgttgtggacattttatagtctaaaggttatctcgttttgagatagccttttaacgtattggatattttgcgtctgacaagaggtggcaaatatgaacacattcgaaagaatatatgagatagtaaaacaaattcccggcggcaaggttgcaacttacggtcagatagcgtctttggcaggaaatccccgtcttgcaagagttgtgggttatgctctgcatgtcaatcctgaacctgatgaaataccgtgtttcagagtggtgaacagaaacggatgcacgtctaaggcatttgcctttggaggcgaggatcatcagagaatgatgctggaacttgacggagtaatatttacagatgatggaagagtggatttagataaatgtctgtgggatggaaatgtgaatacagttaaaattgaaaaatcaagcgatattacagaggagtaaaatgatgaaagatgatttgctggagataggaaaaattgttaatacgcatggtattaggggagaggtaaaaatacagccttggtgtgatgaacccgagttatttgacgagctggagtatttatttatagaaggggaaaaatataatattgtgcgtaaccgttttcataaaacatgccaaatcgttcagctggaaaatgtgaacagcattgatgatgctgaaagatttaaaaatcaaatagtatatataaacagagatgctttggaactgcctgaggggagatactatattgccgatattgaagggctcactgtaaaggaacagaacggcagaattttgggcgttgtcgacgaaataattaagacaggaagtaatgatgtgtattccttaaaagatacattcaacaaaaagccggtgcttattccggttattgaaggagtggttcttgagacaaatatagacggaggatatatagtagtcaagctgcctaaaggtttgattgatgactaggaatttatttcttgtataagttttgaaaaggaagcggggatttttcagttatgaagtttgatatattaacgctttttccggaaatgtttgaagccgtattggataaaagtataataggccgggctaaggaaaaaggtttgcttgaattaaattatatacagataagggattttgcatttaataaacacaggagcgtggacgattatccttatggcggcggacagggcatggtaatgcaggctgagcctatttttaaggcgtatgaaagcgtgactgaagatttaaattataaaccttatactgtttatatgtctccgcagggaagaactttcagacaatccacagcaaaacgtatggcaaaaaagtatgaccatgttgttatactttgcggacattatgaaggggtggaccagagacttattgatgagataatagatgaagaaatttctattggggattttgttctgaccgggggagaaattgcggcgatggccgtggtagacgccgttgcgcgtctgatacccggagttttaaaatctgaggaggctttttcggacgaatctcactatagcggattgctggagtatccgcagtatacaagacctgaagtttggcataatgagaaggttcctgatatattactaagcgggcatcacaaaaatattgagaattggaaaagaaagatgtctatagaaaatacttttaaaaagcgcaagagcatgcttaacaaagctcgtttgacagaagaagaacaagaattcgtaaaaaaattaaaattagaaaataaatagcaattttaataatttaaacgccttatttgaggaatacttaaatgaggtgtttttttctgtactgttaaaactgaaagccattttttgtaataatgataaaatttttataaaacagttgttttttgtcttataatgtggtaaaattatatttaattataattgtaataagtatgtttgaaaacagtatataaatgacccagaaaggtggttgagttatcaatgaagtgtgaaaagtgtggcgctgacattccggcgggagcgaaaacctgtcccaagtgcaatgccgctgccccccaaaacaccgttccgcagaataaaagtgttaacacaactgataaaaataagagtgcgtctgccggaaagaaaaatacaaattccaattccaatcagaagttaacttcgtcaggcaagattaatacttcaggacaagctccttccggtacagaggataatgagtttgacagacagtattctctgatgtttgaaagtaatcagtcaaatgttggagacgctgattatgaaattgatgaatctttgaaaaagaaaagggaagcaagatatgacgacagttttgctaatatgacagacgacgagaaaatcaaggcgttagaagcggcaagattggcaagaaaagaaagacgcgaaaaaaagcaggcaaaaagaagcggcggtattttttcctcattctccggtcaggataaagaaaataagactgttaaagaaacagttgaaaccggtgagcgttctgattcttctgctccattcggtcaaagaagccataaagctaccggcgccgcagagagaaagattgaaagagtacagagttcttctgatatttcaactgtaagcggatctgccgataagtctgctgcagtagaaaagcgcccgaaaaggagcagcaagcgttcaaaaaactttaaggtatcgcctaaaacaggtttgatagccggcgttattgttgcggttcttgttatagcggttgttatagcttcagtaaatatggcgtctaaagttactgcgggtgttccggcaacgccaacggtgtatgctaaggataactctctttattcctattatggaggcaaatcagtagaggtcagtcagaatttcatcgccagcgaatatacggaaccaactgaaccaacagcaactccaaatagaaacagagatgatgacgaggaagaaactcccacgccggcaccaaagtttgaacccataaaagaaaaagagcttataaattatactgctgacggaactttgtcttttttccttgataatgctgatttaaacaataatacaggttcattgcagtatactcagaacggcaaaaaaaattctacagttaagattgcggataacgtatattatgatattgagattgctgaagacggaagcggagttttatatttgacggatactgatgaatttggtgccggaggaactcttaatttctggtctaatatctctaaaaaggctgtaaagctttctgataatgtgaatattggaaatttccgattcggacagaacggaaacagtgccttatatataacagaatataacggcgagtattttgtaggcgatttataccttgcagaaataacaaaaggtgaggttgctgaggctaaaaaaatagagtctgatgtatacaaggtatttggaacaaatccaaccggaaagtccgtggtatatgctaaaaactataacactgaaaatgagtgctttgaaatatatcttaaaaatgataacttaggtgaacctgttatggtcacagacggttccagaatagaacctatcttcctgaaaaattcagagggtatgtatataggcggaacgtatgaagagtattatcagagcttatattatgcgagtcttgaaaatggcgagaaagaaaaaattgccggcgggcttacagagataataaagatgagcaaggatgaacaggctgtagttttcagaaaggcaaacgctgagggaacggcttttgattatttttatgcaaaccaagccgggacagaaggtcagctgatagctgaaaatgtgactgtgcttgatgatgaggaccataagaaggtatcacagtttgaaataaatgacgactttactaaggccgcgtttattcagggatatgatcttgctaatgagagcggagcattgttttttgtttcaataacgaacggagtggttggttcagataaaaaaatcagcgacactgcttattcatgcaatataacacctgacggacagacaatcagatatgctgataattatgatataaaatggaatttggtaacactgaacgcatatacaggcgaacaatcgaaggttttggcgcaggaggttggcgcaggagcattttcttttgataaaacaggttcatatattgtatatgctaaaaattacagtttagaaaccagaacaggagacgtttattgtgttgacaataaaggaaaaactgttgaggttgttaaaggcgtaagttcatatggcctcaaaaataatggtgagatagtgtattataataaacaagacaacggttcaaactttgagttgttctttaccagagaagacggtaagaagtcaaagtctattgacaaggatgttaccaaggtggtattatattaaattattatgaaaaaaatcggaataatgggcggaacattcaatccgccccatttgggtcattttgttattgcagaacaggcggccgaacagctggatttatgcagagtattgtttatacctaccggcagaatagtttataaaaatactgataaatcggccggaggctgggacagatataatatgctggataaggttgtttcaaaaaatccgatgtttgatttgtctgatatagagataacgcaggacgagacgacatatacggctaatactctcgcaaaacttcggaaaatttatccgaataatgagtatgagatatattttattataggtgctgattctcttgattatatcgaaaagtggtataagcctgagaagatttttgaacagtgtacggtagctgttgccggccggacaggatttactgacgaaaacatgaatgaaaagattaatattttgagaaacatgtattcagctgatattataagaatagatgtgccgtttatagatgtatcttcaagtatgctccgggaaagagtgaaagaagggaaatctatcagatattttacggatgacagtattatagaatatattttaaataaagggctttatcaagcgtgtaagaattaattctacggaggtgtgccggtttgttagaaatcgacgggataaaaagtgaattaaaaaaaatcctcagtgagagacgttatatccattctttgggtgtggcggaagaagctgaaaaattggctcggagatatggcgctgaccaatcaaaggcgtatttggcaggactggttcatgattgtgccaaagagtttccgccggaagagatggagggaattcttaaaactgaatacggtgtgccggttgattctatgtcgcgtcttatgcccaaaattctgcatggaccattgggagcatgcgaggcgcagagaaagtttgaaatttatgatccggaaattttagacgctattaagtatcatacaactggcaagggaaatatgagcacccttgccaagataatttatatagctgattacatagagccaaacagagactttgaaggtgtcgaaaaactgcggcgcttagcttatgaaaatatagacgaggccataatagccggtatagatgaaactattttagatttaatcaaaagaggtcttataattcatcctgacactgttcatgcaagaaacgatttaataatcaagcgcagccagagataagagtgcgtgtatagacaaaggagaagtcggtattatgagaagaaaatcaccgtttcgccgcatgatggctgttgtgttggtgattgtatttgcgtttgtgggttttaatttcggtaaaatgttctttggcgataacgctgagtcaagacttacagaggttacaaacattattgtggcgggcgtcgatgtggacggttacagaacggacctcattttatttgttcaagtgaataatattgataaaaaagtgagtgttctgcaaataccgcgtgatactaaagttaataataagagaaatgataaaaagataaattccgcttacttttcggggatagagactttgaaaaaagaagttgaaagcgttaccggactgcatgcggacttctttgcaaccattacttttgacgcctttaaagagattgttgacgctttgggcggcgttactgtagaagttcctatagacatgaattatcttgacccaattcaggggcttagcatcgagcttaaagcaggaaaacaaaagctagacggcgagcatgctatgatgtttatgagattcagaaagaatgacgacggaacaggatatcctatgggagatcttgatagaaataaagcgcagaaagagttttattctgcggtcatgaaaaaagctttgagcccgattggaatattaaaagcaccgtttttatacagtgctgttatgaaaaacaccactacagacttaaacaatgccgaggttagggaacttatgtttgatatgtttactattggaaagaataatgttaatatatatcagcttcccggagattctaaatatataagtaacatctcatattttgttgtgagcgaaagagaagctaaagcaatgataagtgaaaattttagataataaatttaagtttgtattaagaaaggataaaaaatatggcaagtactaatgagacagtgaataaaattgtaaaaatacttgacggtaaaaaaggaagagatattgaagtattaaatatatctgaacttacaacaatgacagattattttataattgttaccggaggttctgatacccaggtaaaggctttgtgcgacaatgttgaagaggagcttgaaaaggaaggtcttacacctgttaataaagaaggatataagacggcacagtggattcttttggcgtatgatgaagttgtagttcatatttttcttggggagacaagagaattttacggattggaacgtgtttggaaagatggaataagggtcgacgtttcagacctgctggtgtaaaaacagaaatatttaaacgttaataacagtaatcaggaaggaatgaataggattgaggtacgattttaagaatattgaagagaaatggcagaaaaagtgggaagacaacggagcatttaaaataaatgaggatgataacggaaagccaaaatattatgcgcttgagatgtttccttatccgtcaggcaaccttcatatgggccatgttagaaattattcaataggagatgttgtggcaaggtataagaagatgcaggggtataatgttctgcatccgatgggatgggattcttttggtctgcctgctgaaaatgccgcaattaaaaacggacttgatcccgctgagtggacttggtcgaatatcgataatatgcgcggacagctgaaacggctgggattcagttatgattgggaccgcgaggttgctacggctaagcctgattattacaaatttactcaatggatgtttgaacagttatataagcataatttggcttacaaaaagaaatcatatgtaaactggtgtccttcatgcaaaacagtgctggctaatgagcaggttgttaacggcaagtgtgaacgctgtaaaagtgaagttgggaaaaaggatttggaacagtggttctttaaaataacagattatgctcagaggcttttggatgatattgataagctcggcggatggcctgataaggttaaatccatgcagactaactggatcggcagaagcgaaggagcggagataagatttaagatagacggaatggataaggaactcactgtatacaccacgagacccgatacaatttttggcgttagttatatggttattgctcctgaacatccggttgttggtgaactgataaaaggaagcgaaaccgaagcggaatgcagggagtttataaaaaaggttcagaatcaaagtgaaattgtccgctcggcgacagatacagaaaaagaaggcgtgttcaccggaacatatttgattcatccattcacaggtgaaaaaatacctctgtatttggctaactatgtgtttttggattatggaacaggtatagtaatgggagttccggcgcatgaccagcgtgattttgattttgctaagaaatataacttacctataaaaattgttattcagccaaaaggccaaaatatgaagtcggaagatatgaccgaagcgtttgcggctgagggtataatggaaaattcagatcagtttaatggaatggacagcaaagaggcgcttgcttctataattaaatatatagatgaaaagggtataggagagaaaaaagtaaactttaggctcagagattggctgatctcaagacagagatattggggagctccaattcctgtggtttattgtgaaaagtgcggcgaagtgttagtgcctgaagaacagctgccggtgattttgcctgagaacgtggagtttaccggtcagggaaagtcaccgctaagcgagtgtgatgagtttgtaaatacaacctgtcctaaatgcggaggccctgcaaaacgtgagacggatacaatggatacgtttgtatgctcttcctggtattatttgagatattgtgaccctcataatgataagatgccttttgataaagaaaagactgattattggatgaatgttgaccaatatataggaggagttgaacatgcgattcttcacttgctgtattcaagattttttacaaaggcgctgcatgattttggatatttgaactgtgaagaaccgtttgaaaatttactgacgcagggaatggtattaaaggacggaactaagatgtcaaaatcacttggcaatgtagtaagtcctgaagaaataatagagaagtacggagctgatacagcgagactgtttatattattcgcggctcctcccgagagggatttagactggaatgacactgctgttgaaggggcttatagattccttaacagagtttggagagctgttgaagatttaaaatgttatgttatcagtgatacctccgatatgtctgatttaaatgatgacgataaaaagttaaggcttgcggttcacactacaattaagaaagttactgctgattgtgagagattcagttttaatacagcaataagttctgttatggaaatggtgaacgcgctttatgtctataaggaaaaggtgaacaaggaagactataacaagtcggttataactgaagctttggaatcgttagttatattgctttgtccttttgttcctcatattacatcggagctttgggagcttatgggcaaagaaacagatataacaagcgaaaactggccgaaatatgatgataacgctttagttgtagatgagattgagattgttcttcaaattaacggaaagataagagataaactgaaaatcaatcctgatatgagccctgatgaaatgaaagagctagctttggaaagcgaaaaaatacaggagcttatagacggaaaagaaatagtgaagtgtatcgctgttcctaaaaagctgataaatattgttgttaaaggataaaaactggagttttgcaaaagcggcgggaagagcagactataaacatatttgggtgaatggttgttatgaacagagttagattaagaataaacagaagacgaagaaacaccattattataatagttattatagctgttttagctgcatttttggttccttattggactgaacccgggattccggtatttatgtaccattgtgtggcggatgaacccaggggcggagatgaaaatttatattgccgtccggctcagatagaagaacagtttaaataccttagcgacaatggttatacgactttgtttgctgacgagtatgaacaggcttacagcacttataagcctgttatacttacatttgacgatgggtatgaggataattatattgaattgtttccgcttttgaaaaagtaccatatgaaagcaacaatatttgttgtttcctcatatgtcggaactaaaggatacctttcggaaggacagctgaaagaaatggttggcagcggtcttgtaagcatacagagccatacggctcatcatgtggatttatccaatgaagataaaagtcatatggatcaggaattcagagagtcgtgcgcggctttagctaagataaccggtaaaaatgtcacaactatttcgtatccgggaggttactttaacgataaggtcctgaatgaagttcaaaggtattttacatacgcatatgcgatagacacaaatgaatattcaaaagataatcattatgaaatatcaagaggcggcgtgtatagaaatactactttggaatcgttttctatggcacttcgcacctattcacaaagacgccttatcagagagatgtttaaattaaagcataagatttttggataactataatgcagagactatagcggtctctgcattatttatattaaaatattccgcttgcagatacattggaattgtttatgtaaatgaaaaagtatgttaattatatacttttggtcttatcaaggcttaggaaataagtctgcgagtgattaaaaaacaaaagcactcaccgatttaggtgagcgcctttgcacttatcttaaataatatatcattttgatctgtttgtcaacaataaacgggttaaatattgacgcagtcaaaaatacagatcaaattttctccgaatactggtgtttcaaggtgttgtgttttcttgaacattaattgttatttaaagcttaagcggaagttttgcggttacagtttctgactgctgctgcatggtgatttacagattgcttataaatcagactacgcccaaagactgttgtaaaccgtctgcagaaatttgcataacttgtaaaacacagaactgtttattaattcaataaattagtgattgctgaggcagactttttgttattaaagcttatctatgatattgccatacataaatttgttttaacgttataaatatatggctgcacataaacagctttgcaaaggtatcagcagcgtataatgattcaattaaatattacttgaccaaaaaatcttttctttaatttctgggatttttaaagataaaaatttatttttgaggttattgggataaatttgctgctttcaaaaaatattggtctaatacaaattgaatatacctaaatctgacatcggcggtataatcggatttaggcgacgctgtttcaacacaaagacttaacaataaccaacatacaaacacttgatgttgaataggtcaatacatctccgctgtagctcaaaataatctggttctccttttattatgagcagcagaaaacttttcgtcacaagacgactattttcgccgctcaatgtattctatgaggaaaagccgtaaatgtgtattatttatttaataaattataagataaaaataattatataaatttataatatttaacaaaagtcctccgtttaattagaaacggaggactttgctgacgaaaaacgtcttaaaaagggggaattatatatttttattatattcttttgtaattataaaatcaactattaacttagtattttatatataaagatgatattactgtataatagataaaataatcagttgtttagaaaggatgttataaataacatatattttgcaaagcaaaatgtagaaaataaataagtaaaaactattgacctaaaacataaattatgttaaaatatttaagtcatgttaaatcggggctttagcggtgccttgtaaccctcaatccgctgtagaggggatgaaaacttgccatgagggatatctttgtttggtctgcctcgcataagtggtgttgacggtttggtcttacgcaattggaacctgtgaacctcgtcagggcgggaacgcagcagcgataagcagtcattctgatgtgccgtaagggtgccaaacttgagctaactgtgggagtaacgcttgtaaagctatttcgaatgcaagcacatggcttttttatttatctgtgctttttaaaagaggtgaaggacaggtgtccgaaaaataccaggctttatatagaaaatggagacctatgacgtttgacgacgtcgtaggacagaatcatattacggaaacgctgaaacatgagcttgcttctgaaaaaattgggcatgcctacttgttttgcggcactagaggcacgggaaaaacaacaacagcgaaaatattctccagagctgtaaactgtgaaaatcctaaagacggagaaccctgtaatgtatgtgatacatgcaagggtattatcgacggcagaattatggacgtttatgagatggacgctgccagcaataacggtgttgacgctatacgtaacctgcgtgaagaggtgatttatacaccggccggatgtaagtataaggtatatataatagatgaggtccatatgcttacgatacaggcgtttaatgctcttcttaaaactcttgaggagcctcctgaacacgcactgtttattttagcaacgactgaacctcagaaaataccgcagacaattttatccaggtgtcagagatacgattttaaaagaatcggcgttgatgatattgccgggagattaaaaaaagtagcggctgccgaggcgataaatgctacggaagacgcgcttgaacttattgcggaaatcggcgacggttcaatgagagacgcgctaagcgttttagacagatgttctgcttttggtgaagagctgcggcgtgaaaatgtttctgaaatagtaggaatagttgacgagagagttttgtttaatataactgaggatgttatttcaaataatgtcagcggagctattgcgaaactggacggacttttgaatatgggtaaggatgttctgacattctttgaggattatatagaacatcttcgttctgtactgctctgtaatgagtgtgaaaaaccggaaagggtgcttgaaaagtcaccggaggcgattgaaaaatacaaatctcaggctgaaagacttactgcaacgcagttgatttatggaataactgttcttaatgaatatcacggcagggcaaaatctatggctattcctaggattgcggcagaagttgctttgataaaattttgtaaacctaaatatagttctgaggttgatgcgcttaatgcgcggattgaaaagcttgagcaattaattggaagaggagctgcggcagttcagctacctgaaattaaatctgaagcagtacatcatgataaaaatcctgacgcaccgccatggaacgctcagtctgaaaataaagatatagattcatcacaaaaaaaggaagaacccaaacctgctacttcgactgaaattaataatatggcctgggatatgtggcctgaggcgttggaagcgataaagcaaagcagcaagagattgtatatgtatctgtataaggcggaagtcatattgaacggtgatacggtcgatattgaagtagggctgaaatcagcatatgattcagttgcaacggctaacggtatagattatctttctgagttgttttcgaaggtagcaggaacaaatttgcgcgccagagtgtttatgaaaggtgaacattcaaagaaggagcaaaccgggagtcaggcttcgataatggatatagtgaacaagaaagagcagtttggagatataataaaggtgaaaggagaacaataacgatggcaaaaggatttccaagaggaatgggcggcggaatgggcaatatgaaccagatgataaagcaggctcagaagatgcaggagcagatggcaaagatgcaggaagagatggaaacaaaaactttttctgctgaggtcggcggcggagccgtttctgcaacagttaacggaaagaaagaacttcaggagattattctcaaggaggaagctgtagaccctgatgatatagagatgctgcaggatttgatagttgcggctgtgaacgaggctatgagaaaggctgataaggacagcgagacgcaaatgaacagcctgaccggaggaataaatattcccggacttatgtaatattttataataatacttatacccccgacgttttatatttcgggggctttttattttaatctattaattttgtatatttattcacaaatcgaatgttgtcgaaatatattgtaatgtagaagatttttaaaatggcggttgaaaacttctgtttgttatgttagaatagtttgcaatggtaaatttatattcagaattaattctgagtttaaaggtttatcatttttggaggaatttgtatggaaatatattttgacaacagtgccaccaccagaccatatgacgaggtggcttcggctgtctttgatactatgagcaataactacggcaatccgtcatccttgcataagctgggcatagaggcagagcgtgccgtaaaaacagcaaaagaaagagttgccgcaggtataaaagcaaacccatctgaaattttattcacatcgggaggaactgaatctgataatatcgcattgttcggaacggcctctgcaaaccgcggaagacacataatctctacgcctttggaacatccggctattattaacactttaggcgaattgagagagaggggatataagatagattatacccctgttgattcaaatggaaaggtaattttaaaggattttgaaaggcttattcggcctgatacttttttggtgacagctatgattgtcaataatgagataggtactattgagcctatagctgaaatggcaaagattttgaaatctgtaaacccgagagctgtatttcatactgacgcagttcaaggatttgggaaagttccgattaacgtagacgcgttaggcgttgatttggtttcattaagcgcacataaagttcacggccctaagggaatgggcgcgctttatatccgccgcggaacaaaaataaaacctataatatacggcggaggtcagcagcagggtatgcgttcgggaactgaaaacgtacccggtatggtaggctttggtattgcagctaaaattgctgcaactgaccttggtaagaaaattgagaggatgtctgcacttaaagaaagattaaaaaatgggattttaaattctatagataacgttagaataaatacgcctgataataatgcgcctcatatattgaatgtatcatttgggggaacaaaggccgaggttgtgcttcattctcttgagatgcaggatatatttgtatccagcggaagcgcatgcagcagtcataaaaaagaaccaagctatgtgttaactgaaatcggcgttccaagaaagatgatagatggaagtattcgttttagtctttcagaattttcaactgaagaagatgttgatattactattgaggcactaaaaaagataattccgagattaagaaagctaaatttaaaataataattttatattaataaatatttttctactttaagataaaaatatagaatggagataaaaatgcagaagatagatttaattttattaaagtacggagagattgctctaaaaggtcttaaccgtcccttatttgagcagaagcttattgacaacatcgcgtctgcaacggctccgattggtaaattcagtatcaaaagggcgcagtctactatctatgttgagccgcttgaagacggtatagatatgatggaaaccataaagcgtctgcaaaaggttttcggcgtagtcaatatctgtccggcagttcgctgtgaaaaaaatatggacagcataaacaagactgctgtggaatgtatgaaatctattgactgcgccggaaagacgtttaaagtagaatcaaaacgcgaagacaagaagtttcctttgaattcgcctcaaatcagcagggaagtcggaggggaaatattaaaaaatgttaaaggcttgaaagttgacgtgcataatccggacatcactgttcaagtggaaatccgcggtgacgcatatgtttttgcggaaaaattcagcggcgcaggcggtatgccggtcggcagcagcgggagagctgccttgttgctcagcggaggaattgacagcccggtagccgggtatatgattgcaaagcgtggagtaactttagacgcggtgtacttccacagtccgccttatacgagcgagcgtgcaaaagataaggtggttgatttagcgaaaatagttgcccagtattcaaggggtataaagctgtatgttgtgccgtttacggatattcagcttgatataattgaaaagtgcccgaaaaattatcttacggttatcatgagaagaataatgatgagaatagctgaaaagattgctttgtcaaacggtgcgcaagcgcttataacgggagagagtatagggcaggttgcaagtcagactatggaagctctttactgcacaaattcagctgtaaatcttccggtattcaggccgtgtatcggtatggataaagatgaaatagtgaaaatttcaaagcagatagacgcttatgagacttcaatccagccgtatgaagattgctgtactatatttgtaccaaaacatcctaagacgaaaccaaaacttgatgagatagcagaggctgagaaaaatctcagcgatattgaatttatgataaatgaggctattgagggcgcagaaattttgtatattaattaaaccaattataatggtttagaataacttatagaaagaggagtttagatgacatttgagttattgtcagtgggaacagaattgctgctggggtcaatagtaaacactaacgcccaatatcttagcagaagactgagtgaattgggctttaatgtatactatactacggtggttggagataatccggacaggctgaaatcggcgcttgagatagctgccggaagagcagacgcggtgattactaccggaggtcttggccctacagttgacgacctcacgaaagaaaccatagcggaatactgcggtttgaaatgtgttatggatgaggaaagcaaggagcggataataaatcgttttcaaaaaggcaattcctatatgcctgaaaataatttcaagcaggcggagatgcctgagggatgtattattttaaaaaatgagaacggcacagctccaggtgcgatagttgagggagaagactgcatttttataatgctgccgggaccgcccagcgagatgaaacccatgtttgacaatagcgttataccatatcttgagaaatattctgacggtgtgatacgttctaaatctttgctggtatttgggtatggcgaatctgcggttgatgagatgctcggagatttaatgaacaattctaaaaatccaactgttgcgccgtacgccaaaacagggcaggtggaactgcgtattaccgcaaaggctgatactgttcaagaagcaaaagaaatgttaaagccaatggaggagaaaattatatctatactcggagacaaggtttacggcagaggtatagataattctatggagaatgttgtggttcagctgctgcgtgataataagcttaaagttacgtgtgcggagagctgcactggtggtatggttgcggaaaagataacaagtgttccgggagcttctgaatgttttgactgtggttatgtaacatattcaaatgagcagaagacagagcttttgggagtgagcgccgaaacacttaaaagcgcgggcgctgtatcagaggaaacggctttggaaatgtcaaaaggcgcgcttgaaaaatcaggagcggatattgctgtttcaataaccggaatagcagggccggaaggcggcaccgatgagaaaccggtagggctagtttatatttctgtgtgtactgaagattttcataaggcgtataaatttaatctcacaggtgaaaggggaatggtgcgcgagcgtgccgctctatatgcgctagatttgattcggcgctgcgccttggggataatagataaagaggctgaatatatttggtgataaattaataggagatggaaaacccatctcctattaattttaataaagtattttatttttacatttaatgcgctttagaatatttgtttatctgtattccgcggctgcgcgccttacgaggcgtacttcgcacgcccttccgatgcttgcaaaaccatattttttatattcttctaagactttttattacataaactcttttttctgtttaatttttattgattttgctttgttgacaataatatgttttaaatatagtgaaaatagaaatatgtgatgatagtgtcagcggctaaatgaacatcggcaggccggacacagtccgccgcgttaggtgaattttatctccgccttcttatgaaagcggaatataaaggtgaatttgtctgtacaaaaatttatgttaataaataatgttgtttgttagagtgtatcttattttgagtttatcattcggtctataacggtcaacgcttcatctcttgttatatagtcgttaggcctaaatgttccgtcttcgtatccgttcatgtatccgcagtttgtcatttttgacaccggtgtgtaaaaccagtcgttaaagtccaaatcattataatttacttcagacttatctgttacttcatatataaattttgaaaaaacagcggcaaactcggctcgggttatattattgtcaggaagaaatgtcttatcatcataacctttcataatttgtttttcgtaaactgaaattactgaatcataaaaccagtcgtctgttttgatatctttaaattcattttgatttacaggtttgcattcatcgacaagcagacgtgaaataatttcagccgtttcggctcttgttaaatatctatcctgcggaagcgtattgtcagtgtcacctttaatgtatttgccggggttctcctttaatcttggtgtaatttcaagagtgtttgcatttgcataataagcaaatttaaactcggcgttatccgccgctttcttgctcaaaacagcaaagattcttttttgggctgtaagttcgtctatcagtccggcaaattgtttcaagtcttccacagttgttgaaatcatttcatcccggacttttttaatgtcgccgtttgttttgccggtcagcgccatggtcgctccatattcagaattattatagtattcatcatattcttttactataggaacgattatcgcgtcaagctctttttgcgtcatgtccagagattttagataatcgtccattccatcccatatctttattgccaaatcaatatccgtaagaccggctactgaacataccataccggagtcatcaaaggaaacgccggctccgtacgcaccgtatttaccgcgcattgttggcagaatgtattttgttgtgagaacttttgcgagaacgttcattttaccggtgtaaagatttttgctgaaataacctgcctgcataaaatgatttgagtcttcaatattagttatcgcggccgcggaatagcagccaaccggcagatttatatgagagttttcagcttgttttgaatttttaaaatattcacagacagcagtcttaaaatcatcgtatccgtttccgccgacatattcaactgttggagcggtgtttaatattatattttgtaccatgtctttaagccttgtcaatatttgcggagcattatgtaaatcggtacctttcaaaaagtgataatacgtcactgaaccttgaccgatactgccgcgggttgatgaatatagtcttttttctgcggattgtgaggagtgcattaactcgtatgaaagataaaaagggtcgcggtatccattttttaaaatctcatcgggagctgttttgagatactcttcaaaatcgttttgattccaaatagagtcgttatccaaaaattctatcactttttcaagcagctcagtaatttcattgtctggcgaagacatggaaattattagctgtgggtcaaatttattttcatcattataactttccatcgatagtatatcaaaatacacatttgaaatatttaacttttgagcttgccttgtcaaaagtgagtttagcagctggatgtaatttaaatctgaatcttgaatagggaataacagactggctgttgaggaatcagttgatagtttttcagtataataaaacggaatattttcaacgttttcatatttgggttcatagtattcaggagcatttttaacttcatcaagcgaaagagaagggatgccggcgataacctcaggcgagtcgggttcatccacccaattattgaagttttccgtatcattttttatattttctatctcctcagaacttagtgacagcgtatcgtcatattcgggcgatttgtttccatttccggatataactatcttgctgtacggattttgaatgaaatatttatctaaaattactctaaagaactcaggattctcttttaaatatttttctgtctctgatatgcctgtataatagaacgggtcatttttatatataattccgtcaaataatgtgaggtccggcgcataaatataggggtcttttcggtttgatatgtattcgccaactgcgctgttcagttcgctgcagtcaaatcccttttcagaaaattgttttaatattgcattataagtgttgattatattatctttttcgtttataggtatttcagtaaccagcagagctgaatttgatataccgccgctgttgccgccggtgacaaaagtcttattgtttacttcattcattttttgcagtatcaggttaaaaattatttctcttgcatatagttcctcattaccttcagacatcattgcgccggaagacataaatccaatatcaacggtttgggtatcggaggtgatattatattcgcttatctgattttcaggcagttgttttgtgtcattaaaggctatatcaggttttttatttgaaaatccatcaaaaaaactgtctaagagtttcagggtagattttatatcctgcttgccggaaatataagtcatactgtttgacggaatataatagttgtgataaacccgcattaagtcgtcataacttaaagtttttataccttcagccgtaccgccgctgttgaatgacgggggtgtgtttccataaatttcagtatataatttatcggataaaaagtttattgagttttcggcgctttctaagttctttattttaagctcattgtatacaaccccgttatattgtacttttccgtcaatatattcaagccttattccctgctgtttgaaaatgttttcatcttgcagcagcataggatgaaaaatcccattcatgtaaacatcaataagattataatattccgttttatttgcagtttttatcgaataataagtgcagtcgtcaacggtgaaagcgtttatcatttctgcgagagagttgctgtttagataattcattatattcttggtcggatatttttcactgccgcagagcaaactgtgttccaaaacatgatttgcacccttattatcaatcggcggcgtcttaaagccaatagaaaattccagtttttcggagtcgttttcaagaaacacgacttcggcgcctgtttctgtatgcttatagtaataggcttttccgtttaagtcggaaatatcttttgtgtccagcagttcaaatcctgtttcatcatctaatgcgtaggcaggatttaatcctataaatattgaaaaacatagcagtattataaaagtttttgtcagtttcatattattttcactcctgtgcgtctattatttcttttgccatatttatgagttcgtctttagtgagttcagaatcagcggcgcaaatgctgtagtttaagccattatattcaaatgataggatttgtacgtcagatatttttatttcggcgcttccatagctaaatatatatttgcctgatttttcatcctttttatcctgctcagttaatcgataatctccgggaaccaatttgtttgtatatgcaaaatattttatatcgcttcctttatatgtttctgctgtgttagaatggttactttgatttcccgaagttgatttgtctatatcaagagaaatcatgtcttcattacgtttgtaatggcaatttagtgatttatagctttcaaaaattcttccgtcttcgctgtaatcctcgttctcaacaatataaccgctgtcaaaggtatatccgttcgaaaagttatttagaatttttgaagagataccaatatcatcttgaagtgtttctgctgttggaacgctgttatatgacggtatatttgaagattgagcgcctcttgaggtgattaacacatttgccgcccataccgagagacttaaaatcataaccgccgccgctgcaacagcggctatttttgatatttttaaatgttttactaatttaacagaattttcagcctctgttatcaaatcatcatctattaatccaattgttttgtatagctcctttttattcataatctaattccctgcctttccaggtaaatttttaattcgtttctaagtctcattaagatagactttactttgctttctgagaatttgtaatctttcgctatttttgaaattgagtctgaataccaataccgctttacaaatataactcgtttggttaaactttttgttttaagaaaatgactgataaattctgcaacttcacgagcttcatatttttcctccggcgtttctccgcctgataatatattttcaagttcagataattcagtttcaaattcacggttgcgcattgccgctgaataatagtcatatttgttgagcgctatatttcttgttatacgcccaagaaaagcgggcaggcagcgtggtttttgaggcggaatctgattccacgccgcataatatgtatcgttttcgcactcctccgagtcggtgatattttttaaaatgttgtatgctatagaatttatcagcctcccatacttggatgatgtttcagggatggcggattcatccctattaaaatataaatctattatttttttgtcgtccatggcaagagctcctttttatttttctgcctcaaatatatagtaagaaaatgataatgcttggttgcaaaattttgtaaattaatttttttcagatttatttaaaatttatattttaagtgttagcatatgaatattgtattttattatcgcctaaaagtctatcaaaaaacaactcaattttaaattttattctccctggcactttttgtcacttaatatttattataatgactataggtcaataatttaaataaataattaaaatctgaaaggagaaaaacatgccgaatttaactacgcctatacctccaaagcttacaggagctgcaggagatgatattaaggcaataaaaaaatgggggacggcgcttattgatgagctaagctatattttcaataatttggacgccggaaacgtgtcggaagcggcaagcgtaaaagctgaaaatattgatacttcaaacgctaaaatacaaaatgctcagattggaaatctaactgctgataaactcaggacgggtcagctcaacactaatttagttacggttgagagcgacttcgggaatctcagtatgagcggaagttctataataataagcgataataaagaggagcgttttaaggttgagtatgacccggatacaggtctgtttagttttgtaattaataactcagaaggaaatccgactgtttatataaacagttttggcaacgcggtattcagcggacgtgttgacagctcagagattttctcttcaactatagtaggcactgacagtgtttcatatctgcaaaaggatggcggagtttttgcggagatggatacaaagggtataaaaatacttcaggataaaaaccaaaagcggctgcaaaaattgggtatgtctgttggcgatgacggaaccgcttacatagtcttaggttccggagacggttcgggggaggttactataaacggcgttaaatactcaaacggcagttttgttatacaaaaaaactcgacatattcatcctttgggacagtgggaggcagcacagttttatcttttatggatgacggcgatttatggattcgaggcgatagagtattgataaacggaagagacgtattgaaagagattgatgaaattaaaaaacaaatataaataaaaaggagtaaaatttatgaaaaatgataggtacagcggaaaaataaaatcagaattttttggaaaggttcaggagtattttaaaatttatagggacaataaacaagaactggatcacagaatcattgataacaacaggtggtataagagccgttataattccgaccctgatgcggtgataccggagccgacaacaccttacttattcaatgttattgcaaataaacatgccgacgccatggataactatcctgaaccaaatattttggaaagaagcgaagaggatactcaggttgctgaaaagctgacaaaaattcttcctatgcagctggatttgtgtgattttaaaagaacttacagcagggcttggtggtataagctaaaaaacggagcttcctgttatggcatattttataatcccgattccggcaaaaacggcgatattgatataaagcgcatagaccttttaaatatgttttgggagcccggaataatagatattcaagacagcaagtttgtatttctgacagctcttatagaccgtgaagagctgaaagttaaatatcctcacatggcggataggtttaccggcggaaactctatggacatacttacatatgacgatgtgttaggaggacccgaccaaaatattttaagggacaagtgtttggttgtagactgctattataagaagacggacggagaaaaacaaactgtggagttattaaaattttatgatggaaatattttggaagcatctgaggatataggggaagacggtatttatgaccatggcatgtatccttttgtgttcgacgttttgtatcccgacgaagatagtccggtagggtttggatttgttgatatagtgaagaaccctcagttatatattgataagctggacgggcttatcagccgaaatgctttgatatccggaaaaaccaggtttatggttaaagataacggagggttgaatgagtatgaattgtctgatttaagccgtgatattattcacgttgccggttcggtaagcgacgaaaatatcagggaactgcaggctaagcctatgcatagctttattattcagcaccgtcagaataaaatagaggagctgaaagaaattgccggaaacagagattttcagcagggagatacgcatggcggagttacggcatattccgcaatagtggcgcttcagcaggccggtgaaaaactcgccagagatatgctggtaacaggatatgacgcgtttagagatattatttatttttgtattgagctgatgagacagttttatgatgacccgcgttcttacagaataaaccgcagcaatggaaaaggcgagtatgtaacattttcaaaggatgatttggaaaatggttatcatagggctgagtttgatatatctgtgagcgctgaaaagaataacccttacagcagaatagcccaaaatcaaacattaacggagctttggcagatggggatatttgacccgaagcaggcggacgcgtcaatactaatgctggaagccatgcacttggatggaaaggaaaagataattgaaggacttaaaaatttaaaggctgagtatgaagaaaacataaatacggagcttgaagttaatggtgaaaaaataaaatcaccgcagcacaagccggctgcggtgggtgtaaaaactgcgaatatacaaaatgcaacacaagtttcgtaatcacattattactttcccgaatgtatagataggttcagaatcattgaaaaatatgggagtatatctgggattgattgaagttagacacggacggccgtttattttatcaagttttttacaatatgcgtcaccattgtatagaaatattcctatatctccaaatcctatgtgaggcatatatttgatataaactatttcaccgtcacaaatatccggttccatgctgtcgcctgaaatacgtattccggcgtctgcttcaggaggagcgggcaattccattacttccatatcatcatcggttatataattgcccagcccggccgctgccggctgcatgtatacaggtataggccgcattctgttatgaaatttaataactcgtttatccaaatatttgttgtattcataatttaaacaattaagtactgcttcaaaattttcagggtcacgagagatttcacgcagttttgtgatagctagattgagttcagtattgtatttaaatttgttgtattcagtatttgcgtcgcaaaaaaaactgtatacgtcatcaatgttatattcccggcaaagttcaagaaatgttttgacgtccggttcggaaataccattttcccaggcgctgaatctagcttgttttataccgaatttttcatagacctgtttttgggaaagtccggaattgtatcgtgcctgtttgagttttttactcaagtttttatttgccatataatcacctcctgtcataatatatcacattttgtagaattaatcaaggaataaaatcgaaaaatttgttattttatccttgacaaataaaaaatttgttatataatggttgtgataacaaaaaaaatgttgggatttggtgtttatggtaataatgtgtaagtaaaaaatgttagtcttatattttaaatcaggtatttataaacatttatataggataaaaaattatttttttaaaagtaatgtgaaaataaatcacaaaatttaataagaaaggaatatgaatatgacgcatcccgacataaagtatatagaacgttatggttataccagaggggagctggaacgcggcaggccggtcggtatatgcctgttttgcggcagtgaggtttttcagggcgatgaggggttcatcaagagctttgacggtttgttttgtaatattgaatgctgccataactactatgaaattgattcacaggagtaaatgtgaataaaagaaaggagaatatattatgaaattttcaaatgcagaccaagtcaaaaagtggctgagattgctgccggttgcgagaaaagaaatgaatgctaaaataagtttttataatcagctaataaatgattttacaagagttgaatatactgagaatgaaatagtgagaaatggattatcgaaaaatacatataaaggtgaaattaacaatgttcatttttaccgttctcagattgaggagtgcaagaaaaaatatgataaactgctgaaggattgggaaagactttcaaaattgttagacagcgaagagataacattaataactgaaaaatatttgaaaggcaacagttgggactctatggaattcgttatgttttacagccgccgccaatgtttcagaatacttgaaagagcggctgaaaagttaataggcgagacggttggagaataatatggcagagtttgttaatgagaatcataataataaaaacgaccaatccaaagaatatataaataaagatttaaataatggggaaattacaaatgttataaaacagagcgaggaagttaacagagcgatggaagctttaaataagatacaggaactgctctgctgcggagacaaaagaattgaattatctgcggctaaggagatattaggtcagcttggtatgcccggtgaacttgggggagaaaatgaaataacaaagcttgaagttgaaataaaggttatataggatggggtatacaatatggattcaaaattaaagcttgaaatcacaaagacgcagcttaaatttatagagtcaaaagctgatgaagtgctgttcggcggcgcggccggaggcggcaagtcatacggacaattagttgacgctttattatttgccttgaaatatcccagaagtatacagctggtattgagaagaacatttcctgaacttgagcattctttaataatgaattctcttttgatataccctaccagcgtggcttcttataaggtgagttccagaaagtggatatttaaaaacggctcggtcatcgaattcggattttgtcagtctgagacggatgtgctgagatatcagggagctgaatatgacatagttaggtttgacgagctcactcactttactgagaaccaatatacatatcttttatcgcgcgtcaggggaacaaacgggtatccaaaacagataaaatccagcacaaatcccggcggaatagggcataattgggtcaagcgaagatttattgacggatatgagccaggggttgagcataaaactgaatttgatactaaacgattgtttattccgtcttttgttcaggataataaatttttgatgaatttggataaagactatataaaaaggcttgaacagcttcctgaaaacgaacgccgggcgcttttattcggagaatgggatatattcgacggtcaggtgtttaccgaatggaaaaacgacataagaggctataaatcaagaaaattcagtcatgttataaaaccgtttgaaattccgaaagagtggagaaggtttagggcgtttgattttggttattccaagccttttgcggtatcatggtatgctgtggattatgacggcagagcatataattaccgtgagttatacggctgtgccggaaagcctgatgttggaataagatggacggcgcagaaaatagccgataagatacttgaacttgaagaagatgagacaaaagccggatgtaagataaccggaattgcggatccggcaatatggaacgctacaggaagcgcagaggggagtattgctgagatgatggaaaaacgcggagtatattttgaaaaagggaaaaatgacagactggcaggaaagatgcaggtgcattacaggctggcttttgacgctgaaggttttccaatgctttacttttttgaaggcaaatgttcaaacatgataagaaccttgccggaactgaagtatgacagtataaaccctgaggatgttgatacaaaacaggaggatcatttatatgacgcgcttaaatatttcctgatgtcaaaccctattactccaaacaattttgatacttctgataatattgaagagtattctcctatatggactgaaaaaaacagttcttttgaaagatttatagtataaaagggttgtaatattttaggaataatggtattataactttgatattaatttttgtttggaaattgtaaacatggaggattaaaaccgtatatgaagagtttgggaatagatttcggagatagcagaactggctttgcagtatctgatgaattggggttcggcgccggcactttggataattttaagtccggaagcatttataaagttgccgaatatgccgctaaactttcgaatgagttaggagtttccgaaattgtagttgggtttccaaagaacatgaacggtacggttggggaacgcggagaaaagactaaaatgtttgttgaaaaactggaagagttggtagatgtgcccgttattctttgggacgaaaggcttactaccgtttcagctcataatttaatgaacgttacaaacgtcagaggaaagaaacgaaaagagtctgtcgacagtatttccgccgcctttatattacaatcgtatctggacagcaaacgttgagaaaggagcagtaaaaatgtcagatgaaaataaagatgtaatgcaggaagaaaatcaaaatattttagaattagtagatgaggatggaaacacggtgccttttgagcatttggatactgtgcaaattgacggcgaggattatatagtgtgtattccatataatgaagaagaggaagaagttacagaaatcgtattgtttaagatagataaggctgccgagagtgaggattgtttgtctcaggttgtagatgaaaatttggcggagagaatttatcaggaatttaagaagcgtaatgcggaccaatttgattttgaaaattaaataatatataaaagcggcctttttataaagccgctttttgttattcaaataaattcgatatttacaatcctgttttgctcgtcccatgtaactgcagctccgcaagcctccgatacagctctgagcggtaacattgtatagtcgcttaacagcatagcaggtgcgtcaagttcaatttcccaaccgtttttagtcattttattatcattgatttttagagatatttcggtgccgtttttctttgcggttactgtctcatttgtctcgtcccaaattacttcgactcccaaagtttcaaatatagcgcgcattggaaccattgttctgtcgtgaataataaaagcaggctggtctgaaattagttcctcaccatttataaatacaggaacttcagggtaattgactgtttgatttgagtcttttgaattataagttattttgaaatcttttgagtcaagtttttggtttaaagaatatttttcaaccgttaatgtatgcgttccttcagataagtttgacgaatcaagagtaaactcataaggaggatacattgtttcatagagagaaacgccgtctattaggtatttgacgtttaaatacaacgctttgggttcataggcgtaggcggataatttaagactgtctttaacttctatgtcgtgcatttcgggatactcgacaggagaaaatcccggatatccctggatgtatggaggggttgaaaccgccgaattaactattgagtaaagttccggcgaatcactcatgtcatatctgtaaaaatccaaatccacgttatggttaaagcttacgtttattttaatctgcggaaacactctcggaatctcataataaaattttctgagctgctgtgctgcccagtcaacatattcaaaaccgtttatgtagtcttcacgtccgggcatttcgccgtaacctacaccgccttcagttataacaaccggcttttttatgttatatgtttccataaaatcagttattgctttagctcctattacagcattgctgtagtcgccggctacgaaagagacgctgtttgaccatgttgtctgtgctttgcttccctgaaagtatggcattacatataaactcataccaatccagtctgtatactcatcgccgggataaaaatctatcagtcttaaatcgaccgaaccaacattattcggcgcccaaacaaccgcaatattatcctttgtgtgggcatagtcggctacatatctgaaaagctttataaagctttcaggatgagtaaaattatcgtttatattaaactctttgccaaataccaaaaggctgtcattaccgtctgaggctatgttatcgacagtatttttaatgtagttttcatagtctgcaggttcaataacttcgtcttttaatgcacagttccaattataaagcctgaattttccgcttctttcggcatattcagatatttcagctctttcgcatacgtcatttgttaaagtcgaatcaaaccaaaaatattcagtgtctatagtgttaggaatcgaaggataagacacgtcgtggggtgtaccatggtacaccccactgccgggttcaaactttgctccgtaaaaacatctgttttcggtttttgcctcatagtatattctgaaatccggcgtctcgcagagcttacccattctgctgaccgtttcatccattatactctcgcattgcaccggtgtgcaaaaaggtataataaacagtaaaaacagtgatataccgagagagcgtctaagaaagtttaaagtttttttcatattatatatcctaataactaagtttatcttatgcagtctgtacattttggctgttatcgcgtataccgcggagatactcatagaagtttgtataagcggtatttatgtatggcgataggaagatgtagccaatacctaatgtgacagcggccaacaaaatccagccgataaagcttaggctaagtacaaataacttccacttataacctttcatcatttctttgctggctctcagtgcttcaagagcggtcatatcatcattgtccgcaagcagataaaaagcttgtgagtatctatatgacgctatgatgccggggattaccaaaagcaatgaccataggaatgtgaatatcccgattaagagcataagcaggaaagaacgcattattgtattaaatccataagaaaatcctgtaaatatgtagctgaactccgagttaccggttcttacaaggttcaggagatacttgctcataccgtacgtcatacatcctgatacaaacagaaggacaatagtgccgattaatgagtaggatgttacaaatataaacgttccggctgatacatttgagcccatactaatcaaattcgcagtcatttgcgcaggaaagtttactacaatgctgacagccataactaccagagttgcaacaaacaatgcaattatagccttgccccacttaccgcgaagctgatttaaagataaatttttaaaatctttgcatgtcataattcttactcctttttatattataatatatttttttattcattttttacaggattttacaaagaaattataccatgatacaggatatttatcaagttacttttttattacgcgcggcgtgtttttcaattcaataattgatataaattgtatctaatatttcttgttcagtgcgcagtcttttttgcttatctatgtatatttaaaattatcatgaatatgattaagagatataattcagacaagcgtggaggagaagaaatgattgagagaagctacaaggcaagaaaaattccggaaaaacatcagtaccgggctgttgttatcgacggacataaaattataaaaacagcagtttttttagcggctgtcggagttattgtcggcgttataataacatcgttttcatatactaaaacagctgttccgacagcgtctcatgttacggaatcgcaatctgcggaggtggctcaggaaaatgtaaagcaggacagcgaagaaaaatctgaagaaaggtctgataaaaaaataaatataaaggagtcatttgattcagttttaaaaactgcctgttcatacatattagggtttgacccatacaatattaacggggctttagctgcagaaattcatggagccgatatggttaacagttatgaaatggttcagaagtcttctgaatttgacgaaagcaatattgtcccgacagaggaacctcagccaacaccgggagcagaatcgtcggccgacggtgagaatcaggcggacataaaagcgataaatgcaggtcagaacgcaaacagcaattccaatgagattaaaatagggaaccaaacttcatacggcgtagatataaataaaatgctgagcgaaccgcttgatattgatatgagcgtcgacggtccgaaagttctgatagtacatacacatgcgacagaggcatatgctcctgaaggagctcaaaagtataaccgcgaggagagcgacaggagcatggagaatactgagaatgtcgtagcggtaggcaatgaggttactgaaatatttaacagccgcggcattgaaaccttgcatgatacagcgctgcatgattatccgtcatttaacggcgcttatgcggacgcactttcgtctattgagtggtatttgtctgagtatccaagcatacaggttgtttttgacctgcatagagattcaatagtttatgatgatgatacaaaggcaaaagtggttacaaaaataaatggtaaaaatgcggctcagctaatgtttgttgtaggcactaacgaaaaagggctgtatcatccggactggcgcgagaatttgaaatttgcactgaaactgcaggataaaatagaccagaaataccctaacttaatgaggcatgtaaacttaaggcaggaaaggtttaacggacacacaacccacggaagccttatcattgagatggggtcaagcggaaacagtttagaggaggctaagtacggtatgagctgtgccgctgaatgtatagctgacttcttaaatgaacttaaataataaatttaacataaatgtcacaaactttaacgtattagtatgcaaattttgatactaatactcttgaaaaagattcacctttcagatataatgtactttaaaagaatttggacgcggagtaaattatttcttaaatgtattatgccgaaaggatgaatttaatgagaaaactattggctgtgtgggcggcgaagcttgcgtcggtggcaggcaggattgttggcaaaaaatcatcgtcaacgccgggtgtgtgcgctcttaaaatttgccccaatttgataagtattttagccaagaatgtcacaaaaggcgtgattgttacatgcggcacgaatggtaagactactacaaataacttgctgaatactgctttgataaaaagcggatataaaacagtttgcaataacttaggcgctaatatggtcggaggtatagcgacaacctttgctcaagcgtgtaatatatttggtaattttaaagctgactatgcagtgcttgaggtggatgaagcttctgcaaggcgagtgtttaaacacatcaaacctgattatatgcttataacaaatcttttccgtgaccagcttgacaggtatggagaaattgatataacagttgatttgcttaatgaagctattgatatggcaggagatgttaagctgatattgaatggcgacgacccgctgaccgctcagtttggcgaaggcagagacgctcgttattttggtatctcggaacaggtgcttccacagaccgatgaaactaaggaggggcggttttgcgcaaaatgcggacaggaacaggagtataattattttcattacagccagctgggcgactactattgtcctcactgcggaaataagagacctgagattaattatccggcaaccaatgtggacttgtcgtcgtctatgaagttttctgtaggtaataatcaaatagatgtgaattaccgtggattttataatatatataatattttggcagtatactcagctcttgatgttatgggtgttaagaccgagaattttaacagtatacttagtgattataagcctcagataggacgtatggagctgatagaactgggcggaaagccttgtatattaaatttggccaaaaatccggccgggtttaaccaagctattcagaccgtgcttttggataagagaaaaaaggatgttatcgtggctataaacgaccttgcaaatgatggaagggatgtatcatggctttgggatgttgactttgataaattgggagaagctaatttatgcagtctaataactacgggaataaggctttacgacatttctctcaggtttaaatatgctgatataaaggttgatatgattacctctgatatgaaatcggcgcttaaaaaatgcgtggacaatcctgattcagaagtatgttatgttctcgtaaactatacagcgttatatcctacccaaaatacaatgttgggtcttaaaaaagaattgggcagcagcgagcttgttccggtcagtgcaggaggtagcagcaatgggaaataattatgagataaacatcgttcatttgtatcctgatctgcttaatctctacggggacagaggaaatatagcctgtatggaaaaaaggctgaagtggcgtggaattgacgctaaagttcatatgtgtacaaatcaggacagcagcattgatcttaaagcagctgatattatatttgtaggcggcggttcagaccgtgaacaggagatagtttgcagcttgcttctcgaaaaaaaggaagaattaaaagcgtatgcggaaaatggcggcgttttggtagctgtttgcggtggttatcagttattgggcaaatactataaaacggccaatactaaaatagaaggattggaaattttggatatatataccgacgcgggagataccaggctgattagtaatgtggttttagagtgcgaaaagtttgaccagcctatagtagggtttgaaaaccatgcaggaagaacatatattggtgaaaaccacactccgttggggaaggttaaattcggaaatggaaataccggagacagcggttatgagggcgtaatatataaaaatgttattgccacttatcttcacggacctttgcttcctaaaaatcctcagctatgcgattatattttagaatgtgcattaaagcgaaaatatgacgattttgatggacttaagcccctggatgacgaacttgaaaacaaggcgaataaatatatagccgataaatatgtgcgttgatactgtataaatttgtcttgataggcaaaaaatatttttaactaatggtaatagaaaattaatattcacttaacatttatttggaatatttttgataaaataacatggttaatatggagcagtgtataatgttggatattaatacccgggaaaagtgggtttgaatgcctgaggtccggcctattacatacagggggaaaacgaatggatttttttaaaaagttgttttccaaaaaaaacaatgacaaagataatatagaacaggatttcttaaatcacgcttataacagtcttggagaagagcatcttaatccggaaagaattttagatgaaaacagcgtaagttataagactgattctgaaaatgagattgccgaaggtgagcctgtcggcacttttggcgttcatgaaagcgagtatgaaaatgatcgcacagaaaacgatgaaaacaaatttttgaaagaagcttcagagcatgagaatatcggttttgaacaggataattttgaagacagcggatatatatatggcgaaggtaaaggtttagatttaaaaacggattatgaagatattgaagacagcggagaaaattcagattttgatgaatatataaacgaagatgaagatataagcgaaattgaagagtttgaccctgaatcggcatatgataacctaggcggcgataccggggaaatggatactgaagctatcagcgctgcggctgatatggcacagaatctatctgcagacgaattgtctgacaggagagcggaatacggacgagattttataccctctgataattatatttcagaggaagcacaggaagaaactttttctgtatctgacgaagccgggaataacggttcagatattaatagtttgtctgatacgagggaacttgaacaaacaattccaataagcagtgagatagataaagaagagatttactccgcatatgctccgaagaatatgcgtcctaaggtaacgcagacatcgtattttgatttggataatttggatgatgaaccggaagaaaatttgtctgataaaggttttagagctttctgcaagagacgtaaaaaatggcttataggcgccggtgtagctgcggctgtagttttagttattgtcggaacggttttcttcttctggaatcgtatggaccctcttatgggatatacacaaacgtatgtagctaagggcaacgtgattaaaactatggcagcaggaggaaatgttgagcctaacgccagatatgatataacttccttagtcagcggaactatcaccgagactcctcttaacgcaggggagcaggttcgtgccggtgaactggtttataaaatagatgatacaaacgcacagctggcagttcaaatggccgaaaatgatgttaagcgtgctaaggtggacgattcagattcaggttcgtcacagcagcttagaatttatgctaacgcgtcaggaactataagcgatttgaatatttcagccggaagcagtataacaggcggtaagattgcaactatcacgcaggcaaacggaacagaatttgccttgataccgaatgttacaggaacagttcagtcagtaaatgtcaggaacggttcaactgttgagtcgggtcaagtggttgcgactttaaaaagtgacggcagcggctcttcaaaagaggggcgtgagctggatatagcgtcttgcgaacttgctttagagcaggcaaacaaggaacttgaaaaatataaaatagctgctcctatcgacggcacaatactggttaagaatgcgaaaataggagacaacgtgaacgctaatcagactgataagccgttaatggtaattgctgatatgagtaaaatgaagtttaatattgaagttgatgaacttgaaatctggaatattgaacttggtcaaacagttgttataacagcgaatgctttgccgggtcagactttcagcggtgagattacgaatattgccggcgaaggtgagaaaaagggcgacggcgttaccacttatgcagttgaaattacaatttcagacccaggaaaaatcaaatccggtatgaacgttgacgccaaaataataattaattcagcaataaatgttttgtctgttcctgaacgcaccttatatgagtctgacggaacaaacgcattggttattacaaactctaacagtgctgaagaagacgctgtgatgaatccggcggaatatccgaatataaatgttcctgaaggatataagcttgttaaggttcagtatggcgtgagcgacggcactaatgttgagattatttccggtctgtctgttggagatacagtcctttacaaagcagaagacggtgaaaatgttaagcctgcggatagtgttaattcaggtaaagattccgggaataaagaagcagaaaattcatctaacaattcagaaaattcttcaaaaactgataaatcacaaagtggtgacgcagactcaattgatgaagagtttacaactgaaagcgataatggtgaaaatgtcaaatcaaccggaaaatcagcgacccaggaagatcttaccgatttagagtaaaagtttttaggggaaatgcgtaaatgagcaataatgagaaagaaaaattaaatgataaaaaaagcggaatatttaagagtgcgtttttaaacgcactctttgaaataaagctgaataaaatccaggcgcttatatcggcggcaggctttcttattgcggccgcttctatgatagctgttataatagcgacgcattctatgataatttccgaaggatataggactaatcctttaggagctaatactattactcttacagtaaatgaagaaaaatctaaagtaaaaatagacggcttaagaagctctattttggaatatgatgattttatagacgttgtgccaactgagacggtttctaatattgaaatgtttggtaacttgagtacaagttcatattataatgtgcttgcaacagactattcgttttttaatcattcggctttgactattgataaaggccgttttttctcgacagcagatgtaacggcaagaactcatgttgcagttatcggcagtgatattgctaaaagtttgtatggtgattccgaccctataggacaggacttaaaaataaataatcagatttttagcgttgtgggtatattcgacagcgaaagcaaatcgtcgctgaatgaaaccgtaattataccatacaaaagcgccaggcttattttaaattcaactgacgttggaacctatacttttgtgtgtaaggatgggtttgaatcagatagggcggttaatcaagcggaaagctatatgggtaaggttttctcggataattctaaatactcgataaaatcaaattataacagcggtatggttagcgtaattcggcttattgttcttatagtttttcttattatactaattataagctgcttcagtttggccatgtttgccgcttatccttcaagaaccataaaaactgatttagatcaaacaaacaaaaagaatggttcagcatatgtttttcttaaattagagtatatttgtcttttgatttctattgcaggaacattagttggtttggcggcaggaatcggagccggctgcctatattgtctcttaaccggtaatcctctgtattttaacggcggacttttatttatgactgtttttttgttcttgctctctttagtatttggtcttttgtcaggtttggttccggggatattagcgtccaaaaagtttaaacgcagtgaaataaaataatatttataatattactttaatataactattaatagttatattaaaatctgtttttacataattataagtaaattttataacactttattatcgtaaattaatttatcttagtaattaaatttaatttgttatattttgttggtattctatatttttagtaaattaatgagacaaattattgtgtaaatatatttgcttttttttgtaagctgtgttattatgttatttatataattggaataatctggaaacgaaggtgttgttaggtgatagaattatgactgacacagccagaaaactagaatacgataacatatcaggtcagcagaatgaagtgaaaaagaaacttaatattattaaaaaaattcccaaaattgagctagtgtggcgcgtagtatggtgcgttgtttttatggtcatatttagtttttttgcttttggcttaattcgattaatatttggggactcggcgcatggattagagtggattgttgcagttgagacagctgtgattgtattttccgtctgtctttttagctttgcaatacggatttttaaagaattaaaaaatgttgtcgatgaggatacggaaatcatgacaaatgttgtcgggggaactatggtaacatacttcgacgatagttttacaataataaatgctactcctgtcttttacagcatactgggttatgaaaaaaatgatataaaaagaaaatatcgatgtgaattttttcgtctgctggtgggagacgactctaggcgggagtttggaagacaaaagcgcatgcttcgcgaaacgggtttttcagaggctcagtataaaattctcagaggtgatggaagccgtatttgggtttccagcagaagtcatttaaagaaaaatgataagctggaaactgttgtatatactgttttattcgatataagccgtgaaaaaaatatgcaggagaaactgcagctggcagaggcaagaaacaaaatcgtattggagaatatcaacagcggtatttttgaatgggatatgataaaaaatacgtttgaggcttccgaccagttttcacgcagatttatggttgatgaaaattttaaaattgaaaaaactattttgaaaaagtttgtgcatcctgatgatatatccgtgctttatgataatttaaaacttctaagagagggaatagaagataaccttgaaatattgctgaaattaaaggattttcaggggatttacagtcataacaggttagttttaagttcggtgcgtgataataataatgtccctgtaaaagcggtaggaatagttattgatgtggaagaacagtttcagaaagaaatggagcttaaaaataaagcttccagagattcgctcacagggctttataacaaagggattactcagcagcttatagaaaacactatactagaccgcggaacacaaaatcatgctctgattttatttgatatcgatgattttaaatcagtaaacgatacgtttggtcatggtatcggagacgaagctatcagaatagttgctggtttgtttaaagacgttttttatgatgattgtattgtcggtaggataggcggagacgagttcatggtattttgcagaaatattgatgagcgcggcgtcaaggtggaacagcttcttaataaaatcatggagcgggatacatttgtaaagtccggcgataaattaagaaatttaactttaagtgttggtattgccctttatgtcagtgacgcgagaacttatactgaattatataaaaaagccgatattgcactctataaggcaaaacaaaatggtaagaacagatacatattctttaaagatatagatgaagattaataaaaatggggctgagagatgatgtgctcaccaaagtcagactaaaaatctaacgttgggagggcgcgtcaatactcagcccttttgtttttaaataaaaaagacaccgcaatcagcagtgtctaattttttacttttcaagaccataacgttttctgaacttatcaactctgccgcctgtatcaacaagcttttgctttcctgtgtagaaaggatgacaagcagaacaaatttctatacggatgtcctcttttgtggaaccggtttcaataacgttaccgcaagcacatttgatctgtgtttgcttgtaatcaggatgaattccttccttcatcgtgtttcacctctttcaatatataactcaattatttatccatttaattagcaacgtcgtctattatagcacaacggaaatcaaaatgcaacacttttttcaaaaaatgtaaatatattttttgttagtctccaagacacatatcaatagctcttgcagtttttatccagtaaccgctctcttctacagctttgttttttccgattacgttttcaagagagtcataaccaagcttagttccgtctaaaactaccatattgccgaatttgccttccatcaacagcttaaccgcgtatgaaccgtaacgggttgacaagattctgtcgttagatgtgggtgaacctccgcgctgagtatgtccaagaatagtagcgcggcactcgagaccggctaaatgttcaagctgcccggcgattacttctccaactccgccgagacgtattgggtcaggactgttatcaataactttggatataactacgtctcctccaataggcttagctccttctgcaacaacaacaatagcaaaattcttgcctctggctctgttttctttaatagcgtctgcaactttattaatgtcgtatggtatttccggtatcaaagccgcgtcagctcctccggctatagctgacgctatagcaataaacccggcatatctgcccattacttccacaacgatggttctgctgtgtgattcggcggttgttcttaatttatcaatagattcagttgcggttgcaacggcggtatcaaaaccaaaagtggtatctgtcgaagctaggtcgttgtctattgtttttggaacgcctataactttaactcctttgcgcgcaaaatcacggccggacgtaagagttccgtctccgccgataacaataagagcgtcaataccggctttctttaggttgttgactccaacatccgaaacatcgccgcgctgttcttgtccgtgttcgtcaatatatgaatagtcaaacagattatctttgtttgagctgtaaagcattgtgccgcctttagagataattcctgaaacatcatgaagagtaagaggaacaaactcgtcttcaccgagataaagcccgcggtaaccatgttttattccaacaacttcaagaccgtatttgaggatagccgtcttaacaactgctctgattacagcattaagcccaggacagtcgcctccgccggtcataacaccgattcttttgatttcgctcataattagccctcctgtatttatgtattaaggcaaaattccgtatagatattatttcctatcttatattctattatgtttaagtaaatatgtgcaaaaattaatttcagagttcttatgcttttaaaataaagccgaaaaaacactataattctgcctggtgctaaattgcaccacgtaatctattttaacttatataaaagcaaaaagcaaggagaaaaaccgagtggtgtctaattttgtatactgtaacaaaaacatatttaaactgcggtgactttttcataaaatcacatactgaaatatggaataaatttttattttaactgtttatttacattgtgtggcgtttttattactttttttggaaaataaataaaaaaactgtaaaaaagatttaatttaatgttgcgtattttgaaatgttgagttataatacaaagtgcgggaagagggacccgtgaacccgaatgtttcggtatttggggcttgttcgaaaaagaattattttatatataggaggattaattatggataaacaacaagttttaacaaaaatgacagatgctggtcttgtagcggttgttcgtgcatctaatgctgaagacgctataagaatcacagacgcatgcctggagggcggctgcccttcaatagaattaacatttactgttccgggtgccgctaaggttattgaggctcttgcttcaaaatacacaaacggcgagatgcttttgggcgcaggaaccgttttggattccgagacagcaagacaggctattctttcaggagctaatttcatagtaagccccggtttcaacaagggcgctgcagagttatgcggacgttatcagattccttacatgcctggatgtatgacaatcacagaaatcttgacggctatggaagctggatgtgatatttgtaaagtattccccggagacattgttggagctaactttattaaggatgttaagggtcctttgccgcacgctaaacttatgcctacaggcggagtggacgtatcaaacgttgataagtggataaaggccggcgcagttgcagttggagcaggttcatctcttacaaaaggagctaagacaggcgactatgctgatattactgctacagctaaagagtttatagcaaagattaaagaagcgcgcgctgcactttaagtttttgaagagataatttgaaaagataattagtacatatttgaaattaaattatacaaataaaggagaaaattataatggctaaagttgttacaatgggcgagattatgctcagattatctacacctggtaatgagaagtttattcaggctgatgagtttgacgtatgttatggaggcggcgaggcaaacgttgcagtttcacttgctaattacggacatgacgctgagtttgttacaaaggttcctgataacccaatcggagaatgtgcggttgctgcacttcgcaagatgaatgttaaaacagataacattgcaaaaggcggagagagactgggtatttatttcttagagtcaggcgcttctatgagagcgtcaaatgtagtatatgaccgtgctcattcttcaatttctacagctgaagctgctgattttgattttgacaagatttttgacgacgctgattggttccactttacaggaatcactcctgctgtttcagacgctgctgcagaattgactgaggaagctttgaaagctgcaaaggcaaagggcgttaaggtttctgttgacctgaacttccgtaaaaagctttggtcaagtgagaaggctcagaaagttatgtcaaacctcatgcagtatgttgatgtttgtatcggaaacgaagaagacgctgaaaaggttctcggatttaagccgggcgctactgacgttacatcaggagaccttgaacttgccggttatgaggacatatttaagcagatggttgagaagttcaactttgagtacgttatcagctcattgcgcgtaagtcattcagcatcagacaacggctggtcagcttgtatctattcaagagatacgaaagagttctatcattcaaaagagtacagagtacatcctattgttgaccgtgtgggcggcggagattcatttgccggcggtacaatctgcggatttgttgacggtaagaattttaaagacgcacttgaatttggtgttgctgcatcagcgcttaagcacacaattcccggagacttcaacttggtttcacgtgctgacgttgaaaatcttgttggcggcgacggaagcggccgtgttcagagataattaataattataaaaattgcctgcaccgtttggtgcaggcttttttgttaattaaatataaatggcaaatttgtattgcccaataaatataagactgttgaatttttggaattatattaacatactataggacagtcctcaatattattgattaattcagaagttatgctgtttattacatcgaaattcatagcgttaatatatattgattcaagttcatcgtgcagagtatgtatgttgcttaggaaacagcgtgcctggctgtttaatttatcatacctgttttggatggcggacagccttgccgagttttcttcatccgttccgggcttaactgcagtctgatacaggtcaactatttcgtcgcttgtgcgtgacgggaacagttcgtgcggtgaagtcgaatcaaagatacacacgtccaaatcacgtattattaccatatccaaactatcggggtcaaagctgcagtgatatacttctgttttatagccgttatttttggcaaggttagcaatttttttcattattgtggattttcctgttccgggacgtcctttaataaaataccgttttgagaggtcagaggtcaaattctcgatataatttactgacccgtttggggttaaggcgccgaagaaacggtctattattttgccgttgtcatttgatttttcgctgtcaactattttattgcataactcaattgcagcactgtctaaactgttataatctatattgtcaagatatattttctcccaatcgtcgtggactgttttggcttttgaaagatttgaatatattccattatataattttgaaatttgctgtttaatatccagtatttcggacttatgctgtttaagtttgtttctgtcccatgcttttccgagatttatgtattcttcaactgctcccggagctttgggttcaataacgtgaggtgaggttccgtcaaccacagctgttttccggttgttgataatgataccgtccagagaatttgaatcagaactgcaatatatatggtcgatattttctccctggcttagaaaatagtctccgatttttttcatcattgtggattttcctgttccgggccctccttttaaaatataaatgttttcaagtccgtcaaggttttgttcaaagaaacttacaaaacctactgatgagttagcgcatgtaaagtatttataaattcttttggtcatattatcactctccattattaatttactatattaacaactatacattatatgtcaagaataattgtttgatgttataaactaactatattctacaaaatttattaaaatgagatttatttaggtatttatttatgcaggattatcttttcaattaagacgtgcctgggctttcaatgatgtaaatattatataaaaaagtggttttgcaagcatcggagggcagatgaaatctgccgcgtaaggcgcgcagccacggctaagcttattagtaaaaaggataatgacaaacttttttaagtatgttcacactccgcgtgatatggcagctcacctaacgtggtgtgcaagcacacccttccgatgttcaccaagaaacgctattttttggaaaattgattctaaaaaatatttataaaaaagtggctttgcaagcatcggagggcagatgaaatctgccgcgtaaggcgcgcagtcacggaaaatttattagtaaaaaggattatgacaaacttttttaagtatgttcacgctccgcgtgatatggctgctcacctaacgaggcgtgttaaacacgccctcccgatgttcactaagaaacgctattttttggaaaattaattttaaaaaaataattataaaaaagcagttttacaagcatcggaggtgtaacatcacttttcttaaaagtggggtcacactttcagaggtttgctatatgtgattttaatatttatgttcagtttatttaaacctatcaaatttttattcactgcatagaagatatacatataaaaatttcatatataaaattaagtgctatttttaagatagcggattgttaatatatttgttataaagctaatgtatatttattgcaaaagtcaatggtttttcaccttcaagagtaaatttaaatttactcttgaaaaatatgtatgtttatattataattaaatagtataatgtgaaaatagcggatttgtgcaaaaccgttgaatttggtttttaacatttttgtttaatatgatagagagaggttgatttaggtgcaaaatcaggaaaaaacaatggaaaaaatagtagcgctctgtaaaggaagaggatttgtttatcccggttctgagatttatgggggattagccaattcctgggattatggtccgctcggagttgaatttaaaaacaacgttaagagagcgtggtggaaaaagtttattcaggagagcccttataatgttggacttgacgcggctatacttatgaacccgaaagtttgggtggcttcaggtcatgtgggcggattctctgaccctctcatggactgcaaggattgtaaggcaaggttcagagctgataaactgatagaggacgcaaccggagagatagccgacggttggtctgatgaaaagatgatagagtttataaatgaaaaaaatatcccttgtcccgagtgcggaaagcataattttactgatatcagaaagtttaatcttatgtttaaaactttccagggtgtaacagaggatagttccagtgaaatatatctaagaccggagacggctcagggtatttttgtgaactttaagagcgttcagagaacatcccgcaagaagctgccgtttggtataggacaaatcggcaaatcattcagaaacgagattacacccggaaattttattttcagaatcagagaatttgaacagatggaattagaatttttctgtaaaccgggcaccgatttggaatggtttaaatattggaaagactactgtgaaaacttccttttatcattagggattaaaaaggaaaatatgcgtttaagagaccatgaccccgaggagctgtcacattattcaaacgcgactactgatatagaatatcttttcccgtttggttggggagagctttggggaatcgctgacagaaccgattttgacctaaagcagcacagcgagttcagcggtgagaaaatggagtatactgaccctgaaagcggcgagaagtatatcccttactgtattgaaccgtctcttggagcggatagagtagctttggcgtttttagttgacgcttatgacgaagaggttgtcgatcctgaaaagaatgacacgagagttgttatgcacttccacccggcgctcgcgccgataaaggcagcagtgcttccgctttcgaaaaagctttccgaggaagctgtaaaagtctatgagaagctggcgtctgagtttatgtgcgaatatgatgaatcaggctcaataggaaagagataccgccgtcaggatgaaatcggcacgcctttctgtataacctatgacttcgattcaagagatgatgacagtgtgacggttcgccatcgtgattcaatggaacaggaaagagttaaaatagaagatttgacggattatatcagagagagaattgcattttaataaatcatagattgggtgcttataaatgctttttaaaaaaagtttgcaggatgagcttttaaggtttataaaaaaagacagggttcgggcgcatatgccgggtcataacggcggagcagggttgagctccggctttaagcgcaatgcgtttaaacttgatgttacggagtttgatgaaacggataatctgcaaaatccaaacggtataattttaaaaagcgaggagcgtgctgccaaagcttttggagccaaaaaaagtttctttttggtaaacggttcaacagtgggaattgaagccgctatattgacagcggtaagaaacggggacaagctgatagtggacagaacttgtcacaaggcggttatttcaggaatgatacttgccggtgcagaacctatttttattgaacccgagtatattgaaaggtttggaatatatggagctatgtctccaatcacggttatggacgcgctcagaaataatcccgacgctgtaggcgtagttttgacatctccgaattattacggcatttgttctgatattaaacgtttggcaaaaaacatacattcctcaggcaaatttttgattgttgacgaagctcatggcgcacattttgcttttagtgacgagctgccaaaaccggctcttgaatcgggagctgatttggttattcacagcgcccacaagactttgccggcgcttggacagaccgcgctccttcatgtgggaaacacggagttagtagatgttttaaggctgagaagaaatatcaatttgctgcaaacttcaagcccgtcgtatattttgcttgccagtattgatgaagctgtttcaaaaatgtcaaatgaatatggaaagcagctgaatcgggtaatagagacagtaacagcaataaaatctaaaattggagttttggataaggtttcgtgcatgacgagaggtaacttagataatgattatgatataactaagctggcagttgacttttcaaaactgggaataaccggatacggcgctgctgaactgctgaaaaaggattatggaatctatcctgaaatggccgatgagagaaatgttcttttatatataacggcgagcacaacgaaaaaggatttggagcttattgacagggcaataaccgatatatctaagtctgagtataggcctcaggtgattaaaaaaccgaggcctatgccgcatacgagatttgaaatgcctatgaaagaagcttttttctcggacagcgttatgatttcggccgaatcggctattggaaagatttgtgcagaaattgttaattcctgtcctccatgctgccccatagttttgccgggtcaaataattgacaacagcgttgtggaatatctcaaggaatatacggatattgaaaaaatagccgttgtgtcaaacagtataaactccaaaacaggtcaaattgaggaggaaggttaatttcgtgagccattttagcggaatatacggacatgaaagtgtaaaaaagcttctggaaacggctgttaagacaggacgaataagtcacgcatatattttttgcggccctttaggggtcggcagatataccactgcaagggcgtttgctgcagatgcggttaagactgacctgaaacagcatcctgatattataacggttacaaacagtctttatggagttgagagtaaatccgattctatattagtggatactgtgagcgaaatgaggaaagatatatttataaagccatacagtgctgagcgtaagatttatatagttccaaaagcggacactatgaacgcagcgtcccaaaataagcttttgaaagtgtttgaggaaccgcccggatattgcactataattatgatagcggaaaatttaaataaatttttgccgactattttatcaagggcgtcggttgtaaaattttcagcattgccaaacaagactgtatctgactttttgattgacaaatataaactttctgatgaagaagcggccgcaaaagctgttatgagcaatggcagtataggaagggcggctgagttgattgacagccctcgtccggcaatgcttagaaaagagacgatagatggctttatgggacttttgggcagtgagaacagaaatatttataatttcgcaaaatttttaaagtctgaaaaagatgatttaagttttatattttcagttttaaagagcttttttgaagattttgttcatttaaagtttgggcttgcggatgaaatggtaaatgttgataaaaccgcggagatgcgtaaactggctaatgttgctaccaaacgtgccgcggtacagtttttggatataaccttaaaatacgaaagaattgctgcggctaatacaaatcttaggatttcaatgttttgtttagcctgtgaatattgggaggaaatacatggcagagattataggagtacgatttaacagtgcaggaaaggcgtattattttgacccggacgggcaaaacctttctatgggcacaatggtagtcgtagagacctctcatggtgtagagatgggaaaggtttctatcccaaaccgtgaggttagtgaaaaagatttaaaagcgcctctaaaaaaaataataagagttgcgaccgatgatgatataaagcagctgaatgaaaatcaagttaaagaaaaagaagcgtttaaaacggcgagtgaacttattattaagcataaactagagatgaagcttatagatgtcgaatatacgtttgacagaagcaaaattctgttttactttaccgctgacggaagagttgactttagagaccttgttaagtcattggcgagtgtgttcagaacaaggatagaactgcgccaaatcggagttcgtgatgaggcgagacagctcggaagcattggaatatgcggcagatttttgtgctgcagtacttttcttgacgactttcgtccggtttcaataaagatggctaaagaacaagggctatcgcttaatcctacaaagatttcaggagtgtgcggcagacttatgtgctgcctgcagtatgaagaggcggcttatgatgacgcgctgaaaactatgcctgaaagaggggcaactgttgaaactttggacggtaccggaaccgtggtggacacagcaacgcttaagcagcagataagagtaaagttagacggaaccgaaggtcataaaaccgaggtatacaatgttggagaattcaatattgtaggacatgagccttctgtgtcactggacgaattgaagtctaaaaaagagcaggaagttttagaaaaagctcaaagactgcttgaggacagcgagagaataaactcaatttttgcaaatgaagatactgagtttgagaaggaaacagagcgtgagaacaaagaaaatcagaacaaaaacaaaaataacagaagaagacggcgccctgcaggaaagaaaccggcacccaaaaactcaggaaactcagattctaaaaaaccggcagttaaaaattcaggaaacacagaatctaagaatccctctttgaaaaattcggagtctgataataaagagggaaacaacaaaaggcggtatcgccgtcccagcccaaaaaagacaggcaacggcggttataataaccaataagtttggagaaaaatatgcgaagattttttactgaacctgataatattgatttagacaacggcactttgactattattgatgacgcggcgcacatttccaaagtcttgagaatggaatgcggagataaaattatagtttttgacggtacaggatatgaatatgaagctatgcttataaaaatagaaaaagagaagagcatagccaatattttgggaaggagcctgtcagaactggaacccgaaataaaagttactctgtttcaagggattccaaaatcggataagctggagataatagttcaaaaagctgtggagcttggtgttcatgatatcgttcctgttaaaacgtcgaggtctgttgcaaagattgctgatgataaaaagggcaggcagaagatagagcgtctcaataaaatatccaaagaagcggctaagcagtgcggaagagggcttgtaccaaaagtttcaatgcctgttgtcttcagtgctatggctgatattttgaaaaattatgacctttcaataatgttttatgaggagctgggtcatgatggaaagaaaaatttaaaagaaattttaagggcaaatcctgaggcggaatctattgcagtattgattggacctgagggtggattttctccgtcagaggctgagactattcaaaacatgaataaaaataccttctgcgcaggactaggaaaaaggatactcaggacagagaccgcaggaagcaccgctctttctgtgattatgtatgaaaaagatgaaatatgagatataatgctgaaaatattcttcagcaaaatgaaggagagaagaaaatggcggcaatgacaaaaaaggaaaaaatggcggcaaaaagcaagaagattcgcgacaaggagcagagaagagaaaagcttacaaactggtatatgataaatctgagctttggtattttggctattatagcggttcttattctaagacagctctatttgatgccttcaatgctatcatatatgcagattgtgacgtgggtaatgaccggtgtgtttgcggctgcggcaatagttgtcttagccctgggactgaccgggaagataaagaataagcaaagggctgtgaattatagtattttcttgggcgtttgcgctttgggttcgctttggctggcactgtataataaaatcagagtagcggctgaaaatgttctgcatttcattactaataatacgaatttaaacatcaactcacattggaatattaatttgttgattataggtattgttgtttaccttatagctgcttttgtttattatgttataaagctgtatagaacaaaatagaagttatacatatataaaaataaccgggaaacagcggaaattattccgctatactccggttatttttatatagtatcgatttattataaactattttttcagcagtgaagccgcccagtccttgtcttctttggttacacggtaagaatctctcagttttctgactgtcatttttaagacagcgtctcccaatgaaaagttgtttgtcagataatcctttgtcaagtccctttgcttggcaaaagcggttgcgataagccacgcctgcgccatttgaacataatattcgtcacttttcacgctgttggcttcgtttagagcgtattcggtgttttctttatcgcagagataataatcaagcaaaattataagcccgactctttgttcccaggggttttcgctctttaaaaatctatatatttcaattttgtattcttcaatatatttttttatttctttaaacgaacttacgggacaatcacagcatgcccagttgtttactttagaggcgtaggttctgattctttgacagagttccccgaacggaagtttggcgtatccgattaccattccgtatatagaaatttcttcatgagataaggatttattatcaagaatgtccacataatccaaaaaagcgcgaaaagacccttttgcaatcaatttggcagtatcgcgcattttgggaacccttactccgtaaatttgactttcgtatgatataggtgttattttgctgttaaattctttatatttgtcgtcagcaagactttttaggtattcaatataggcttggtagctgttatcattccatattgtttgtgtaaaatccatattattccgccttttaatatatttaatcctcaaaatcaccggttaggacgttaataatccgacagtgccctgaatctaaagcataattggtagtgtaagccgttccgctggacatagagagaatatacacaataaccgccgaactgttgtctaccataaatctgttacgcttgtgcatacattcgggcgtatagctttccgatacatatatgacttcatcggcgcttccgagaagctttgtatattgatttttttgtatcttgttccatttgcaagcctggtctttgcacggaagagcaagtataagcctgatatttgaatatttagagcgaagtttaataacactttccgccgccagcgtatcaaagccaagagcgcctcctgagatataatttgttattcccttattatagagcgtttcaagtattttatccaaattagcaagaatgttgtcatagtcctgagacttaacaatcctgtgtccgctgaagcagcaagtatttttttgatttatattattttccgctgtaaatttcaaatttcatcaccttttatagtatatcattgattaagtgttaacacaagtctttactttttgctttttttgatttataatatttcgctagaggctggtgaattatgagaattttaaaacaaattggatttatatttggtatttgtttggtgggtcagataatagcggagctaataccggtgccgtttcccggaagcgtaatgagtatggtgctgttatttatattgtttatgcttaactgggcaaatcctgaaaagctgaaaaatgttaatgattttttgctggaaaatatgtcgttttttttcgttccgtcagcggttagcataataacaaaatatgatttaataaaaaacagtattgttcagattttgattatctgtgttgtttcgtttgtggtgacatttgctgtaacggcttatacagtcacttttgttatgaaaatacaagagcgtttcagaagaaaaagaattggttcgggagatgaatgctgatgcaggacataattaataacataacatccagcgccctgttcggggttacactgagtatatttgcatatgttttcggggtaatggctaataaaaaacttaagacgcctatagccaatcctgttcttattgctgatataattattgtaactattttattggcgcttaatattccatacgaaaattatgctgtcggcggaagttttatagagctgtttctggctccagtaacagcggctttggcggttaagatacacgctcagattaaagagctgaaagcgaattggctgccgctgattatcggaacggctgtcgggtcgctggcttctatattatgtgttctgtttatgtgccgtttatttgggtttagtgatacgctgacagtatctttatttccaaaatcagttacaacagctatagcgataccgattagtgaaagtcacggcggcgtttcagcgataacggttatctcgctgatgtttaccggtatgctcggtgccatgttttcaccagttttgataaaattattccgtataaaaaatccggtcgcagcaggcaccgctataggaacatcgtcacatgcactcggcacaacaaaggccttagaactgggagatgtagagggggcaatgagcggtattgccataggaatggcaggtttaataactactgtctattctatttttatgctgtaagggtttaaaaataaaagtaaatataaataacgattcatataattatacaggttaaaaattattttatagggtggagaagatgaaaacaaatagagtttattcaaataagtattgggaagtaaaaccttttccggagagtgtggaggagggaagaacctggcgtgaaggaatggtaggaggcaacggagaaaatggttttataaccagcggcgcgccttattcggatacgattatttatcagaatattaatttcataatgcctagtgatgaaccgagatatacgccggaggagcttttaagcgaacttgaggaggcaaggcaggctgtaataaattttgatgatacgtgggacgtgcatggaaggaagagaacatgtttttattgttttcatccgggtcatttactgagaatgaatatgaatgaccggaactgtgaaagttatgtgcgctggactgattatgaaacgggcgaagtgtgcgttagttttgaggatgaggacggaatatgggaaagaagaacgtttacctcgcatactgacaatgtaactattacagaaataaaaaaatcatctaaagattcaaaaatagatatggttataagtattgatgatgtctcatcgatgaaaaagttcgggcttcgtgatgaaaattttatgcagtataagaagcttgttgatgaagacggctcatatatagcccaagccgctcattatccgtcatacgaaggttccgagctgaaaaacggcggttatgccggggtcacctatgttttgaatattggtggaactaaagaaaagatactgcttgaaaacacagatgaaaaacaaaatgttggagaggaacaaaatccggctgtaaaaatctgcggtgctgaggctgtttatttgataaccaaaaccggcaggacttttgatatgggagaatttcaagagtttaagaatagtaaaagttataaacttgttgattctttgcttaatgattgtattgctgccgctgaaaactatggaggcagtaagttcagctatgatgacgctttgaaaaagagtgccgagatacaaaaggagatgtttggggcagtatatttttcgttggggaacgatgagaatatttcaaatgaagacttgattgaaagacagaaaagcagtgaagttctcagcagttcttttgtagaaaaggcatataaccatggaagatatgcaatgacctgctgcgccggaaaaactatgagtcgtttgtgcggtatgtggagcggcgaatggaacacaaaatggcgcgggatatatacaatggacgccaatgttaacattcagtccagcggtatgaatacaggaaatttaaaagaattcggaataggatatgttaattttgttctgaggcaaatcgaggactggaaagataacgcgaaaaaatcttacggtatggaagacgctattcaggttcctgtaaactgtgacggcgacagggcaatgatggtggaatacgacagcaactacccgtttcagtattggaacgcaggagcgtcttggatgatacagcctatctttgagatgtatcagtgctttggaaatattactgtaaatactgattttggagataaagaattgctcggcgatatattattgcctttgcttagaatgcagaccaacttttggaaacagttgtgcactcccgagtattttactgatacggatggcaatgcgtgttatttaaaaggtaaaaaaagcttaaatgacggtgaaaaatatctgataataccatcgtattctccggaaaatcatcctaaaggatatgaatctactataaccgccaatgctgcaatggatatttctgctgcacgcgacggtctcagaatgaatattgaggttgaaagaatattaaaatttgaaggatatgaggacagaatatcagaaattcagaattttgaaaagctattgcctgattataaattcgacgatagcggagcgctttgtgagtggtcaatgaaaggttatgaggaaaataatgttcataggcacataagccatctttactgtgcttggccggcatatgaaactcagcacagcaaagtgctcacagacgcatgtaatcaggccatagagaacagaaacactgaaaataaaggccatgacgacacggcttcacatggatgggtacataaggctttagtggcggcaagactgaaaaatccgaaatctgtgtatgaaaccctatatatattattaaacagtgaaatttattacacttcactgatgactgaccataatactgacagacgtgcagatacttattgtacagataccgggtttggtattgttggtattattaacgaggctttgctctattcaaatacaggagaaatagaacttttgcctgcgctgcctgtgcagtggaaatgcggagaaataagaggtcttatggcaagaaccgaagcggaagtctccattaaatggtttaatggaaaagcggaagctaaaatcaagtcttttaagcctcagacaataacagtatcatgcggagagagtaaaaaaacagttgattttaaagcgggagaagagaaagaattggagtttattctttaatgctattctgttataacagtcttatttcagttagtgcaatacaaataatttgagtcttaaaatgtttttatgataaaataaaaatctaagcctttccgatataattgggcgggcttagatttaatttttgttctttaagttatagctttgtttataattttataaattatagtttgtttatatatatttgtgcagggttttaaacatatcatccacattgataggtttggatatatgggcgttcatacctgaagaaagagccttggttatatcactttcaaagctatgggcggttatagctattattggtatggttacggcgtcaggtttttctgagttccgtatttgtgccgtcgcttcatatccgtcaagatttggcatctgcacgtccattagtatcaaatcaaaataattatcagccgaattattatactttttaacagcgtctaaaccgtcaaccgcaagttcaacgtttgcattttgtgattttaaaagctcggaaataatttcgcggttgagagcattatcctcagttactaagatgttttttccggctatacttttttctgaattttcagagtgatcgtttttacttaatttggtttgattatttttatatttaaatggaagctcaaccgtcacggatgttcctgaaccagatttgcttttaatatttatgcttccttttaaaagcgtaaccaaattttttacaattgacattccaagaccggtgcctccgtactcgcgggaaattctttcatcctgctgctcaaacggtgtaaaaatcctgtctttaaattcgtcagtcatacctattccgttatcggttattataaatgatatgtataaaatattatccacttcagagcggcgcaggatatcaaactctatttttccgtttttgccggtaaatttgactgcgtttgataatatattcagcattatttgtttgaaacggagagaatctccaatcagggcaagacctgaaaggcgtttatcaaaagatatttttaagtcaatattcttttcttctgtctgagcgttaattgcggcaagaagttcgtctacagcgtctttcaaaacaaatttttctgttttcgtctgcaattttccgctgtcgattttcgaaagatcaagtatatcgtttataagagaaagcagatgcttggaagcatactctgttttttggagataattgtttagttttactttatcatcgatattttgcttagacagattagtgaatccgattattgcattgagaggagttcttatctcatgtgaaatatttcttaaaaatttatctctagtttttgcagaattttcagctactatcagcgcgtcacgcaagccgttttcgtattctatttgtcgtttttttgtttcgtcgatatttcggtttgcaataagaatacatttgcagcctgattttgctttattatcatcgtgaatactttccacaaaatacatataccaagagtatttgccgtcctgtttgcaggtgcgcgcttcaaaactaaaactttcgccgcaaaatagttttgacatatttacatcagaaaagtattccaaaaaattttttctatcgtttggatgtatattgtttagacatatatactctatatatttttttaaaccaaattcaaaattgcatgaattagagacgccgtttctgttgatgacttccacgtttgacgaggtgttattataagtaacccgccacacttggtcatacatgctcatcaatactttgccgagtataacatcgtttgcagttcttttagctttaattttattctttactattataaaaaagcatataaaaaatataatgagaaacagaataattatgctaagcagcagcgtcatcatatcgggataactatggaacaatgttttcaggttgtaactgtcatcataaatattgttgtttttgactataatgttgtcgatttgaccgttggttattgaaagcagcgatttatcaattattctcagcagtgttgggtctgccgtatcggatacgcctatagatatatcttgtatagagcccgtaaggtcgttgcttactaaatcggaatatttaaattttgataaaagataattcgcagtgatactgttcgcgtaagtacaattgacgttgccgttttcgactgcgtcaaaacattcttcaatcgtgtcgtattctattattgcagaggtcgattcatatttctctcgaataaacttatttatgtaaaatccttttggaagcgctatggtgttcttatttgattcttcaatttttttgatttgtattatgttagagtttagataaggatttgataatgatacattgtgttcggacgcccagttatagtcatatgtgattcctgaaattatatccgcttctccttcatttatcattcggcatgcttcctcatatgatggagcgtcaattattgtaaatttcagaccggaatattttgatataagctgtaaaacatcggctgatattcctgaatattttttgttgtttgtatcataatattctattggcgcccaatacgggtcgtaaactactttgaactcaggcgagctgtttataaaatcaatctcctgctgtgtgaaattcggctggaatatttgaccgttattgaaatattttttatgcatctgatagctgaaggcaggtgaaatatttttcatttcaaacaatatattatccagtttattaagatatggactgcctttggttaaggcaaaatatacaggcatttcgggaaaccgggttataactttaagattttttttgctgccggatccaatagtataaataaggtctatttgatttgaaaataatgcgttctgcatttcaaattgggtcttaaagtatataggctgataggtatacccatacttatttatataatcatcaagctgatagttatgacggctgccttccagtatacctattttcaggtcagctgtttcacctaaattgtcaaagttcatatcttctcttgctgagggggcatagagttcatatgcggctgttgacatctcgtatttagaaaaatcatatttataggcgtcttccctatttttgcttataccgcagacaatatctacttgtccattttccagcatatttaaacaatcggcaaaaggggcttttatatattcgaaatcccatccggcatactggccaacctttgagagataatcataaacatatccggaaggatcaccactgtcattaagttcctgataaaaatctatttgatagaaaccaactttgagcgtttgtttttgatgtgaattttcatcactgaaaacagttaaatttataagacaaagagtaaataaaagaaagattgaaacgaaacgtttcattatccaagccccccaggaaaatcaaaaatcaataatagatattatttgatatataaatattatatcacgatatatagatttttgcaataacgtatggaagaaaatggaaatttttattttgtttacggcaataaactacatacacagccagtttagtattaaaacgctcgcaccaactactgccattgatgacgccagccataataaactttgaaccagcactttgtttttaaccttaggtttggtttgtctttttgaagacgaatagacatcaggatacagaaagctgtttattattctctgagcttctgttactatatcggtctcgcggttctttgaaaagtatttctgtacttcggatgtgttttgagaaacattgtctcttagaataaaaattgcctgttcaattttatccgacttgatatcattgattattacaacttggcgtttgttttttaacatcataagtatcaccactcaataaaattttttatatggagattattgccggaaatattaaatatatacatgaatatatttaaatgtaatttgttttgggagaaatttattatgacaaaaaaagtaatttgtatattattagtatatatatttatatttatggtttttccgtgcctaacaagtgacttcaatgaagtatatgtcaatgaaactaaaactgaaggcggcagagctgcggaagctgccgctgtgtatcttgacgtgccgcgcagtgttttggattgttcggcatttactcaaaaagcatattcagatataggtttgtcaataccgagagttacatatgagcaagcggagtgcggcgttaaaatatatgattatgaaaaactggagccgggagacataatttgtatgggcaaaggggcggagcctgataatattacccatgtcggaatttattgcggaaatgatataatgcttcattcttcgtcaagccggggaaaaataattgaagtcagtctatcagaatggatagaaaacggcggatatggcactccgtttcagtatgccgtaagagtttcccggtaattttggtgtgcgaaaatttaaagcccgataagattttattgattgagtctctttaagtattagttagattgattataagcgtatctgttttgctgtaattttttgcctctgagttattatcaaaaaagttttattattacataaattgttttgataagacataataaaaatttgtgaatcgacacttaatataaaattgtaaactaattatttttttattaccgagattgttggtatttttaaatatttatctataatattttatagatatttttaattatataaagtttagaattaactaggataataattgatttaaaaaattttaaggaacaaatttatttttaatgcggaaacaaaacactgaaatattggtttgtaataacttattattgcgattagaagtaaaatctgtagaaaaatttattaaaataagctatgataactaaatgattaaatagctgaggcaggaggatatggttatgaaaattaatagggcgctaaaaagtttcacagcaatggctttatctgctatattggcgtttggggcggcaggaacagcggcggcgtcaacgaatacggataacgcgtcggctgctgaattttctgatactgagcctgaccgtgcaattgcttttcccggcgcggacggagcgggtaagtttgcaaccggagggcgcggcggagagatatatcatgttacaaatttgaatgacagcgggacaggctcgctgcgtgacgcggtttcaaaaggaagacggatagtggtttttgatgtgggcggaacaataaatttgaagtcagatttaagtataagcggaaatataagcgttatgggacagacggctccgggaggagccggagtgactgtgcgcaacggaaagcttgctatggcaggtgataatattattgtcaggtatatgacgtcaagacccggtgaaaaaggaagcggtgagtatgacgcctggggcggatcaaaggggtcaaattcaattattgaccattgttcaataggttgggcaaatgatgagcagtttggactttattcaagcagaaatatgacaatgcagtatagcataataggtcctgcaaattgtctttccacacactctaaaggctctcatggattcggtcctatgtttggtgccgccagtaatacttggcatcacaatttgatttgtcataatatgtccagaaatttcaggggtaaggttgaaagagaacagcctaatgactatgtgaacaatgtggtgtatggctggggcggacaaacagcatacggcacttttggacatttaaactatgtgaacaattattttaaaaagagtatttcttcgagaaacggtgataattttggttctctcgacagtggttccaactatgaaactacaaagttttttatggaaggaaataagatgacggacaggaagggcaacgcggccaatcctatgagcaccaataactggaacggcggccttagtttaaaccgcagtcttaattattacgagtctcattatcgtgcgtcagagcattttcctattatatcaaatggtattgatgtatctgctgcaaaaaatcccgaatcagcagacgccgcttttaataatgttgtcagctatgcaggggcggctgtaaatttagattcaaggaataaaattgacgctgaggtattaaatgacgcttacaccggctcaggttctctgtcaggcggacttgagaactcaaaagtgacagcggatgttagaagcaaatacagtattaagtatgtaaattatgacgaatattacccaaaatcagttctcaaaaaggaaattatagacagtgacaatgacggtatgcctgatgactgggagattgccagaggtctgaatccaaatgacagcagtgatgcaaatggttattatattggcggagcctatactaatattgaacattactgcaatgatttgactgtagattcattccccgagggggtagttactttatcaccgacgctggacgagcttggagctgattattctaaagcaaaagaggacttaaattctcttaagctttctaaaactaaaatttcgtcggctgatgaaattagtttgccggtctcgggttctaagtttggctcaaaaataagctggagttcttcatcggattctttgaaaatagagaataatgctgttactcaggtgattcagccaaccggcgtgagtaatgaaaatgcatacattgccgcggatatagcgaatggtgattgtgtgcttaaaaagtatttcactgttacgatactttcttcaactatgaattggttcgcgtcgagttccgataacggcaaatcggcgggcacggttctggctgatggactgagcaatgtaagtggtattatcacgggagaactcggagcctcggtctccattgacggcgtatcaagaacgacatatataacgtcggatgcaaacggcggttacagcgatggcaaaggcagcggaacatgtcttaaatatacggctcctaatgatggaacgctatatggatatgcggcggaattggcggacacaaagacgctttatattgtacctgaaggagttgaaaattataaaactgactatgttggtatgaaggcaggcaacggaggaaccgttacggtttcagctaaggtaaaagccgggaatacatattatatcttcactgcgggaacaaaaggaaagcttttaggaatgaagtttgccaaaaaaacagagagttcttctgagatatatgaatcaaattatgaaaagtgggacttcgatgagctttcagcaggaacttcatatgctaaaaatgataccatcacaaacaagaatggaaagagtataagccttgatataactgacgcggcggattctattactattgcaaaccgcagcggaagcagtaactatctaaagatcgcggataacagtaaaagcaggttgaagtggtcgtataaaccggattcgccgttaagcggaaataaagtcgtatttgaatttgagtttaataaaagcgatattgaaaaggacacaacgttcctaagagtatatgatgaaattaatgcgaatgcaaataatacttattcaaacggaagtgttatatttgatttaaagaccagcagcaacaagggagagtccagttcaacaagcagcgagcttgttcttaccgattatttttctatgggaacaagcagcacagacgatagtcctaagggagtagattttggtttttcaaatttcacctatcaaaaagataaatggtatggtattagacttgaatatatgaaaaatgctgacggtaaaaacgaggttgcactttatactaaaaacgacggagcttcaaagtatacttaccgtgactccgttatattgggctcaggggttcagagaccgaatgcagatatagacaatttgactctgacgcctaccaaaatggaattaatgactccgggaagcggaactgttacaataggtatagataatatatcgattggaactgaaacacttgctgaagaaccaaaaacagatacctatgttttccgccaaaacggcgttgaagcaaccggctatgacgacagcgaactgacgtgcagtataaacggaatgcctgaaaatgctgaatatactgcggcggcagctgagtatgacggcaatggtatgttgataggtatgacaagaagcgaatgtgtgggagacggcgagataagtataatgccttcagaagcttcacaggaaattaaaatatttgtttggagcgatatggcaagtatggaaccactaatcgaatgtgggaatataaaaagaaaataaaatatttgttatgaatgtgttaatcttataataaattatatatttaatcaaaactactgttcgttgcgtagaaaaagagactgggttttgaacctgcctcaaaatctttagattttttgtctaacttttgggggtcggttcatttgccggtctctttttctgtaattaattattagaaatatggtatttataattacaacttacagcaatgctaaagtgaagtataagttttttagcttaaaagtttgttaattataatgttatgtaattaatcctatgtgtatattaatttatgtatataacaaatatttaacgtataaagtatgaacggttggcggatatatttgaaaagggattaaaatatttgtgtatgattcagtaatatagatgtgaaacaagttagggaaaacttaatattttagaacagagattaaataacacatattaaagcgttaaaatgtataagttatttattaattagaattgaaaacggccgtctagatttgaactgacctcacaatcattagattttgtctaacttttgggggtcacatcaattgacggccgttttcagtttttgcagttaattgtgtttaaagcagtatctgtgttttatagagaaaataattttataatatagttattgttccagcaatattacgtcattttgaggacttaataaatcatcccaaaggtatactttgatattatatttttctgaaaatgcaatctctatattctgagactgagaatcagatgaatatggaatttctataactttaatatcctttaaaatcgtgtttgtctcatcgtatactgcaacagcaaataatgcgtttttatttttagtattaacaatttcagcagttacttttccgttttcaagctttggatattctttgtaatatattccgggaatattcggcgttgcggtcggcgggtttgcactcggtgttgcagacggttctgtggtaggcgaagcagttggcggtgctgttggttcagcggtcggcgcaggcgtgctggtaggttcgccgattttgctgaattgagcgcttataactacatttttggccggcatagtaaaagtatagttgttttcgtcagttttttctactacacttccgctgtctacattgacggaattaacaaagtatccgtcttcgggggatgcgattatttttacggtttcaccttctttggctgttggaactttgtctgaaaaagtaacactctttaatcctattttcgatccattagcccaagcataatatcttgaatccgcttcaacaggtataacatacgtgttgagttcggctgatgacggcacatatgatttaataaaatagctttcggttgcatcatcataaaggttaaatggtttgccgggatttagaaataattcaagagtcaagtatcccggtctgtttggaataaagctaaagacgtttccggtaggttcatataagctgagtggaaataggacattggggttattaagtccttttaggacttttgttctgcttccgtttacatcaacataattccattgcacagcgtcccagaatgtaaaagttccgtcgctgctgtcttttccatttatattcagaactgcctttccgttgccgaatatattggttacaccttcaacggcgtctgccggaatattgtcgtcggcaagccaggttattttattgccgccgcttccgataccgctttccgtctcaatttgtatggttccgttttgaatattttcatcaatggcaatttcgtattttgggattgggggttctgttggttcaggggtagcggttggctgcggcgttggcgttgcattttcatctgtcagtttaagattgctgaattttgcttccgccatatactctttcctaggtgtgccctgtattgagtcgaccgccagtcctacgtacagagtttctgctaatcctgatattgttatagtttgaggctgtctcggattatctctccagttagtgccgctgtctgaaactgacagagtaataacgtcgccttttctttgcattctgaggtatttaggaacgcggtattcagatttgctggtgtcatatgagtcgctgttggatatttcttttccgctgctgtttctaaaccatgaaacttttgctgaggagccctgtgaggtcctatatatagcctttacattttcaccgtatttaagccagccgtcagaaagcatagccattctcgaattgccgttaaggttttccctaagcatgattccgcagagctcgccgttttcaaatttcggaacctgttcggttttgacagaaatatcaaaatcgcccttgatttcctgatacataaaatcgcaggtatccgaaccttttccggctccgattgctccgcttcccattatggtatatactccgttgtccaggctggatccgccttttccgttaaaggctgtagtgccgatttgagcatgactgaaactgcccggatcagaacatgattttgcatacacaatagatgtggggctttgagttgattcgcctttgttgttataagctcttgaagaaatataatgagtgcccggagttaatgttatatctgtgttaacagcagaatcgtttactgtttttaccagtttagaaccgtcatatatttctattttggttatatatgtgtcatctgatgaaggtgacgcttcagcacagtaattcaggtcgaagtctacagtcagaacctcccagtttccgttgtttatctgtttcccgtctatagtatccgaaatagactgtatcgccggattggtaacaactatagaagggtttgtgggtgctgactgttttaaagtccagtcgtttacataggcttctatccaagtatatccggcatattgaccgctttttactatctctgtttcagaagctgtgcccattccgttttcggatttccaatcgtcagggatggagaacacgcgttttgttgcaggcatttcaactaaacccgcaacttcattcgcattgtttattattctgccggtttggtttttaacgtcagctattattctcgcgtctatgctgtccctcttaggaagggttgcgcctgcgtctgataataccgtgttataagcttcttcggcgctttgggtttcggaaagttcatactctcccatatctattggggcggaaagcttgtttgcggccgacgagttgtttacgccgttccagttatttgccgtaacattggcatccccatacatatagtttccgtcaaaataaaaattggatttagagacatcaggataagcgtttgatatatcaaatattctgctttttatttttgacgcggtacccgggccgaatttataataattgtttatccaattcacgtttgaaggagtttgagtaacgttattgtatgaatacggttcggcgccgtatgcggagtttgtttgaccccaattatatattacgttattgcgaacatctgtgttttgcagctcacggtcaagacgcgggcttcggctgtcatgatgagcaagcaggttatgatgccatgttgagtttgttcctccgaaaatagctccgtatccgtgcgcgcctttaaagtggtttgacattcttaggctttctgtagccaggcagttttgtactgtcatatttgaactcggagtaccgctttcggttgagcctgcgtacagcgtcaaaagttcgtcaacgccccagcttgtactgcagtggtccaggataatgtttttgttccagcgtccgccgattccgtcaggttcaccgccgtttatatcggttggtctgactctcaaatatctcataataatattcctgacgccgtttgctatagaaatatcaccgccgagaagagttattccatctccgggggcggtctgaccgagtatggttaaattactgttttttattgtaaaagttccgtttaagcgaatggttccgccaacatcaaaaacaatgattctgccaggtcttgaaaccgcgtcagcgaatgaaccggcgccctttgtgttaaggtttgtgacatggtatactgtaggcgacgaagcgccgcgtgctccaagtgtatatttaccgccgccttcagctcccggaaatgccggaatattgtctgccccaaagaccgtatgaacgggcagtgctaaagtgagcagcgcaagcagaaccgcaaatgcggaacaaaatttttttagacagtttttttctccccttaaaatcataagtttaccccctaatttgtctgttaacttcattaagtaaaaaacaaattaattataacatatttattataaaaaaggtaatgaaaacttagctctaataacaggaattttgcctttgaatgtgaaaaaaattaacatttttagaaaaatccaatatttatccatatggagttgtaacagttcatgaagacatagaattcttgagacggttaaattataattaaagtaatatgctgatattggtttcagttttatactatctccatttgctgttacatagatagattattagtctaaatttcagtattttaatgttattcttgacgttaactttttctgctttttgttatactgtgtcttgaagcggtacttaatatataaatttaaatatctatttaattaatttgtatctgcaatttgataaatttattttcatattctttaatataattttattctcaaggcataaaaaaacatatttttgagaatttattttattcttcccggggaagacagttttttataagtctgtttttacttgaattgtgcaaaagattgacagttgattttatatttagcattctgccgggacctgttgttattaaaaatacatggcaaaacttaatttaaacttgtatatttgattatgactatataaaagattgacatacataagactaaattataaaatatattgtaagttcttatttatgattatatattagtataaacaagtgttttatttataagacgaacaaattatataagataaacaaattagataggatgaaaaacttatgaataatgaaattaaaatacgtgcggcaaaagcggaggacgctaaagcgcttctaaatatatatgagccttatgttaggaacacagctgtaacatttgaatatgaagtgccttctttacaaacttttgctgaaaggatttgtaatgtgctggacaagtatccatatctcctggctgaaaaaaacggcgaggttttgggttacgcttatgcggattcctttcacgagcgggcggcttataaatgggcggcggaaacttctgtatacataaagatgaataagaggaggtcggggattgggaagattctatataatgagctggaaaacattttgaaaacgcagggaattttgaatcttaatgcctgtattgcctgtctaagtaaaaaagatgagcatatatccgacgatagtttggtttttcataaaaagtgcggttataagtatgttgggaagtttcataaatgcggatataaatttaacaagtggtatgatatggtatggatggaaaaacacataggctctcatacaagtaatcaaccggagataaaaaaattcagtgagataaaaattgatataggctgatataaaacgcggcgctgaaaactgcgctttttaatctataaaattaataattccgcaagatataattttatgttttttattttaaaaatatttataaatcagtattgacattgaaaaaattgtatggtaaaatatatgtctgtatatagtgaggaagtttgcttattttgaggttataactgagactgagaaagagttgttgtgtgttagaatcaacgttttttcgagggatttcgcagtcttggattattagattttactatgatttttaagccccggttgttaagcgatttttttattgtattcggatgcccgaaatatatattttgtggttttataaaattttatacgagaggtgatcggttttatggtacatcctgtgaaactaggcgaaaacacacgtatgagttacggtaaaatcaatgaggttttggaaatgccgaacttgattgagatacaaaccaattcatacaaatggtttttgagtgaaggactgaaggaggtctttcatgacgtttctcccataacggattataccggaaatcttattttggagtttattgactatagattagagtcaaagccgaaatatgatattgaggaatgtaaagaaagagatgcaacatacgcagcacctctcagggtaaaagttcgtctgataaacaaagagtcgggcgaggttaaagaacaggagatatttatgggcgattttccgcttatgactccgtcgggtacgtttattataaacggagctgagcgtgttatcgtgtctcagcttgttcgtgcgcccagcgtatattatgctcaggattatgataagctgggcaaaaagctgtttacgtctcaggttataccaaaccgcggcgcgtggcttgagtatgagactgacagcaatgatatttattatgtaagaatcgacagaaccagaaaaattcctgtgaccgtgttaatacgtgctttgggatttggtactgacgctgaaattatagatttgttcggtgaggatgaacgccttatcgcaacaatggagaaagatacaaccaagacccacgaagagggtctgcttgaagtgtacagaagactgcgtccgggcgagccgcctactgttgacagtgctcagtctttgatttccagcaccttctttgatccgaaaagatacgatatggctaaagtcggcagatataagtacaacaaaaagctgatgttaagcgatagggttacgggtcatgtatcggctgagaatattatcagccctgttaccggtgaaattctgtgtgaggccggtcagacaattacaaaagaaattgctcacagtcttgaggtaaatgctgttaacgaggtcgttttagactgtgacggcaaacagacgaaggttatttcaaacaatatggttgatatgcctgagtatattttgaataaaataggcgaagagctcagctatagtccgcgcgagtgcggaattaccgagcgtgtcagacgcagcgtgcttgatgaaattttagaccagttcggagatccgaattctgacgagtttaaaacagctgttgaggacagacgcgacgatcttcagcctaagcatgtgcttattgatgatattatagcgtctatgtcatatatcggcaatcttgcaaacggagtaggcgaagttgacgatatcgaccatttgggcaacagaagaataagaagcgttggagaactgcttcaaaaccagtttagaataggtctttcaagaatggaacgtgtggttcgtgaaagaatgaccacatctgaccttgattctattactccgcagtctttgattaatataagaccggtaacttccgcaataaaagagttctttggttcttctcagctttcacagtttatggatcagattaaccctctcggcgagctgactcataaaagaagactgtcagcgctgggacccggcggtctgtcaagagaacgtgccggatacgaagtgcgtgacgttcaccattctcattacggccgtatgtgtcctattgagacccctgaaggtcctaatatcggacttatcaactcgctaagcggatttgccagagttaacgagtatggttttatcgaaactccatacagaagagttgaccatgagaaaatgattgtcactgatgaagtgacttatatgacagccgattatgaagaaggtttttatgttgctcaggcaaacgagcctttgaatgatgacggttcatttgtgaacaagaagattgtcactagatataaagatgaatttatagaagttccgcctgaaagggtggactatatggacgtatctccgagacaggttacatctatagctacagccatgattccgttccttgagaacgacgacgctaaccgtgccctgatgggttcaaacatgcagcgtcaggcggttccgcttttggttcctgagtctcctatcattggtacgggtatggaatataaagccgctaaggattcaggcgtttgtgttcttgccaaaagagacggaacagtttcccgtgtatctgccacaagaatagaagttaagacagacgacggcgatacggacacatataagcttataaaatttaagcgttccaaccagggaatgtgtataaaccaaaaacctatagttgaaaagggtcaaaaggtaaaggaaggtcagataatagctgacggtccgtctactagaaacggcgagataggtcttggaagaaatattcgaatggcgtttatgacatgggaaggttacaattacgaggacgctattctaatcagcgaggaactagttaaagaagacgtattcacttctattcatattgaggaatatgaggtagacgccagagatacaaaattaggacctgaagagataacaagagatataccgaatattggcgaggaagcgcttaaagaccttgacgagagaggtataatacgcgtcggagccgaggtagagagcggagatattttggttggaaaggttactcctaagggagaaaccgaactcactgccgaagagagacttctgcgtgctattttcggagaaaaagcccgtgaggtaagagatacttcattgagagtgccccacggagaatatggaattatagttgatgtaaaagtgtttacaagagctaacggcgatgaattgccgccgggagttaatcaggtagtccgctgctatatagcacagaagagaaagatttctgtcggtgataaaatggcaggacgtcatggtaataagggtgttgtatcacgtattctgccggttgaagatatgccgttccttcctgacggaacaccgcttcagatagttctgaaccctctaggcgtaccttcgcgtatgaacattggacaggttcttgaggttcatttgggttatgccgctaaggctctgggctggaaggttgccaccccggtatttgacggtgcaacagaggaagatataatggaagccttaaaagaggccggatacaacgaagacggaaagagcgtcctctatgacggaagaacaggagaaccgtttgataacagggtaacggtaggttacatgcacatgctgaaactcgcccatcttgttgatgataaaatccatgcccgttcaaccggaccttactcgcttgtcactcagcagccgctgggaggtaaagcgcagttcggcggacagcgtttcggagaaatggaagtttgggctcttgaagcttacggcgcggcttatacgcttcaggagatactgacggttaagtcggatgatgttgtcggacgtgttaagacttacgaagcaatagttaagggtgaaaatgttcctgagccgggagttcctgagtcgtttaaggtattaataaaagaattgcagagcttggctcttgatattaaagtccttgacggagacggaaatgaggttatacttcgtgaaactctcgatgatgacgaggttgaggaattgcctgttaacattgccggatttgaggacgatgaactcgttcaggctaaggcggctgaaccggaagatgaacttttggcagaagaagaggctgatgaagaagagaccgaaagcgatataattgacgaggtaactcagattttggcggctcctttgattcaggaaggcgacgctgacgtttcagcttttgaggacgacgaggatgttaagtcatttgaagaattgagagatgcagaagattttgatgatgaagacgacgataattactaattaagaacagtcagcataaactgttcagccgttatcggtttatgtttttcaattgatattgtttgcttaactcacggcagacaaagggttatacagtgagtagaaaggcatggtcgtttatgggagaatatcaaaattttgaagcaatcaaaatcggacttgcttcacctgaaaaaatcagggaatggtccagaggtgaagtaaagaagccggaaactataaactacagaacactgaaacctgaaaaagacggtttgttctgtgaaagaatattcggaccgcagaaggactgggagtgtcactgcggtaagtacaagagagttcgttataagggcgttgtttgtgaccgatgcggagttgaggttacaagaagcaaggtaaggcgtgagcgtatgggacatattgagctggctgtcccggtttcacatatttggtattttaaaggaataccgtcccgtatgggattaatgcttgatatttctccgcgcgcgcttgagaaagtgctgtattttgccgcttatatagttattgacccgggcaataccggacttatgaaaaatcaaatactgactgagaaggaatatacagaaaaccgtgagaaatacggcgatatgttccgtgccggaatgggagctgaatcaatacttgaaatgctccgtgaaattgatcttgaggaactatatcaggaactcaagaatgatttggaaggcgcaaaaggtcagaaaaaaatcagaactgtaagacgtcttgaggtcgttgaagctttcagacagtcaggaaataagcctgagtggatgattttatcggttattcctgttataccgcccgaaatcagaccaatggttcagctggacggcggaagatttgcaaccagtgacttgaatgacctttaccgacgcgttataaacagaaataacagactgaaacgtctgcttgatttgggcgctcctgatattattgtcagaaacgagaagagaatgcttcaggaggcggttgacgcattaattgataacggaagacgcggcagacctgttaccggacccggaaacagaccgctcaagtctttgtcagatatgcttaaaggtaagcagggacgtttccgtcagaaccttttgggaaaacgtgttgactattcaggccgttcagttatcgttgtaggaccggagctaaagatttatcagtgcggacttcctaaaaagatggctttggaattgtttaagccatttgttatgaagaagctggtagaagacggacttgctcataatataaaatctgcaaagagaatggtagagcgcgtccgtgaagaagtttgggatgtgcttgaggatgtaatcgcagaccatccggttcttctgaaccgtgcgccaacgcttcataggctgggtattgaagcctttgagcctgttttggttgaaggtaaggctctgaagcttcaccctcttgtttgtactgcgtttaacgctgactttgacggtgaccaaatggctgttcaccttccgctttcagcagaagctcaggctgaggcaagatacttgatgctgtcagcgaacaacctgataaagcctcaggatggtaagccggttacggttccgactcaggatatggttttgggttcgtattaccttactcttaaagatgatactgagctgggttctccgagagaagaggacggtcatactgtatatagggtatacagttctcctacggaggcaaagctggcttatataaataaaacagtaggtctgcacgctcctataaaggtacgcgttacaaaagagatagacggcaagacggagagcgctataatagacgctactgtcggaagattgatattcaatgaaaaaatccctcaggatttgggattcgtagacagaaccgaccctgataagagatttaatctcgaaatcggagatgaagttctcaaaaaacctgacgctaaaaatatcatcggcgacaacgttgaacccggtgttgataaaaagctgttaggtaagattattaacgccagcataaaggtgcatggcataactgaaacagctactttgcttgacgatgttaaagcaatgggatataagtattctacgattggcgctataactgtaggcgtttcggatatggaaattcctaaagaaaagaaacagtatctgctcgaagcggaagaggaaatcgataaggttgttaagaactttaggcgcggacttcttaccgatgacgagagatatcagaaggtaatcaatatttggaactctacatcagataaggttacaaaggcgcttatggataaccttaaacagcttaatccgatttatatgatggctaattcaggagcccgcggaagcgttaatcagattcgtcagcttgcggctatgcgtggtcttatggctgatacgtcgggaagaacaatagagattcctatcagagctaatttccgtgagggacttacagtgcttgaatactttatctctactcacggagcgagaaaaggtttgacagatacagcgctcagaacagccgattcaggttatctgaccagacgtttggttgacgtgtctcaggatgttattgttcgtgagcatgactgcggtacggatgacggaattattgtttcagatataatggacggtaatgaagttatagagccaatggcagacagacttgagggaagaactataatcggcgacctcgtttctcctgaaacgggcgaacttattgctgctgacggcgatatgataactcatgataaggcggctgaaatagttaagtcaggaataaaagaagttaagatacgttctgtggttaaatgccgcagtaaggttggtatttgttctaagtgttacggtatgaaccttgctactgcgaagccggttgatataggcgaagcagttggtataattgccgcccagtctatcggtgagccgggtacgcagctgacaatgagaacgttccacgccggcggtgttgctcagggcgatgatattacacagggtcttccgcgtgtcgaggagctttttgaggctagaaagcctaagggtgtcgctatcgttacagagggagcaggaactgttcatcttagcgaagctaaacaaaagcgtgagattattgtgactaatcaggagacaggtgaagcctttacgtatctgataccgttcggttccagaataaaggttcgcgaaggtcaggaagtcgaggccggcgatccaatcacagaaggttcgcttaacccgcatgacattatggctataaaaggcgagaccgctgtacagaattactttatacaagaggttcagcgtgtttatcgtctgcagggtgttgatatcaacgataagcatatcgaagttatcgttcgtcagatgatgcataaggttaagattgaaaatcccggagacaccggattgcttacaggttcgttaatcaatatatacgaccttgagaaaattaatgataaggttattgctgaaggaaaagaaccggcagagtattcagttcagttaatgggtattacaaaagccgctcttgctacagaatcattcttatcggcagcttccttccaggaaactaccagagttcttacagacgcggctattaaaggaaagacagatccgcttgtgggacttaaggaaaatgttattatcggtaagcttgttcctgccggaaccggaatgcctatatataataatattgatgtttatgcaagctatggcgcggttgcttctgacaataattcattgttggatttggacgctgaagactaatattagtttgatataaaaataagcatatgctcagcatatgcttattttttataatattgaaatgtgataaaaatattttgcggagtatattgcgcatattatattgaattctgtaataaagttttggctatataatcgtaatggatactataaaaattttattgattttctaattagttaattcacttatattgatagttgattactaagctatttatattttttaattataaaattatatttaacttataagaaattttaataaatatatttaatgagtattaaaaaatataatttaattatatagatataaaaaattataaatttctaattaatatattatttttattgaaggtaattatttaagctattttaatgttttaattataaaattatatttaaccataagatactatgataaatgtatttatgagttttgaaaattataatttaattattaggctataataattttatttgaagcttgttcaaatcattacttcaaattattattgtaatattggaattacaaatttatgttttatcaaactatgattcattctgataatccgttttcgaaaacatcgctttcattgctattattcggattattatcagaggattctgtagtttttgctgcttcatcattatctgtataatctgtcacttctactcttgataaattagacgcttcgttattggaatttgcttgatttgattcagaatcttctgataatttaatctcttgatttgagagaggttcttcttcagttggggttgtttttgatgcactatcaacgctgtcaaccgtttttgtcaattcttctttttcaataccgctttcacttctgacagaataagacatgctgtcgtcctcccatacagcggattgatatatatcatcattagattttaaaactacgtttttttctcctacttcaacctgttcttctttatcataaatattataatctccctcgcttccggcttttcccggtcctgttctatatgtcatacagtcatttttactattatattttatttgtactacgctgccgaatattaaagaaaagtcgtatggacggtagccgtcgggtatatatttcggtacagaaaaatcaaaagcagcaatttttctcagttcatcaatactgtttgcagactgcataggacttccgcttgaaacctctcctgagctgctgttatctatttgattatcatcagtattgtcgttttggactggcggtataatatttgaattgttttcatcttccggatttataggagtgttgtcaaattgattttgtccgtttatataactagagttgttttcagtataacgtggattatcagaaaaatcttttggttttacagcgctggcgtgccaggatttaatgcctgaattattggggctgttagaaatttcattattgtattcctgctcactatttatttggttagaatcaccggagttttcttcccttgaattgttgtatggaataatactatgattaacagtcggcggttctgtgtactgtgaagaataatcaaacgccgtgttttgaatattgggatttgatttaaaaactattatagatgtaaccgttaaaaccaaacatgcggcaatcccggccgcgcggcgtatatagtatattttgggggtgtatttcttttgattttttgcctgtaagattattttgttttttagttcgtcggacataactattttgtccattgcgtcattatattttttactcaaaatcatacatctcctttagtattggtttcagcttttctctggctctgtgtaaaagagaacggaccgtcgattctttttgtcctgttatctcggctatttgtgttgtcttatatccctcataatagaaaagatgtataacggtactgtatttagcgggcaggcttataacagatttgtatactaaattctctgaactgtattcatcataatatgggtgctcctgaacttcatctatagagcagatgtttctgcgccaaaatagttttaatttattcttgcagatgttggacgtcactctcattatccaaagtttttcatgtttttcattttcaaatttcccgttatattcgaataattttataaatacatcctgagaaacatcttcggcgtcctgcttgcttttcatatatgaaaacgcaagtctgtaaactgtatcgccatacttgttaacgagattttcaatattacaatctaacgcgtgcaagcaaacgcccccctttcaataaaatgataacacagtgaaagccgcataactgcggcttttatagttatgataacatatttatataatactttcaatcattgatttaagctcatcaaaagttataccgttatccgcatatattgaaaaactgaactcaccgttgttccattttgcattgtgcactttttgaccgtttccgctgtaagatatttcatatccgtttatttctgcagtttttgtaaattcatatgtattatagtcgccggatatatcttccaggcttttggcggttctgtaactgagttcgctttcgccgtttacgtatgtcaaatcaagtgcggtatttgaaatggttgttattttagataactcatagcctgccggcagcgctgttggaatggaagcgtcaattcccagactggcttttgcttcgtctacagtgttatattctataataggatttggaatctgaaccaatgaattatcttctttatctgaattgtcatttctagttatagtgatagtattattatcaatatttacacttatatcatcaagcagttcaaatagctttagtggtacgtaagttgtatcattcaataattcgggagctgccccaagcgatgatggagccgacatacctatagctgtggaactagcggtgtaataactgtcaagcccaatatagacagttgtatttttttcaccgttatctaaaaatacagcgttttcttcctcaatccattcaattttaaatccaagcttttctccgattaaacgaacgggcaccattagctgaccattattttcatagatatttgcggggatttgttcgttgtttattaaaacgtttgcggggcaggcttgtgttgaaaccagcagcggtactccgctgtcaatagggtcagcgtctgccaatacggctgttgtcaatgacaaagataatgctcctgcaagtactgcagctgtgatttttttgttcttcattttaaaaaacctccaaatttattattttataacttcatatagaatacaactcggaatgtaaaaatgttgcattttttataaaaatttttattttaatatttaacgacgataattgctgaaatgtttatatttttatccagtattgttataattataattcagttttaagacgcctcttttattattaaagtaaatagagaaagtaaaaatatccacttatttaatagatttttttaaagaaaaattattatatattttgtttctaaatcagagaacggctgaagctgccaattaacggactgtacaaagacaaacggctgattacatttcaatatatcaaacgtagatttataaaaggtataaaattggatgtgtaaatgtaaataaaattatatgatattttttatatcaagtcaaaataaaatttttatagtaaaacaattttaactttaatacagtttgagactatatttattataacatgatattgatataacataaaaatttatttatataaatatataaaatcgtaaaatgttttaattcggcagttataaggaaagtttaagacaggattatatttacgcatgtattaaggcttattacatttctgtttagttcaatgtgaaagccgggaagtctattcagtccatatcagtttattagtgataatatgcgcttttgtctttggtatttagtctttttaggcgacagattattttttctgtatagtaattctatctgtccgttcgtttatgtcagcataaataaagccttttacgcagttctaggtatcttaaaatgtgcaatcgacacagcgtttgactgtaactcagaatttcttttaatctattttgagaattatttctctctgaacattccataaataataccagacggacaatctgttaacaccgcggtttgaaaaagcgtttgcaaaccaattgcaatgagaagtatacgcccattttccagctgtataatttttattaaaatcgcttttttaaaaattttttaacctgttcttagttataaccagaatttcaagttttttagctgtatgttttactattatttcgccgactcatcaaaattggcggcggttattctattttaatgttattaaaccggatttctgtgatatgtctgccgctgttttcaatattctcaggtattgaggtgtgacgtttatcaaatcgtataagtctgcgcgcaaaaacatattgacaaatttcaatatgatgtatataatataaatgaatatagaaagaaggaggctcggatcatgacagaagatgaaaaaaacgcaaggatattcaaagctttttgcgactcaaatagattgaaaattttaggcttgctgcaaagcggagaaaagtgtgcgtgcaaattattggaagaacttaatatcgggcagccaactttatcacatcacatgaaagttctatgcgacgcagaaatagttgcagggcgcaaggaaggaaaatggacgtattattcctttaatccggaaggcgttaatcatgcaaaagaattgcttaatcaaattacaacggtaacaggcagcactcaatgcagccgtaattactgataagccgcctaaagtacgggcggcttacaaaataaacaatatatcgatatattgcgatgtgtaaatggattggagggtttttcttgcagattattatatctatattgaatttttttcaagatcaagtgttaggcatgaaatggctgaatgcggtgatcggcagcggtttgtccgccgttggtcttgatcttgaaagcaaggttggcgcaagtattcagtttttcatttacgatacaattaagattactgttttgctttgcgtacttatttatctgatttcctatatccaaagctattttccgccggaaagaagcaaacggatattagggcgttttcatggagtaggtgcaaatattgccgccgccttgcttggaacggttactccgttttgttcatgttcttctataccgcttttcatcggctttacaagcgccggtcttcctttgggcgtaacattttcttttctaatatcgtcccctatggttgatctcggctctctcgttttgttaatgagcatattcggatcaaaaattgctgccgtttatgttcttgtcggtttagttatagctgtcgcaggaggtacaatcattgaaaaactgcacatggaaaaacatgttgaacagtatatcaaaacagctggaagcgtagatattgaagccccggatttaacaaaaagggaacgattgaagtttgcgctggagcaggtttctgctactttcaaaaaagtttttccttatattcttgttggcgtcggtattggtgcatttattcacaactggataccgcagacttggattgaaacagctctgggcagcagcaatcctttctcggtgattttggcaacgcttgtcggtgtacctatgtatgcggatatttttggcacaattcctgtcgctgaagctctgtttgccaaaggtgctcagcttggcgcaatcttatcttttatgatggcggttactactttgtccttgccgtctctcataatgctgcggaaggcagtaaagcccaaactgcttgctctttttattggtatctgcgcaggcggaattatcattgttggttatttgtttaatatatttcactattttttggtttaaatgaaaggagattatcattatggcactttttggaaagaaaagaaaaaaagaagaaaccgcctcctgctgcggtaattgcaatgctgaaagtatggcacaggctgaacaagcaaaaacagagggggcaagcgttaaaattttaggaagcggctgcacgaaatgcaatcagcttgaaactgctgtaaaggcagcgttagagcagcttaacatggatgcgtctattgaccatattaccgatttttcacagattgcagcttatggagtaatgactaccccggctcttgtcgtggacggaaaggttgtgtcttatggaaaggtgctcaaggtcgatgaagcagttaaaattttgaatagagttaggagttaattctgcggagtgggctcttcgctgaataatacggttgataatacatgaagtaaaaaatgaattgctgtaaaataggcggaaacacggaggttttgagagaatttcaagccttcgtgttctttttaattttttatgagcgtaatcgttttgtcttcaatatacgccgtttactatggagaattacgcagtaaaagccgtaaatgtaaccgcgaattgctcatctgtttctgttatgtgaaggtataaatcatgttatacttttactgttttaaaagtgcttacaatctctcatagattttgaagcctatgcggttttgcccaaaaaatcccgcggaaaacgatgattgaagtataatagaagccgcataacatttgtattatgcagcttttacgtgtttttgtgattatatagagtgctgaaatggattttttgagaacaacgcgaaaaaatactgtttttatgtttttataggtcataaaaattttataattgcatagaagtctagcatatattgacaaatcttttaaaataccatatactagatttatcaatttatatggaggaatgaatgatgagtttagttataaaatcggttaatgataaagagtttgctcagtatggaagagtggtagaaggtatagagttcagccggcttcttgataaacttaaaaacacaactccggcgcctgctgatgaggtcatttatgtgccgggagatagtaatttggaatctatgccggaagcggagttgctcagcaacaatatatacggcggtatgccgattcaaattgggtattgtaatggaacaaacacaaagctgaactgcctggaatatcatagggacagcgaaatagatattgccgctgatgatgtggttcttcttttgggaagacagcaggacgctatgggcgatagctatgacactggattggttgaggcttttttgtgtcctgcaggcacggcggttgaactttatacaaccacactgcattatgctccgtgcagcggaaaactaggagattcgtttagagttattatagttttgccgaaaggaactaacagcgaaaagcctgatatagaaattaaaaatgatgaggacaagagactgtttgctagaaacaaatggcttattgcgcatcctgaatcctctgaggctgataatggagctgttgtgtgtctcaaaggcgaaaatatagatattgcggaattaatctaaatataatttgaaaggggaagagggagtaatgagatgttttaattgcggcgcggagatagagccaaactctgttgcgtgtccgaggtgcggcgcaggcgtgcgcaggccaaatgctgatttgacggcggaacagccgcctttgcgtcagccgggatataatatgagaccaaaccagcctccgagaggaatgacgccgctttacagtgaaccaataggtcagcccgtatcggtactaagatgggtaggacgtatgtttctgccatggatacctattgttggcggtttggtttattttataatgataattgtatgggcatgcggtgataagtttgatgaaacgtcaaagaactgggctattgcttctattattatgatagctttcaatttgctggttacaatagttatattttgtattttttatgcggtatttatggcgttgtttaacgatgcgtctgttcaaagggatttacagatgttctttgattcggtgccatataatatataaattaagttttgagaaaagtaacaattaatctatttaaattgtgacgttggagtttatagatacaaaagtatgtgcggttttatcggcaatgcttgtaatgtgtattcttatttcttgcggaaataattctatagttggtatatgggagccaaatggcagcggttatgaaatggaattttatgatgacggcactatgtcgtcaaaacatgaaacaggcaaatatgaaacaatagataatcatttgagaatattagacatgggttttatgggtcatgttctatcatatgattatgagataaatggcgatactttgatactgattaatgacagcggaatcagacgtgagtataccaaaaagaaataagataaaagttcaattaagaatattcaaattttttaaaataggacttgcaattttgtttagaatatgttaaaatctaatgcggtgctgaaaatgacagcggctaaattcggagaggtggtcgagctggcttaaggcgcagcattggaaatgctgtgtacgtttatagcgtaccgagggttcaaatcccttcctctcctccaaataagccaaaaccgccgcaaaacggcggttttgttttgccttaaatgattttttacacaattttattcaaaatatttaccgcttgctcttattttttggggggatatatggggatatgtattccctgtcgtattgacgtctgtataacgtaagcgtcgggcaatcccatgtatatttatgccttagtttgctatcagcgaggcgtggctatgactaaaatcgtgtatgcttatggttttcagtcttgatgattaggcaaactgttcgttaatttttactaatctagaatctttgagcggacatgtgtttcctcaaattctgaaatcgtcgttaaaggctttgtgcttataccggcgttttttatgttcatctgaaattttaattaataatatttggagatgcagtgcgcgtattaagcctatattcataagcgatgcttctttggcttagccccttaattttttgtgatattctgagcgttacgttcagatattttctatcaatatcaatcaatttcaaaacgtgtattttgtcctttctcagtacggtgtaaaatgcggaaggatacataataatcccagccatttaaatccggacaagtttcggcgtgtttaagcgcagatttggcgtatagtttaattcttcatatatgtaaaaatccatttctttgtttctatagtatttttaaagtttctatgtcaactgggtaattagataatcaagtttgacccggataccggagaagtatctgatatatacgcagggacgccgtttgagggtatgatgattatagcggccgggagaatttctactcatatgtgggaatctgagagtgggaagaaaaattattccactgatgtaacagtaagcgagataagttttggagagagcaaaaaaatgggtcagggcgataatgatgtgccggatgatatgccgttttaattttgccggctgttatataaagcaaaaagttagttaagcagttaatttatggcacgcactgtcatttacattaaagtataattaacatattcatagtatcacaactaagtctgattattgataaattgttttaagtatgttcacgctgcgcgtgatatgacagctcacctaacgaggcgcacaagtgcgcaatatatcacaactaagtaaatttattatatgacaactaagttaattattggcatttatagtttgtataacacaatatagtttatataacatacacttttaaataaaagtgtagccgcaattgacattgcaatctataacaaaacaagttgttttgtatcacacccgccctacagacggggtcacacctaccgtagttcacaaaaaacactgtgttttgggtaaatatttaaaaaataataaaaaatgttgtttagcaagcatcggtaggtgtgaccatacttttcttaaaaagtgtgtgttatacatatgattttattttgccataatctacaatgtcattattatgaatactcaatgcagatgaaatctgccgcgtaaggcgcgcagccgtggtaaagtttattaatagtctgtattaagtttcagtaattagtattgttttgaaaataggggtggcattatcgtttgctgaaaaggcaggttgtaatgttgttccgtaacaggggtggcgctgccgttcgtataaatcgggttgcagcgttgttccaaaggagaattcttatgggaaaagaagcatttgatttctttcctttagacgtgcatctttattgtatcgcatggtatgataatcaaagatttatcgcctaaagatggactcgcgtccgattagctagttggtggggtaaaagcctaccaaggcgccgatcggtagccgaactgagaggttgatcggccacattgggactgagacacggcccagactcctacgggaggcagcagtgggggatattgcgcaatggaaagctcccattgactacatcaactcttttatcaatttcggtgaactcttttaatcttttttgtaacacatcattgacaaacctacaaaaatggggaataaatctttaataagtttaatattgactaaatcagcaaaataaaaactcggctgagaatgtttttttattaccaatgttcttattgtacagtaatatgaattatgagatagttatagaacacctgattaacggatgattttgtttgaaatttatataaattttgcatattaatctgttttttataacataactttactttgctcacgaaagagttttcataaataaaataatataattataatactctatttaaaactgtaaaattattttattgataacaaataagtgactggacatttaaaatagataatgctataattttatctgaaacattaacaataacagataggggataaaaaatgataatagatatacacgcacatgtgtttccgaataaaattgcggaaaaagcgtcacagggaatagaagatttttataatatagacgtgcctaataatgggacaatagaaagactgctggaattgtcagacaaagccggagtgaataaagttgttattcattctcctgcaacaactcctcatcaggttcaatcagtgaataattttatatatgactgtacccaaaaatatcccgacagggttataggatttatgactttgcatccagactttgagaatataaatgatgaagttgagcgatgtatctctatgggattaaaaggcgttaagctgcatccggattttcaaaggtttcatatcgacgaccataaagcattttgtatatacgaagcaatttcaggacgattgcctcttttagtgcatacgggtgattttagataccaatggagcaaacctgaaagaatggcaaaagtgatggatgaatttccggcaatgacagtgataggagcacattttggcggctggtctgaatgggacgacgcagcaagagtttttaaaggaaaaaatatttatgttgatacgtccagcactatgtatagtgtgcctcctgaacatattaatgagttgataagacagtatggaacggatcatgtactcttcggttccgattatccgatgtgggatgctggaaccgaacttgaatacatagagaaacttgatttaacaaatgaagaaagagaacttatacttcataaaaacactgaaagaattttaggtatttaaaatattatattaaacagtctcaaaagtcctaaagttataagtattattccgggtattgcagtgagaaacttatcatttatctttggaaattttttgactgttccgcctaaaaagattccgaggctaagcataagatactgcatacaaaatattgctacaggaaaccagaacgaagcgtttgtgccaagtccaagcccagttgccgatgaatccatagaaaccgcgattcctatgcacagagcttcttttctgtcaatatcaagtgaattatccgtgtcgccgaagctaagatcagatttgttcagcgacaaaagcatataaattccaataacaaaaaatattatggctccaattaagtcggagacaaatggcgaaaatattactgaaatagccaaacgggacaccgctgtggatataaaggataatgtgaaagacgctaagcttattatcagacggattgtcttaggtacatatatattttttacaccataggcaactccaatgcccagggaatcgaaactaagtataaacgcaagcaaaaaacaaaacagcatatcatgatacctcccaacaaaaagttctgctgttagtatcaggatatgccgaattttggttttagtgtgttttgtcttaaaaatgtgattaagtaaatttaatttatattctttttaagcagccgaaaggtatttttatcaaaatctattaacccgtcttgtttcatctttgaaagttctcttgaaagagcgcttctgtcagcacagagataatcagcgagatcagaacggttcatatcagttttaaaatagcttccggagttatttgcaataattgatagataggttagaatcttttcacgcaaagtttttttagatattatctcaagtttttgaacaagctcaatatttttagacgccataagttttacagcgttttctattaaccggtggtgaaattcgcacgcagctgagcaggaatttaatacttttgcaaatgggagaaacaagacttcgcagtcagtttcactgtagaatgagatagaatcagaaaatttgtttgagcacagactgttttcaccaaaaaagtcgcctttataaagtacgcttattagagtgtgattgccattaatatcacacattgtcatatgtattgtgccgcttaaaactgttacaagacaagcgttatcaacctgagccattataatattgtccttcttaaaagtctttttatatgctcctacacagactaaaaccgaacttatttcatctttttttattccttcaaacagtggaagctcagttgtgtattgagtgatttccataaaatcgtcctccgttaattaaactataaatatattaacacagtttattatttgttgcaatcgcaacatacatacatttaaaaaaatgatatagtttgaatacgaaataaattaaaatatgtttgaaattcaatgataatctttttatatgtagaattattcaaaaaatataggaggaagatataatgataaggaatattgtaaaaattgatgaagataaatgtaatggctgcggactttgtgtttcagcatgtcatgagggagctatagaactgattaatggtaaagctagattaatacgtgatgactattgcgatggtttaggtgattgtctgcctgcatgtccggttgacgcgataacaattgagaagagagaagcggcagaatataatgaagaattggttaaaaagaacatggaaaagccggtacatacaggcggatgtccgggcagcgcattaaaagaatttgcgcgcagtgagagtaattattccgaatctgattatgagtccaaattaaagcagtggcctgtacaaattaaattagttccggtcaacgcaccatattttgataatgctgaaattttagttgccgcagactgcgccgcatatgcacatgcaaattttaatcaggaatttatgggagataaggtgacattaataggctgtcctaagcttgatatgactgaatactccgaaaagcttggcgagatttttaaagcgaatcaaataaagagtgtaactgtggtaagaatggaggtaccatgctgcggaggattggagaatgctgttaaggtagctttgtcaaactccaataaagatatatctttaaaagttattacaatttcggttgacggacatgtgatgtaaaacgtcttatacaataaaatgtgacgtaaaaaaactgaagggttttgtccttcagtttttttatttattattatttatacagtcttcttcactgctactattatacgtatccgtccgccgtttgagggcaatttgtcatagtatgcatacagtgtataattgtcactgcctataatgtcgctgattggcttcagcctatataaagtagaagaggagtattccttttcatatacttgaacgtcagcagatatatcatagctctttccgtcggctgtaaggcttccggcgcttgtaactgttactgtgccctttacttcgctcagcggtgacattattgacggattgcttgcggatgaaagccttactccctgaccgctgttcactgaatatattgttgacggacttgtaaatgaataactgctgccgtttactatatatgaatatgagccgctgacagatgttccgaagctcatattctgtgctgaggtcattactccaaacgtataagaatctccggttacatcatttaaaataagtttatctatttctccgcttgaatttttgtggcaatatagaattttgtttgaattaatattcacattattaagacgggtaggataaatctttttatataatgacgggtcatttttatttgttgttcccacgtccaaaatttctacatcgcttgccaaataatcgtcgccgaaacgttttgtgtcccaacggaaataaccgctgacctttgcgctgtccgttctggaaattttagctattccttcatttatactaacagtgactacagaatttttatagtcctcataattttggctgcacgtataatcgtaggtttcaccgtttgccgctgctactttgatataataatttgaataatcctttaggtcctctgatgtataagttttggttcctgtttcaaagatatatcccactatttccgaatcagttactgttgaggtaaccacgtctgcaacctcgttagtttttcccaatagcaaagttatcgtttctccaagtgcgagattaccgcttgaagacagtttattgaaagcatttgaaccctcaactttatatgttacgcctgagacaacaatttctgtagggttatctttattcgggtttgctttgtcatatacacctgtgactttggtagtataggcaaaggccatatttagttcaggtatatagtagagtatgtcgtaggtttttatatctgaaattgtgcaagcaactccgcctctcatgatagtagtagatgaattaattccgagagtttcagcccagttattctctgagtttattgtgtaaggaccttgcatattacctttttcgtatactacgtaatctatatttccattagtctttttaatattaagaacatctcccatttcaaaagatgtttttatagctccgtaggtggttctggttgttccgtcataagcgacggtgccggcaggaatatccaaagttgtcatattgccgcctttgtataccactatgttgtcacttagtacggagtataccacatatttttcattaggagaactgtccgcctttggaaagaagcctataacagttttgttgtcctttaaagctatatctcctttcattccaacatatgaataattaaaatcagaccttattttatatgtgccgttgtcggtgaagacctcatcgccggggatagaactgtcctcttttgaagttgaaatcagcgtcacatcttcaacaaaagcgacatcgaaaatagatataagttttgaggatgaatctttctttttggttcttaatgtattatatactaatgtagaaacgtcttttcttgtcatgttggaaccgatactgatatctgttaggttatctgtcatatcaagactgtcagccattcctatttgaccgcttggccaggctacgccaaaatcgctgtccgaatatcctaaaaccctgagcataattgttacagcctcttcaaaagtaactatatcatcaggcttaaaagaagcgtcagggtatcctgatacaagattgtttgtaactccaacacgaacgtatggagcagaccagtttgaatatggaacatcataaaacggagaaattgcaaggtttgatgctacgctgttgcggtaatcagaagacgctacagctatttttgtgaattccgctcttgttacaaagtcatccagtctaaagttcccgtcagggtcgccgttcataattttaagttcagataataatcccaaaacatcctgctgagaattatcactgccgaaaaccgttattgaaaaagcagaagcagtaaggcatatagctaaaataagtgaaagtataggcctaaaatttttttcagatttatagttcataatttcctccaatctctgtggtttttatcttattcatgtctgagagcgtcaatagggttaagattagcggcatttttagcaggcagataaccgaacatgattccgatacctacagaaacaccgaatgaaactcctattgctgtcagtgatggtagcgcggtcaaacctaagagccgtccaaataaaacggcgaggattgacccgaccacaattccaataagacctccaacaccgcttacggttgcagcttcaataacgaactgagattttatatccctcgatttggcgcccaaagacttacgtataccaatttctcgagttctttcagttacggacacaagcattatattcattattccaataccaccgactaaaagagaaataccggcaatacaaaccaaaagagtactcatagtgcttgtcatggtacttgccatatccattatctgctttatgcttgtaacattatagtaatcgctgtcgccaattttgttagctaaaaactgctttacttttgtcattgcatcatctactatatcaacgctgtttgtctgaacagtgtaggaactgataaatgaactgttggacattgatacagcggtggtataaggtatatagattacctcatcctgtcctccgctggttgaatcgccttcttctgtcagcactcctataacggaaaaagtatctccgtttattttaagcttttgtcccagtccgtttccgcgtccgaacatttctttttcaatatatgtaccgataacgcaaactttttgttttttctctacatctacaaattgtaagaacctgccttgttcaagctccagctgttttatactgcagtagctctcgtcaactcctgttgcggaggtagataaatcatcgcgcccaactttaactttagcggaagcaaccataacgctagggctgacagccttaaaaaactcagggttttggtcaacaaaagtatacatgtcattttcgtcaattgttcggcttccgcccctgtcctgaacgctgacagttattgtgtctgttcccagctttgaaaattgatctgtcatcattcccatcattccgtccatgaggctgataagtataataactgctccaactcctattattataccgagcattgtaaggagtgaacgcattttatcaaacataagattagagaaggcaagcccgaaagattttttaagcgtcattgttgtcgtcctcctcgtcatctccggcatgggctactgttgcaaatttttctatttcaggcgcgccgtcgtatgttatgcgtccgtcctgtatccggataactcgctcggcttgggcggcaattgtattatcatgagtgataagcacgattgtattgccttcgctgtgaatctttttcagaaacttcaatacctctttaccggttttggagtcaagagcgccggtcggctcgtcggccagtattatggacgggtcgccggccagggctcttgcaattgacacacgctgctgctgtcctcctgacagctgctgaggcatatttttagcttttgctttcagcccaaccctgtcaagtgaaatgagagcgcggcgttcctgctctttttcagaaagtccggcatacatcagaggtagctcaacgttttgctgaacattgattttggggataagattatactgctggaatataaatccaagttctttatttcttatttcagcctgttcatcatctttcatggtgctgacgtcagttccacggagaaaatattttcctctgcttggaacgtcaagacatcctataatattcatacatgtagattttccgcttcctgactgacctacgatagcgacaaattcacctttatatattttcatcgaaactccgtcaagagcgtggacttcagaatctcccattatatagattttataaatattttgaaattctataagaggcgtttccattacattccacctccgccgggtctgccgcctgaaccaccgccggcgctgtctttcattctttcgtggctctgctgcatcatttcttccatagaatttccggttcctgccgtggagtatagaatttcaccctcttcaaccccgctgaacacttgtatatattcgccgtcgctggaacctgtggttactgaaacagtcttataaccttcaggagctttatcgttttcttcggttttatcacccttaacatatacagtgtttccacggttaagattgctgacaggtatagccaaaacattgtgaacactggatataataatgttggcttcaacgttcattccggggagaagcgcgtcatcaaagtcgataatatttactttgacagggtatgtggttactccatttgaacctgcagttccgttaacgcttatgttttctacaacgccggtatattctttatctgtaacgtcggtagtgattgtaactttctgaccggttttaacatttttaacatcaagttcatcaacgtttaaagtgcatttaagttcactcatatcataaattaccgccatagctgaactggaagcgctggcagaagtcaactgagaggacgatgaactgcttcccgatgagctgtaagaagaagtagaagatgaaccgcttccgagattgtcgcctttctttttgtttttggtaacaactgttcctgatatcggcgctttaatggtgtagtcttcaagctgtttcagaagcttttcttttgacagaacagcatcatcatacgtcatttttgcagttttaacagcggaattcagtttgtcatcgccgagactggtagttgcgtttgaagtattctgctgaatcttagcgcgttcaagagcctggtttgcgtcatttaaagacaacagtgcggatgaaatttgtgattcaacagagtcagaatccagcatagcaattttttcaccattataaacatgactgttttccgatatgtacagagagcttattttgccgcctgacgaagctgtaatgctatcttcggtaaggttttcaaaagttccggcatcgttacaagctatatctccaaccatagctgtagcagtatctcccgatgatatggctcccggattatctacttcaatagtgacctttttatatgaagtaaaaccgcttccgctttcaactaaagcaccgatttcggtgacaactccgcgtacagacgagccgtttttagttaaagtaagatctgcagcttcgccaacatgcacattatccgcatcagctgtattaaacggaacttttatctttagttttgaattatcaattatatcagcaatttttgtaccggcagcaatggtgtccccctcagagatgtgaatctctgtaactatgcctgtgtggtttgatttgagagacaaatcatcccttgctttcagtgcgtcattatacgcttgctgtgctttatcaacggcaattctggcgctttcaacggaactggcgctggtagctgtatcgcgtacagttttagaattttcatttattgcgtcgtcatagttctttttggctttagctatagctatatcggcgctttgaatactgttttcgatagtactggcgtcaattgtgtacattaaatcgcctttttgaacagtgtcgccttcttcaaaagggtcatccaaaatttcacctgttacatttgctgtgattgaatactcgttattcggttcaacaacagtactgtcatttattttttcttcaatatctcgcttttcaactttaattaaaagattgctgtcttctaattttttccctagcctgaccgtgcttataccaataaataatacaagcgctaatacaatacagatgacagcgctccaaattttatggtttttcatcagtttccataaggcggcaaaaaatattttaagtttgcctccgatgaaaaaagtgaaatctttgattttattacgtactaaaataaatttgttcatgttctgagcctcttaactgaaaatgtctttgtctttttctgaaatattttttataataactatggattcttcaattaattcaagcattgttcggaatttttcttcacccatggtgtctttaactgtgatgcaatttttattaaaataaggatctatttttctagttatgtctttagctttttcggtggtgataagataagttctgcgtctatcgttttcgctgttatacctgagaatatacccttcagattctaaagaagagatatattgtgagaccgccgcgcgtgagacgccgaattgcctgctgatatcactggaagttattttatttccttcagacatactttcgtctattgtttttaagataaaatattctctgttggatatcggcaatacagataaaagacaattaagcgcttcttttatctttaagattaatatctgtgtcttttttacatatgtatcctggcttatttttgggtttgagccaattttagacatatactcctatctccttaaaatttaacagcggcttaatggttaagcaacttaacaaacattatagcagagctaaaaaagggtgtcaatgtaatttatatataaaagccccaaaatatacttgatatttattaacattatgatataatgactgttacatagaaataatttgtaaggagactaaagtatatggataattttatatttgataattatactaaaataatatttggtaaaaagacggaagaaactgtcggcgaagaaatcaagaaatacggcagtaaaattttactccactatgggggcggaagtataaagagaagcggtttgtatgataaaataatttcctctcttaattctgccggcgtagagtatattgaactgggcggagttcagccgaaccccagattaggtcttgtaaaaaaaggagtcgatatttgtaagcgtgaaaatgttgaagcaattttagctgttggtggcggcagtgtaattgactctgcaaaagctatcggattaggtgcgttgtatgacggtgacccttgggactttcatgcgcgtaaggctattcctgaaagaatgcttccggtaggtacagttctgactattccggcggcaggcagcgagtccagcgacggaagcgttataaccaatgaggatgggtggataaagagaggtcttcacagcagttgtatgtatccgacattttcaattatcaatcctgaacttatgtatacattgccgaagacgcagatagcaaacggctgttcagatatattcgcacacttggctgagaggtattttactaatacaaaaggcgttgagtttacggacagaatgattgaagctgcaatgaagacagtgataaataatgcaaaagcaatggttgacggaagcaaagattatgacacatgggcacaggtcgtttgggccggaactattgcacacaataatctattaaacaccggcagagtgggagactggggttcacacaacattgaacatgagctgagcgctcactatgatattgctcacggcgcggggcttgcgattgtatttccggcatggatgaaatatgtgcttaaacatgatgtaagcagatttgttcagtttgcgacaagagtatttaatgttgaaaacgatgtttttaatccgaccaaaactgctatgaacggaatagaagcttatgagagatttttgcagtctttaggtctgccgaaaactttatcggaagtgaatattggagatgaaaagtttgagcttatggcaaaacaagctgttgaaataggcggaggcaaacagggaaattttgttgaattaaaagagaacgatatacttgaaatattaagaatggcgaaataaagacaaagttgtaaggttttagacatatattttaatccagtttgttacatttttgataaatttttaaaaaactattgcaaattgattttgataaggttataataacgtcattatactttaataggaggttaagcaatggacgcaagtcaattacagaacttttatccgtttcttatgacggccttgattcttgttgtgttctatttcattttgattagaccgcagaagaagaaggaaaaggcattgaaggacatgatttcttcattaaaagttggagatgaagttgcatcaatcggcggtatccatggaaagattaacagagttaaagacaatcttttcattttggagacaggcgttggaacaacaaagtcttatgttactattgagaaaagcgctatagcgcgtcttatcagcgaaggaacatccaaggaaagcgatgtcgctcctttggaagaagctgctgatgccgagtagtttttaaaatttgacatttagtattcactctttgcatatagtttaataactttaaattattgcaaagggtgtgtgctgtatgacaagcggtgcttttcaaaaaagcgagaggcagggaggattttctcccgggggatttaagcgtgagcaatccggcggtgaaacgtcaggaggagataaaacaatttcttctctcataaaaagtatctgcataggttttggagcggctttaattttgctgtttctgacttcggttgcggcttcattttatgatattccggaatttgttttaaactatattgttattgctgtatctcttatctgcctatttatggttggctttaaagccgccgggtataatggtaaaaacggtcttttaataggtgtgatagccggtgtagtctatgcggtaatcgtatatttgattggctggctgggatttaaaagtatttcgttttcccccgaggctatcgctaattttgcggtagggggagctgtcagcggtttaggcggagttgttggtataaacagatataccaagaaaaaacgcaaacgctgatacatacaagttataatagtaaattaataattttagtttatataaaggagaggttactaatgaagagaataaagacattaaacagtgcttcactgaaaaacagcgcatgcaagggcggctgcggcgaatgccagacatcttgccaatcagcttgcaagacatcttgtacagttgccaaccaaaaatgcgagaacgataataaataggatataaataggcaagtctagtatttgccgatattctgaattatcaaataaagatagcattgcgggcgtccttgtttaacataggacgtccgatttacgtttatttacaaggagattattatggtacatacttttaaaatgtttgacaaatatatagctcttgatgttaacagcggttgtgttcacgatatggacaaactttcttatgatataattaattttttgaatgtgaagaattttgctccaacttcttcagaagcaaagtttaagctgattgacgacttgaaatatgattacgaccgcggtgaaatcagtgacgcacttgcagatattgctgaattatatgaaaacggtatgctgtgggcaaaggatgattttgaaatcgcttcaaatctaaaagaaaatgcaccggtaaaagcgatgtgtcttcatgtcagccatgactgtaatttaagatgcaaatattgttttgccgacgagggtaaatatcacactgaaaaacgtgaacttatgactgcagagaccggaaaacgcgctatggattatttggttgagcattccgggcaccggaggaatttggaagttgatttttttggcggagagcctttaatgaactttgaggttgtaaaagaggttgtggaatatgccagagaattggagaaaaagtataacaaggttttccgttttacagtaacaactaacggaatacttcttgatgagaaaaaacttgaatatattaatgaaaatatgtcaaacatagtactcagtattgacggaagaaaagaagtaaatgaccgaatgagataccgggctgacggaagcggttcatatgataaaatagttcctatttttcagaaagttgctgaaagcagaaaccaggataattattatgtcagaggaacttttaccagagaaaacctggatttttcaaaagacgtaattcatttagctgacttaggctttaagcagatttctatagaacctgttgtttgtggcgaagagactgattattctttaagagaagaagatttgccgaaaatctttaatgagtatgaaagtttagtaaaagaatatgtaaagagaataaaggaaggaaatggatttaactttttccactttatgattgaccttgaagaaggcccttgtattataaagaggctgtcaggctgtggctgcggctgtgaatacctagctgtggcgccgaacggagatgtttatccctgtcatcagtttgttggcagcgaggaatataagatgggaagtctctacgattccaacgggctaaataaagaactgcgttcgacttttgaaaaatgcaatgtttatacaaaacctgactgtgacagttgttttgctaaatttttctgcagcggaggatgtattgctaacgcttgtttgattaacggtgatatgaataagcctcataaattaagctgtgaaatgatgaaaaagagagttgaatgcagtttatatgctaaggcggcactggcggactgatattaaaataaatttgagaatgaggtgaatgggtgtgtcaggtcaaaatgaaaatataaacaataatctaaagaatatacaggaagaagaacatttgataacgtttcaggatattgttaaggataaagaaataaagacatatcttgaaatgggagataaatatctgggaactttaggatacacaaaccattcactgcttcacgctcaaagagtagcgaagattgcgcatatgatacttatatcgttgaactatgacaggcgcacagctgaacttgcgcgtatagcaggatatatacacgatataggaaatgtaataaaccgtgctgaccatgctcagtcaagcgctatgatggcgtttaatattctcaccagaatgggaatggcgccgcttgagatagcaaaagttataggagccataggaaatcatgacgagggaacagggatacctgttaactcattggcttccgcattaataatagctgataaaaccgatgttagacgcagccgtgtaaaaacaagagataataaagattttgatatccacgacagagttaactatgcggcggtcgtgtcagaagtttcagttgagagcagaagtaaaaattcagttgaaaccaaggttataaaaatggatttaaccatcgatacagatatttgctcagtaaccgattattttgaaatatttttggcgcgtatgataatgtgccgccgcgcggcagaacgtttgggagctaaatttgaactcaatgttaatggaacaaaattaacttaattctgttgaaattttgaaaattattaaactttatttaaaatcagcggctaaaccgctgattttttatttgttataaatctgtttcgttatataaaattttattaacaattttatattttctcttgactaaatcaaaatctaaggctataatagtccggtatgctaatgttgctatgtttatacataggttttgtgtttgtattttgtttgcatacattatattgttgtccggcgaggggtgattatatgttggggagtaagaaaaatatcgcttctgcatcagcagttgttgcggtatttattttgttgtccgcattgttttcatttctgagccaggctttaattgttgaaaaatctaaaactgagcgtattgtttccatttccgattgtgctgatttcggtatatctatgagtgcgcctcctgatatggaaagccatcccggaaacagtgatacgtttattatatccggtaatgttattgatagaaatttaagaacagattcatattttggaacgttttacaatgaacagtctatagcccaaagatgggtagatggtgaaatagcttgtatgataagtgagcgaacatcgtttaatgttggaagcgttgtaatgatttgttaaggacttctatagttttataaaatcgaaaaataattaaaatatatatgagaaaagctcaaatttaaggaggagaagaaattgtccagaagtttagtgaaatttgcggctataattttggttatcgcggcacttttctatgttggattgtatggtcttgattttaccgagaaatatagaattcccggtataatggacagtgatggaatcactcagggcctggatttaaaaggcggtactgttatagtgtttaaggcagatacagacgagccgtctgaagaggatatggataacgttgttaatctgctgagaaaacgtcttgattttcagggttatacagaagccagcgttactatgcagggttcaaacaaggtaagagttgagcttcctgatgttcaggattcagacaaagcggttgaaactctcggagcaacagctcagcttgagtttaaagacgctgacggaaatctgattatgacaggcggcgaggttaaagacgctaagtcggaatatggtcagacagagcagggaatatcaaagagttcatattatattagtatgacatttacagatgaaggtcaaagtaagttctcagctgctacgaagacagcagcggctgcggcatcatcaggtaagaacttcatttcaatagaaatggatggaaacattttgacagcgcctcaggttaagcagcagattgacagtgagacatgtattatcacaggccagtttactgctgaggaagcaaaagctctcgcagctaatattaagtcaggtcagcttcctttctcattgaagacagacgaggttaaggttgtaagcgctacattgggtgaagaagctttatcaaaggcaattacagcgggtattattggtttgatacttgttcttttgtttatgcttattgtatatcgtatcatgggtcttatggcggatattgctttactgttttatctttcaattgtacttattttgcttgcaaacttccacgtaaatcttacgctgcccggtatagcgggtattatacttgcgataggtatggctgttgacgcaaatgtcgttattttcgagcgtgtaaaagaggaattaaagcttggaaagacagtaagaagttctgttgagtcaggatttaacagagcattgtcagcagttatagattcaaatgtaacaactatcatttctgctgttattttgtggtggcttggaacgggaacaattaagggatttggtatgacattgcttatgggtgttatcgtatcaatgttctcggctatatttgtaactaagttcctgctcaaacagatgataggaatgaatgttagaaataactggctctatggtgttagtaaaaagaaaaccgggtcagaaagtgtgaaaggaggagaagcgtaatgtttgatatattaaagaaaaaatggatattctttggtattgctattgttttaagtttaattagtattgtttctctgattttccaaggatttaatcttgatacggatttttcaggcggtatagcattaacatatgaaataaacggagaatttactaccggagatataacatcattggtaaatgacgcaattgaaggcaaaaaggcatcttctattcagaaagccggttcagatgttattgttaaagttggatatgataagaatatgacagatgatgaaagagcagcattttccgcatctgttaaggaaagtcttactaccgctttagaaggtagattcggagccccggttgttgataatgaaaatcagaatacagaggcagccgctgaggcaacagcagctccggaaacaacagctgcaccggatgaggccgcagctgcagaagctacagcgcttccatcagctactccggattctttggaagcaacatcaagaggaacattgacctcaggagttagacttaagagtcttgatgatatttctccttcttcgggtcaggaattggcgcgcagcgctatgtggatggcattgcttgcttgtgcaggcatactggtttatgtaaccatcagatttgagtttacatcaggatgtgttgctataatcgcattagttcacgatgtattgattttgctcggtgtttattcattgttcagaatatcagtaaatattaactttattgcggcggtgctgactgttcttggttactcaattaataatactatagtaatcatggacagaatccgtgagaatacacgtcattccagaaaagaaacatatggcgaaattgctaataacagtatttggcagacaatgactcgttctatcaatactactataacaacattgcttaccattggtatggtttatataatcggtgtttcggctatcaaagctttcgctcttccgattattatcggtattgttgttggtttcttctcttcagtatttgttaccggtccgctttgggctacatggagagattctgctgttaaggctaaaaaagctaattctgcttcgaaagccggagctaagaaatctaagtaatatttgttttattataactgcatcgcaatttaactgcgatgcagtttttttgtaaagtttaaataattaaagtaagtttgtttcggaaacttgtttttggaacctactggaaaataaatcgtctaaataatattaacttttataaaaggagtgaagcagtaatgtttagttgcagaaatttaaataatgggattttaataaagtgttcagtatttataattggtttgattataatatcatgcgttttattcacaaaagtatacgcagccaacggtgatataaaagatactatatacacaactgatattctcacacaggtggatggtaaaaatatacaaagctattcgataaacggggagacacttatagcacttgaggatttagaaaattacggttatacggtctattataatgataatatacggtcggtgtttatcactaaaaccggaactgtcaatccggattataatcccagcattgagcgcggaaaggttgggggaacagcgggatacacatatgagacagatataaacgcctatattaacggcaagttgatacaagcttatgcaatagacggcaaaatggttgctaaggtggaagagatgggaaccagtgaaaaccttagtgaggatgttaatacaaaatatcaaatgagctatacatatgatgactcaaaaagattgctttcactgtttacctcgcttaagaattcagtttcatatgaagaagctgtttctcattatttgagcaaaacattggcgtgggaggaacattacactgaaaatattcacaatgaaaacaactggctgattgagaaaggtattggcggactgcctcacggcggatactataacactatgaatcttatatataaatcaggtcttatagtcgaccttgaatctgtagtaaattcatactatctaagcaacgatattgagtacacctttagtcctgacggttcaaaattgttttttattaatcaggttgatggggtaaatgaatataagcagattgatttgactacattgatgatttctccgtcaaacagcgatgaatatttgagcgctagacatttagctggaatttctgattttaccgctgatgtgaatggggtcaaaatacctgtttattctatcggaggaaatgacgcggtcaaatttactgatttggaattctgcggatatgatatgggccttgatgaaaaattcagatatggatttgccgtgtataacagtgataaaaaattaaatcaggacaagataaaaagtgcaagtataagcggcaatgctaaatatttgaaagcgatgagcagtaatcaaagagattttttaatttatattaataacaaaagtatgataccgtataatgttgatggtgaatattatattttaatatctgatatcaatgattctccgcacttcacatcttatgattatcaaataaacaacaccgaaatgaattataatttagatgattataaaattgaactaaaatatataccttcggcttatgatgatatgaaaataatgtgggacgattatttttatggttcggagctgggaaactgtgtcgccgaatatgagtataaaggaaataagatttatgcttatctttatgagtatgaatatacaggttccggcacaccggagaagaggtacagttatagattgattgaatttacacatgacaatataattgtggaattaactcaaattttaaattcttatatttatgaaaatatagataaggaatatttaaatgtaaataactatgataagttaacttattattttgactttgattctgtcaatggtattttaactattaaaatgtcagatggaagcaaatataacttagatttaaatacatatttaattgcgaaataataataggagtaaatgctatgaacatttgtgtttttggctccgctaaggaatttaattcctcaataatggcagaggcaaggaagcttggaagattaataggaagcatgggatacggattgacatatggcggattcggtgaagggcttttgtcagaagtagccaaaggcgtgaaggaatatggagggtatatcacagctgttgcacctcaaacgcccagacttaataatccattgtttcaggaaattgatgaattgattttgtctgatgataaaagaaaacgtaaagaactgcaggagaaaaattcagatatgtttgttgttctacctacaggaataggggtattggatgaattgtttgaaatacttgttttgaaaagctacggcgaactaaaacaaagaattgttattgtaaatattgaaaatatgtatgataatcttaaagttttgctgcaggatatggacgctatggaatattgtgattttgtagattccgttgacagaatatttatgaacgacaaatcgcagatgattaattaattatattatgtgttatataatacttatctttatctttttatgttcaagaatgtagtttttaatttaaaaacttcatattttttaaattaaaaaagtctgaatttgtgaaataaaatgttgaattttgcaaattataaagagccataacttttgttatggctcttattttctattcagtttctacccattcagtaaccagttcagtaaagaaatggccgtccaaatggtcaatttcatggcagaaagcacgggcgactaaatcctcgcctgtatactcatatacagctccgtttctatcggtagctctgatttttactattctaggccttgttactaagccgtatctgcccggatagcttaaacacccctcggcgtctgtctgttcgccttctgtatatataatttcaggattgataagctctagcacagtatcacctgtatcaacaacggcaactctttttagaacaccaacctgcggtgcggctaaaccgactccatttgcggcttttaaggtttccatcatgtcgtctaaaagacaaattattctgtcgtttatttcttttacctcacggcattttttggtaagtatttcgtctcctagtttaactatgtttcttattgccatattattttcctccgttttaactcatattaattggattgatatcaataatcatagtagtgtttttgtttttttgaatatgggtattattgatttcatggagaatttccagagataaatcagcgtccctgaccttaattaatattctgtatctgtaatcccctttaattctctgaataggcgcaggcataggatgagccaatttaattatattattgtggctgtcatcggaatttttaacaaattcaaaaacagaactgatttcaaattttacaatatcttctgtttttccctgaaccaatatacttattatgtcacaaaacggcggataattcaagcgttttctgaattttatttcattttcataaaaaccaatatagtcatgggttttagcaaactcaattgtagaattctttggctggtatgtctgcacgactgctcggcccgggatatctcctctgccggcacgcccgcaaacttgtgtgagaagagaaaaagtcctttcatttgctctgaagtcatcaactccaagagaggagtctgcggcaagtactccaaccagggtgacatcagaaaaatctaatcctttagttaccatctgtgtgccaagcaaaatatctgcttctccatttttaaatttatttaatatcgcttcatgacttcctttagctgaagtggtgtcacggtccattcttaaaatttttgcctccgggaaaagccgcttcagttcgtcttcaattttttgggttccagtgccaaaaaatttaatatgctttgagccgcattcaggacatacggaaacattcctgatagaatatccgcagtagtgacaaactaaactgtcgctgttcatatgataggtaagaggaatactgcagtttttgcattccattacatatccgcactgtctgcatgaaacaaaggtgttataaccgcgtctgttcagaaaaagtatagtcttttcatttttttcaagatttttacgaatttcaaactccagtctattgcttatcggagacatattatggtaattaaatatttcacttctcatatcaacaatttcaacagacggcagggagttgtcattatatctgttattcatttcaaacagcttgtaatctccaagtgtttttgcatgataaaaactatcgacagaaggggtagcggaagccaaaatcaaaggagctccgtttgccgaagctctgtattcagcaacctcccgtgcatggtatctcggattgatttcagatttatagctgttttcatgttcctcatcaagaattatcattccgatattttcaagaggagcaaatattgcgcttctagcgccgacaacaacgtctacttcattattttttattttgttccattggtcaaatctttctccatacgataatccactgtgtattacagcgactcgtttcccgaaacggctgacgaatctttcaaccatttgaggagtcaaagagatttcaggcacaagcattattgctctttttccatcttcaatacattttcgtattgtttgaagaaaaatttctgttttgccgcttccggtgacgcctctgataagtatcttttcgtgtttgttctcgtctagaagattatctatataatctattataggtttttgttcatcagtgggttcgtattcatttgttacaatataatcagactcgtcatatacttcacgtacctttttttcactgtatatttcaacaaaccctttttcgcttaatgctgcgagagagctgtagttcccgtcagacaatgctattaactccgaagtcgtcagtttttcactgtccgctaaagccaaaagcatattgccttgaacatgcgcatgttttttaaaaagctcatccgcagccgcataagcttcatcagatgatattttaagcttgactattcttattgtaagttctcttattgaatcgcttattttttcagatatagatataacttttttgtctgccaaagaattaagagaccggtgataagcgggggaagaaacaagttcaccaaggtggtcatattccataatcccatcattttgaactagtatatcaactattttcttttgaaattctgatataccggatgtatcagagttttggagacttacccacctgcgtatcacagttttcattttcggcggcactataagcttaaatgcgctgtaaaacggacacaaatacctattttgcatccacacgcagagactaagaagttccttagagcaaaccggcttagtatcaactactgattttattctttttagcctggtaaattggctgctttgcgagataccgacgataagtccttcaacggaattattatatagaccaaacggcaccaggacgcggataccgacttttacagcgtcttctaattcttttggaacaatatagtcaaaagaacggtcgattatatgtttagggcttattaatgcaacctgtactatcatatgccttaccaccaaactattctataatatttgtttgcttttattaattgataaagctttgttaagaattatatttgacagctcaaatttatccattagaggaagttcgcttatatttccatctctatcaattaacgccgccacattagtgtcagtaccaaacccggcgcctgtagtttttaaattatttgcgactatgaagtcaacgtttttatttacgcatttttcagaagcatttttgattaagtcctcggtttccatagcaaatccgacaatcgtttttttatcactgaattttttaccaagttcctttaaaatatccggatttttggataaagctatactcatatcatttagattttttttctttatcttattttctgatacggcagacggtttaaagtctgccacagctgcggccattattattatatctgcactttctgactcattgattatactactcctcatttcatcggcagaggaaacgtcaatagttttgattccagtgataggttcacatgaattatgtccggcaaccagtgtaacttgtccgcctcttagcattgcggctctggcaagagcaaaacccatttttccggtcgagtgatttgttataaatcttacagggtcaattttttcctgagttgcgccggcgctgataacaatctttttgccggttaggtctgcggaatctaaaagcgctaattttgcgatgttttcaaatataacgtcaattccggctaattttccgtttccggtatcgccgcatgccaggcgcccgctttcgggcataacaaaatgatagccatgatacttttcactcaatttttttatattgtcctgcacaattggattttcaaacatatttgtattcatagcaggagctatgagcacaggagcttttgttgccataaccgtagtcgtcagcatatcatcagcgatacctccggcgatttttccgatgatgtttgcagtacacggaactatagcaaaaacatcggcggcttttgccagggatatgtgtcttatttcccatgattttggctcgtcaaatgtatcaattgccaccggattgcctgaaagggactgaaagctcagcggagctacaaattctacagctgattttgtcattataactttgacttgggcgccggactttacaagctttgaagtaagctcaagggctttgtatgccgcaattccaccggtaacacccaatacaacagttttgttatcaagaagcataaatatcacctacataaaataatttataaaaatcaagcccactcggactgccagtgctggttcagccggtgggcggttattcaaataacgtcagtttaaagacttccgatatccggcgttgggatatagttgagcttatcctcataaatttcttcagccgctatagatacctctttgtttgacggaatatcaaccataggctgttttccctctgtcagctgtcttgcgcgtttagcggtttcaatagtcagcaagtatctgctgccggttttttcaaccatttcagtaataggcggttttatcatcataattaatctctccttttatttaatatacttaatatttcatctgatgcgtcttctacaattttatttactacaacataatcatatttatctttttttgtaagctcccattttgcagcatttatccggtcttcaatttcctcaggagtttctgtattcctaccggtcagccgttcgcgaagtacatctatattttcgggagcaataaaaatatatacggctgacggatatttctcttgaagattcaatgcgccctgaacatcaatttccaaaagcacatcttttccttcatccaatttttcattaacatatttaacaggagtgccgtagtagttatcgttatagactgcccactccatgaattcgttattatcaatcatcctcttaaattcatcaacagatttaaaaaagtaagtttcaccctcaatatcgccgtttctaggagctcttgtggtagcagatattgacggaacaatgtctgaattatcagctaacagtttttttagcactgttcctttaccaacaccggatgggcctgaaacaacgattaaaagacctcttttattcatcgtcatcaccgccgtcttcaatgttttcatcaccggatttcggttctgcccttccggcgatagtttctgtttgtatagccgataggataatgtggtcgctgtcagtaacaataactgacctagtgcgtcttccgcaggttgcgtcaatcaccataccgcgttcttttgcttcctgaataattctttttatcggcgcggaatcagggcttacaattgctataacccttgagcctgatacaatgtttccaaatccaacatttataagtttcatattagcctcgcttttattcaatattttgtatctgttctcttatcttttcaattaatgatttcatttctacaacaatttttgataagtctatatcattgcattttgaaccaatagtgttggtttctctgttcatttcctgaactataaagtcaagtttctttcctattggttctgatgaattaagagcgtttttaaattctttgatatggcttttaagtctgacagtttcttcatcaacggcaactttatcagaaaaaattgcgacctcggttaaaattctgctgtcatctgctccgctttccagctcagataatgcgtcgcgcagtcttttttcaagtctttctttatatttagttatagtttcaggagaaagtttttcaactttttcaacttctgacgacagaatatttaaatgttctaaaatgctgttgttgagcctgcttccctcgttaatacgcatgttcaagaaatcttcaagagcagcgtccagcgcggtatttatcatatttaaaattgcttcttcatcaatttctttatattgaacttcaaatatatcagaaagcgagcacatggatgacattgaaatatcatctttaacaccaaagccggataattcacgcaaattatttatgtatgattctgctagaggaagatttattttaacctctttactgtcatcattgattttatttatggaaacatagacttctattttacctcttgaaatattctgagataattttgcacgtatgttttcttcaagaaaactataaattctcggagtttttatagtataatcagcatatctgtggttgacggacttaatttggattttaacttcatataaatcgtcaaatgtcatttcggctcttccaaaaccggtcatactttttatcataattctacctcataacaaattatttttacagcttgatttattaacaagaatatagtataatctaaataaataaaaattatcttgtatattacagtataaattatcattattttgcttatctatcttttaattataccatattttttattgattgccaatagttaagaagtgttgtaacaaaaatgtaatataaaaataatatatatgtaattatagtgtaattaaattgttaatatattattcggattaaattggcaattcacgggaaaataaagcattgttaacaatttgttaacaattttagcaaacgcctgatatgacgttgttatagatgtattaatattcaataaattgggcagtttcttcaattatagcccctaattctattgacagattttcggaaaagcggtataatcgtcacatagtttcaaaagttaaacgcagaaatttggccgtataaatgttatttggccggtcttatttttgttgctttttgaaactgatagtcaaaatttatgcagaaaggggttgtggtttagaatagcgcatagacgtatattcgaaatttttggaggttttttgttttgagttttggaaagagttttagaagaattgttgcaacactattagtattgatgacaatttctacttttataatactacctacatatgccgattacgatgagatcgatgaaccggctcaatactatggtgttgttcaagtctcaacacttaatgttagacaaagcgcatcaatggacgccggtgtaatcaccacgcttccgtatggtacaagagttagagttaattggattgaacccggctgggtttgcgttgcatataataatgatggacttattggttatgtttcagctgactatctttctgtttacgatggaacgatacctgaagcaagtgaaggcggtcaggctgtttgcgatatagcggcacagttccttggggttccatatgtttggggcggtacttcacctaacggatttgactgcagcggattggttcagtatgtatatgcacagttaggatttaaattggctcgtgtagctgacgaccaaatgaaagagggtattcctgtttcaagagaccagttaatgcctggtgatataattggattcagcagttcaggtcttggcggatatgcttctcatatcggaatatatgttggtgacggaatgatgattcacgcgccgcatacaggcgatgttgttaaatataccagtattaattctgattattatgcttcgcgtttcgctggtgcaagaagaattatttattaagtttaatattaagatgagggcgacctaataggccgtcctttttgttcatgaattatattaatataatataagtttatttaggagagtataacatgacgattgaggagttaaacagagcgattaagtcttatactataccgcgggtatttttcttttttggtgaggagacatatttgctggaaaataaaataaaatctataaaggataaaattgtccctaaagatttagtaagttttaatttttcatatttaaactcggataagatgacaccggatgaaataattgaagctgctgaaatttttcctcaggtttcggacaggcgtcttgttgttgtgaaaaacagcggtttgttttctaatctgacgacaggcaattttaaaagtattaaagaatatatattaaatcttccggaatatgtatgcttgatattttgggaggatgggtttgattctaaaaaagttaaatcactgaagtttattgaagaatgcggcggcgggatagtaaattttgaatacttgccggtaaacaaacttgaagtttgggctgagaaacagcttgaaaaagcaaacaaaaggataattgcccgggatttaagttattttgtaagaatatcaggtcagtctttgacaaagttaagcaaggatataaaaaaattgattttgtatttgggtgatgagcgtcataaggtaacaagggatgatatagacgcagtagtcacgaaatctgcagaggttcaggtttatgatatatttaataaaaacattataggcggacgcggagataaagccaaggagcaattgaaacatttaaaaactgataatgtttcacctactatggtaatgagtattattttagaccagttatatgaactgctgatgtgcaagctgttaaaacaggatggtctgacagcaggagaaatgcttgaatactttgacaggcgccctccgatttttgcagtaaataaagctattgataatggtatgagatatagtgaaagttatttgaaaaaaatggtcgataaaggtttgaaatattcaattgatatgaagtcaggcaggatgggacaatgggatgctgtcgagctttttgtatctgaattaataaaaaaagattaaagtctatgtatttaataatataaatatattggctgcgggtgaatataatggaaaatggcgttataatgcagtattttgaatggtatcttccgcctgacggaaaccattggaatagattaaagaatgatgcaaaacatctgtctgacataggaataactgccgtgtggcttcctccggcttataagggagctaacggaatatttgatgttggatacagtgtttacgatatgtatgatttaggggagtttgaccaaaaggggtcggtttccactaagtatgggactaataaggaatatattgaagctgtagatgagcttcataaatatggtattgatgtttatgcggatattgttttcaatcaaagaataggtgctgacggaacagagattgtccgggctattgaggataacccgcaaaacagagaacagcagacatcaggtattgaagaaattgaagcatggacgagattcgattttttaggaagaaataatacatattcggattttaaattggattggaagtgttttcacggcgtagattatgatgagagaacaaaaagaagttcaatatttttgtttgagggtaaacactgggacgaaaatgttgacagagaattgggtaactatgattatttgatgggggctgacaccgattttgattatcagccgcttaaacaaagtttatttgattggattgattggtatgtcgatacagcaaatattgacggttttagaattgacgcagtaaaacatataaaatttgaattttttaaggagtggctgtcttatataagaaacagtaagaaaagagaattttttgcagtaggtgaatattggagtaaggatttagccaggcttcaaaactatctcggaatttgtgagaatgctatgtctctgtttgatgttccgcttcattttaaattttttgaggcttcagccagcgacggaaatatggatatgtcaaagcttttagatggaactttagtgtcgtctgagccgacaaaagctgtaacttttgtagaaaatcatgatacccaggagggtcaggcgctccagtctgcggttttaaattggtttaaaccttcagcatatgctgtcacattgctgcgtaatgaaggttatccctgtatattttatggagattactatggtgttccatcccataatgaaaaaccattcatggatattttggataagcttttgtggttaagaaaagaaaaagcttttggttctcaaaacgactattttgacgactttgatgtggttggatggacaagggaaggcgacgacgaacatataggagccggacttgcggttttgattactgataagcggggcggtgttaagaaaatgtatataggaaaaagacatgcgggaaagattttttatgattgtataggaaattgtgctgatactgtaacaattgataaagaaggttatggtgtttttgaagtttctgacggttccgtttcggtttggatattaaaaaatgaataatatactaaaaaatctttgttaattttgttcataatatttgacaaaactcttataatgtgttattctaagtagcggtataagcggatacggtttaaaccgtttaattggaggtgagggtttggcggacgaactaaagctgattaaaaaagcgcaaaaaggtgacgttgaagcttttgagaagattattactgagtatcagtctattatatataatatagcttttagatttgccggaaatgctgaggatgcggccgatatgtcgcaggaagtttttctgaaaatgtttagaaatataaactcgtttcaatttaagtcaaagctctcaacctggatttatagagttgcaacaaacacttgcctggatcaagtgaagagaaaaaatcggaataatcctgcttattcattagatgacgggtttgaggacggcgacggaagctttttctcaaatgaaattgcagatgattctcccacacctgatgaagttattgaacaggctgaaatgaaagacgttataaaccaggcaatatcagaattgcctgatgattatagaactgttattatattaagagatatacaagggctttcctatgatgagattgcagagataattgaatgttctgttggtaccgttaaatcaaggattagcagaggaagaagaaatttaagagaaattttatctaaagacagggaactttttgataagtatttcgtctaacaaaatgtagacggatatatgtctgaatatacaatatgttggattttattaattgaatatttctgtgtatatttttgtgtattcgttcaattttactataatgtatataggaaggaggggtataatgtcagattacgaaaaggatgatgagcttcgccgtaagtacggtgaggttatggacagtattgcggacgatattcgtcagataaatgtaaacaaatctgaaaagattgttcttgacgaaaaagctgatgatatttccgaaaataccggagatattttaagcggatttgaatctgccggcggaagcgatgctattgaaaacaacgatgtgaaacatgattattctgacaataaatttttggagagtataagcagaatcgattttgacaatccagacgaagtattgcggagtattgattctggaaatgatgaatttaaaaatttatcagactttaacgaaccggattttgatgccccgcattacagtgtccctaatcttgataataatgtgtcaggagttttggagtctaatgatgaatttgatattcctgaggattatcctgatactttgagttgtgatgaatgtgtggatttattgtatgactatttgtctgactcaactgatgatgttgaaaacatgtctataaaagctcaccttagaaattgtgagatgtgcagggttgagcttgatgatataagagatatgattggcgttatgagcagttcgccgaggttgactcctccggctgacttgatatcaagtattcatagtgaactggtatctgcggctccggaagtcaagtacgaatatgaagttattaaagcaagcggagttttaggcgccggtccgattgataaattaacagcggcatttgaaacagcgcggcataaagttgaccattttataagacatgcaaattggaggattcttgctccggcggcacttagtgctgttttggttgtaggcgtggcttcaagcggcttatatcaagtaatgaagtcttctgatgaagtatatgatttttctgataatgccgctatagagagtgcaaaagctactgctaaacccagcgccagcgggcttgacgagtatgttggaggaagagcgtcagaatcttcgccaagaaccacatcggcgcccagagcgtcttctgttcccggaaattcaacttcaccgagaactacagctagaccatcagccggaagttcttcagggctgaacattggttcaagtactccgagcagcagttcttcaaataaatctacatcgtctagcacatctggcagcggaagtacaaataaaaatacgactaaaagtaattctaacagcggtagttcaaataagtcaaatacttccagctctacaaataaaaacaacacaagcagctcaagcaataaaaataatacggctgcggcaactccggctcctaaagcttatgttactccgaagataattttgccggatattacgtcagctatgacacaaggaacacgctcaggacaggataataatttagttatacctgaaaatccggcgcctgaaaagtttgaatatactcccagtgacgattcaggaagtcaggaggaagcaaatcagcctcagactcagaatgagtccaacgatacaaatattccgaatactccagccgctgtaacatcaggcggaggaggcggcggaagcgcagcggaatcaacagcaactccggaccctactgagaacccaaaacctacgcctgagcctactcccggtgcgtcggctccagtagcgacaccttctattactgcagaaccaaaactgggcagaaatagtaagggagaaactaaagcatttgcagataaatcagaaaatatggacgatgcctctgtagtgagctgtgagattaaagataaagcggtatatgacgttcttatgagttcagcgcttgctaactgttcaaagattgatgagaacggcgaggtaacattatactttactggagctgaatatattgcgtttactgacttcttaaaagccaacggcttagaatatactttagttgttcttggtaataatgatgatgtaaaagtgcttgtcacaggagtaaacgtgacagaataatatggtttataaaggaatggtcatttgtgccattccttttttattggatttttttgttaatatataatttacaaaaagtttttgtctgttaaatagatttttatatttttattgggtataattataataataaaatatattaaaattttggaggcggataaagtgggaaatattatatcttacgtaaaagaaaacggttttctaacttttgacgctatggactttaatgaggttgacagccttgttttgtcacaactttcatatctttgctttgatagctttatagaaagtgttcctaaatttgatataacatttaaggatttagcggaaaaagaaaataggaaagagttatttaaaaatattcgtactccgaaacaaaatcatagactgcttgacgcagttgcggagagtgagcggtttggaaacattggtattggaatttatgtcaatgaaatagaaaaagaaatagaaaaacaattttccgctgtaactttcaaattatcatcagagaaatattatatagcatttcgcggcacggataaaagcctgattggctggaaagaggattttaatatgtcttatcttaaaaacgttccggctcaggattccgctctctgttattttaaatctgctgctgaagagcttgacggcgtgttcatattgggcgggcattctaaagggggaaatttatccgtctatgcggcggctaatgctgatgaagacgaatttttgagaatagaaaaaatatataatcatgatgggccgggattcagagataatactttaagccaagaaaaaaggtctaaactttcggatatagttttgaaaacggtacctaaagcttctgttgttggtctcatgcttgaaagtgattcaaaatataaagtagtattcagcaagtccttagcctgcaatcagcataatccgtttacatggtcggttaaagctgatagttttgtattcataaaagaaacggatatgttttcgagattttctaaaactgctgttgataaatggcttgagaataatgatgatgaaactgtgagcggtctgattaattatgtatatgatttgattaaggcgacaggaagtgatactgtggctcagttaataaaaaattggaataaaaatataagacttatttataatgaaataaaaatttcggatccggagcttaaaaagttagcagtcaaggctctgcatgattttatagtaatttttaaggatattttaaaagggaaaagaaaatatagtgatgcgaaaacttgttctgaagtcagtatatcaagcaaataaattcaggggcgtttaattcatatttgaattagacgcttcgtttttatattaactattataatatgcttgtggttcgcagtcaatgaataaaatttatgtattaaaagttagtttatttgtgtgtatacgactttatttattgtttattataaaatatcttattattgtttttctaaaaacatactttttgtattagtttacataagcattcaatttgcatcccgttatgttacgtttatagcacaatttgttattattgcttatttttgattgaaattttagttaaaaatgtcagcgtataatatatctattttaatgctgcaaaaataattcaagaaaaactgcgtataagattgacaaaagataaatttatgtttaaaatactatatgtatgtaaaattataaaatattatgacaattctgctgaaaaggagcttttgtatgagtataaagagactgtttgtagaaaagaaaaaaggtttcgatatagaggccgaagagcttaaatctgaccttgttgaaaatttaggtctgagcggccttaccggtgttcgtgttataaaccgttatgatattgacggtatcagcgatgaagaacttcaaaaggtgcttcccagtgtttatgcggaaccgcaggtagacaatgttgaatttgaaaatatagaaataccaagcggtgataaatattttgtttcagaatacctgccgggtcagttcgaccaaagagccgacagtgcggcacaatgtactcagataatgacagaaggtgaaaaaccggttgtcagaaccgctagaattgttattttgtcaggtgatattagtgatgatgagttaaaggctgttcaggaatattgtatcaaccctgttgagtcgcgtttggcgtctatggaaaagccggataccttagccgacaaccttgaagagccggctgacgttatgattgttgacggttttatagatatgaatgataaagagcttgaacagatgattgcagatttgggtctagcaatggactatgatgatataaaattctgtcaggactattttaaaaatactgaaaaaagaaatccgagtttgacagagatacgtatgatagacacatattggtctgaccattgccgtcatactacattttctacaaaacttaataatgttaaaattaaaaatgagtttattaagtgtgtatataacgattacctggaatcaagaaagttcgtatatggtgaacgcaaaaagaatatctgtcttatggatgttgctactattgccgctaaagagttaaaaaaacgcggtatactaaccgctcttgatgagagtgaagaaataaacgcctgctcaattgaagttgaagtaaagatgactgacggtaccagtgaagactggctggttatgtttaagaatgagacgcataatcacccgactgaaattgagccgttcggcggagctgcaacctgtctcggaggcgctatccgtgacccgctgtcaggccgttcatatgtctatcaggcaatgagggttacaggtgcgggcgacccgagaaaaacattaaaagaaacaatggagggtaagcttcctcagcgcaaactggttattggagctactgagggctatagctcgtatggaaaccaaataggtcttgctacaggcggagtaaccgaaatatatgacgagggatatgttgctaagcgtatggaaatcggcgctgtaattgctgccgctccaaagaaaaatgttatacgtgaagttcctgaacctggagatgtggtgattttacttggcggaatgacaggccgtgacggctgcggaggagctaccggctcgtcaaaagcccatgacagttcgtctttagagacctgcggcgctgaagtacagaagggtaatccgccggttgagagaaagctgcagagattattcagaaagaatgaagttaccacactgataagacggtgtaatgactttggtgccggaggcgtttcggttgccattggcgagttggctgacggacttaatataaaccttgataaggtgcctaaaaaatatgagggtcttgacggaacagagcttgctatttctgagtctcaggagcgtatggctgttgttgtaagagctaaagacgctgaaaagtttattgatgaagctgataaagaaaatcttgaagctgtagtagttgctgaggttactgaatcgccccgcctggttatgaactggcgcggtgatgttatatgtgatatttcaagggagttcttgaataccaacggcgctgaaaaaaatgctgatgttgagattgcggttgataatttctcgtccgatatgtttgaatttgaaacaaagggaaatgactataaagagaagattttaaatttaatgagcgacctgaacgtatgctcgcaaaagggtcttgttgagagatttgacagcactattggaggaaactccgtgtttatgccgtatggaggaaagtatcagcttacgccgcagcagaatatggttgcaaagattccagtgctgggaaatgaaaccaatactgcaactgttatgtcttatggttataatccgaaaatatcaaaagcaaatccttttatgggcgctgtttatgcggttgtggattcggttactaaagccgtgtgtgccggtgcggattataaggatatttatttaacgttccaggagtattttgaaaaacttggaaacgatccaaagagatggggaaaacctcttgcggcgcttcttggcggttattatgcccaggagagtttgtctatggcggcaataggaggaaaggactcaatgtcgggttcttttaatgatattgacgttccgcctacactcgcgtcatttgcagttgcgccgcttgacgcttcaaaggctgtatccagtgaatttaaaaatgccggaaacttggtatttttggttaagcctaagtatgacgaaaataatctgcctgatttcgatagtttaaaacagctctatgatatgttatacatgatgatttcagacagtaaaattaatctgataaagagtgtttatgctgttggatacggcggtgttatggaagccgtttgtaagatggcgatgggaaataaactaggatttgaatttaccgagtgctgcgataaatctgaattgtttaaggctttatacggaagtgtaattattgaagttgacggattaaaggcaaacggttctttgggcagtatgcttgaaactgttaagctgggtcatacaacagacgacggcgtcataaagattgaaaatgaaagtataagtattgatgagattgtttcagcatggcagaaacctcttgaaagcgtttatccaacaaagtcaaaatatgaggatgttggaatgaaaaagtttgactgttcagagagaaatatttctgtgccggctgtaaaggttgctagaccaaaagtgtttattccggcttttccgggaacgaattgtgagtatgattccgcccgtgcttttgaaagagcaggagcggaagctgatgttcagattttcagaaatctgaagcagtcacatgttgaagaatctatcgaaagatttgtgaaatctgtcaatgaagcgcagattataatgattcccggcggtttcagcggcggagacgagcctgatggttcaggcaagtttattaaagcggcttttgaaaatgagaagttaaaagaagcggttatggagcttttgaataatagagacggattgattcttggtatttgtaacggttttcaggcgcttataaagttagggcttgttccgtttggtgagataagaaagatagacgatacctgtcctacactgacatttaatactataggcaggcatgtatctcaaattgtgtcgactagaatttcgtctgtaaaatctccgtggctgtctggagttaatttgggcgagatacaccagattgcagtatcccatggtgagggcagatttgttgccagcccggaaataatcgcggaaatggaaaagaatggtcagattgctacacagtatgttgattttaacggtgaaccgacttatgagatgccgtataatccgaacggttcttattatgctatagaaggtattacaagtcctgacggaagagtgtttggtaagatgggtcattctgagcgtatcggggaaaatgtttataaaaatataaccggtaatatagaccaaaaaatatttgaaagcggagttaaatattttaaatagtataaggagaaaaccatgtcatattatgaagcgtccgaattccttaaaacaaagactaatataagacctaaaacggcggtagttctagggtcgggtttgtcagaactgattgatatggcagaagtagatacaatcataccatattctgaaatacccgggtttcctgagttaaataatacttatcataaatgccgggctgtttttggaaaactttcaggaaaagatatattgattatgcagggaagaatccactattatgagggattttcaatgcaggaattagtttttcctatacgaatgatgaagtatctcggtatagagacggttattttgactaatgccagcggagctataaatactgattttgttcctggtgatttagttatgattgaagaccatattaaactaggttttgattctcctcttcgcggcaaaaatcccgatgagtttggagaaagattttttgatatgtcaaacgcatatacatccggtcttaaagaattggctctaagcgctgctgagaaagaaaacattaatcttaaaacaggtgtttacggatatatgaccggacctcagtttgagactcctgctgaaattagaatgctgaggatagcgggcgctgatattgttggtatgtcaacggttcctgaggttatcgccgcttgtcattgcggtatcaaagtcctgggattatcgggagtatcaaatatggcggcgggaattgagaacggcgggttcaatacagaagtaattgaaaatgccgaaccggtgtttagtgataaagttaaaaggctgattgagagaattatttgtgatataaattaggagatgatgatatggacagaattgcaagtttcagcgttgaccatagaaaaataaaaccatgcgtatatatatctagaatagacggagatataacaacatatgatatgcgtatgagaaagccgaatactggagaccttttaagcaattcagcgctgcattcactggaacatatgttcgctactcttatcagaaattcggaaatcagcggcgacgttatatattttgggcctatgggctgccaaaccggattttatctgcttattagaaacgctgataatcagcaggtcattgatataataaaagaaactttaagaaatataattatatatgacggagagatgccgggcgccagtgagatagaatgcggtaactatagaaatttagatatgaatctggcgaaagttgaagctgagaaatatttagaagctattaaagatataggcgttgacgatttggtatatgaaacctgaggagaaattataatgggaaatattttgattaaaaatattactgctgtaacaatgtcagacagctcaggagtgattgagaacgcttatattgttataaacggaaatctgatagagtatataggaaaagaaaagcctgagacagaagatttcgattatgtgatagacggagagaataaagttgttatgccgggtcttgtaaacacacatactcatttagctatgactttgcttagaagctatgctgatgacatgaatttgcaggattggctgttcaacaagatttttccgtttgaagataagctcacggcagacgatattttaaagggcagtgaaataggcgttgatgaaatgctcgccggaggaaccacttgtttcaacgatatgtatatgtttcaggctgaaacgggcagagttgcgctgaaaaagggaatacgagcagttttgagcgactgcgtgaattttgacggctacgatagaaaagttaaactaatggaagcaatggctgaagagtttaagaatgaggatttaataagcttcactttttcacctcatgctatctatacatgtagttttgacgtgcttaaaaagtgttcggattatgcgaaatctcatgatatgagtattcatactcatttggcggagacccagacggagtttgacgactgtgttaaagagcacggtatgacgccaactgaatatatggaaacaacgggtatttttgacagccctactattgcggctcattgtgtgtgtatgacggataatgatttggaaatattaaaaaaacataatgtaagcgttgtgcataacccaataagcaatttaaagcttgcttcaggagtcgctcctataactaagatgattgatatggggataaatgtggctctggggactgacggagcgtccagcaataatagtttggatatgtttgaagaaatgaaagttgctgctattttgcataagggtatcaccctagacccaactgttatgaatgcctggacagttttgaagatggttacggtaaacggcgctaaggcgctggggtttgataatttgggagttttaaaacaaggatatttggctgatatgattatacttgattttaactctcctcatcttatgccgaataataatactgtttcaaatttagtttacgcagcaaaatcaagtgacgttgagtatactattgtaaatggaaaattagtatataaccgtcaaacaaaagacagataaatattttttataaatcaggaggaattaggtatggcacaagtagcaattgttatgggaagtaattcggatttgccggtagttcagggagcgattgaccagcttaaaagctttggggttgattttgaggctcatgttatttcagcccacagaacacctcagcgtgctgaggaatttgctaaatcagcaaaagaaaacggtgttaaggttataatcgcagctgccggaaaagcggcgcacttgggcggtgtaatcgctgcttatactactttgccggttatagcgcttccaataaagtcttcgtttatggacgggcttgattcacttttatcaatggttcagatgccaacaggtattcctgtagcgactgtaggagtgaatggtgcggataatgcaggtatacttgcagttcagatgctggctgtttcagattcagcgcttgcagaaaagcttgacaagtttaaggcggatatggctaaagcggtagaggagaaggataaaaagcttcaagacgaacttttaaacaaagcataataaattattttacttaaagataaaaatctatttggaggatatgtgatgagcgaagcatataaaaatgcaggggtagatgttgaggcagggtataggtctgttgaacttatcaaagaacatgtaaagagaacaaatattccgggtgtattatccggtataggcggatttggcggtctgtttgagttgggcggcgaatataaaaatccggtattggtatcaggaaccgacggagttggaacaaaactgaaactggcttttattatggataaacatgacactgtaggtcaagattgtgtagctatgtgtgttaatgatattgtctgcggaggagcaaagcctttgtttttcctggattatattgcggtaggaaaaaatattcctgaaaaaatcgccgatattgtaaagggcgtttctgatggttgcgttgccgcaggatgtgcgttggtaggcggtgaaaccgctgaaatgccgggattttatgacccgagtgaatatgatttggccggattttctgttggtatagtcgataaagaaaaaattattgatggagaaaatattaaaccgggcgatgtaatcatcggtattcagtcttccggggttcatagcaacggctattctcttatcagaaaagtatttaatatagatgacagttctgaatgcgccgaggctttaaaagcttatgatgatgagttaggctgctctgtcggtgaagctcttctggctcctacaaaaatttatgttaagccaatgcttgcggctattgacgctgttgatgtcaaagcggtttcacatatcactggcggcggtttttatgagaatatacctagaatgttgaaagacggcactagagcaaaagtatataaggaaaagtttgaagtattgcctatattcaagaaaattcaggagatgggcggaatatcagagcatgatatgtacaatacttataatatgggtattggcatgatgtttgttgtacctgaaagtcaggccgaagaagctgttaatgctgttaatgcagcaggcgaaaaagcttttgtaatcggagaaattactgaaggcgaaaagggtgtagatatatgctgagaataggtgttttggtttcaggaggcggcacaaatctacaggcgattatcgacgcaatatcaaacggtaaaataacaaatgcggaaattgttaccgtggttggttcgagacccggaatatacgcgcttgaaagagcaaaattaaacaatataccttctattgttatttcaagaaaagcatttaattcattgcaggagcatgatactgcgatttgtgaacatatgaagtattgtgatgttgacttgattgtcatggcgggttatttgagcattgtcggtgacaagctcataaacgaatttaataataaaataataaatattcatccgtctcttatcccatcgttctgcggtccgggattttatggccttaaagttcacgaagccgcacttgaacgcggcgttaagataaccggtgctactgttcatatcgtaaatgaagtatgcgacggtggtccgatattgcttcaaaaagctgtagaggttaaacccggcgatactccggaagtgctgcagaagagagtaatggaagaagctgagtgggaaatattacctaaggctatagatttgattgcgaacggaaaaatataaattttggaggctaatctgattatgaaaattattgatttatcccaagaattaaaagaaaatacatatcccggcaggggaattattgtcggtaaatctcaggatggaaagagtgcggtttgcgcttactttataatgggcaggagcgctaacagccgtaatcgtatatttgttgaagatggaaacggaatccgtacaaaagcttttgacgaatcaaaactggaagacccgtcccttataatctatgcccctgtaagggtgctgggcaataagacaattgtcacaaacggcgaccagactgatacaatatatgaacttatgaataaacagatgacctttgaacaggcgcttagaacaagggagtttgaacctgattctccaaactatacccctaggatttcaagtgtaatgaaagtgagcgacggggattataactatgctatatccatattaaaaagtgcagacggcgacccttcttcatgtcagagatacagctttgcttattcaaatcctataaatggaatcggtcattttatccatacgtataaatgtgatggaaacccgcttccaagttttgagggagaacctaaaaaagtggaaatacctaattgcattgatgagttttcaaatatgatttgggagagccttaatgaagataacaaagtttctttatttgttagatatattgatataaaaagcggcaaaaccgagtcgaggataataaataaaaacgtataactgtatacgtgaaagattttagcaaactttgtattcaattttaggaggaagataaagtatgaaagaaatggaactaaagtatgggtgtaatcctaatcaaaagccttcgcgcgtatatatggaagacggcagtgagcttccgattacagttctgtgcggaaagccgggctatataaatcttttggacgctctaaacggatggcagcttgtaaaggaacttaaaaaggctacagggcttccggcggctacatcgtttaagcatgtgtcaccggcaggagccgcagttgggcttgagctttccgatacgcttaaaaagatttattttgttgatgatactattcaaatgactcctttggctaatgcttatgcgagggcgagaggtgcggacagaatgtcttcgtttggagattttattgcgctttctgatatttgtgataaggctaccgctcaattgatcgcaaaagaagtgtcggacggtgtaatcgctcccggatatgatgacgacgctttggaaattttgaaaggcaagaaaaaaggaaattataatataattcaaatagataaagattatattccatgcccgatcgaaaagaaacaggtttatggagttacttttgagcaaggcagaaacgagcttgacattaataaggaacttttgtcaaacgttgtcacagagaataaaaatatttcagaatcacagcttcgtgatttgatgatttcacttattactttaaaatatacacaatctaacagcgtatgttatgttaaagacggacaggcaatcggtataggcgcaggtcagcagtctagagttcactgcacaaggcttgccggaaacaaagccgacgtatggtggctgagacaggctcctcaggttttaaatttagagtttgttgacggtctgaaaagggctgatagagataatgcgattgacgtttatatttctgacgagtatatggatgttttatctgacggcgtatgggaaacccgatttaaaacaaaacctccggtatttacaaaagaagaaaagacagaatggctgaaaaagaatacagacgtttcactcggaagcgatgcgtttttcccatttggagataatatagaaagagcgcataaatcaggtgttacggctattgcacagccgggtggttctatcagagatgacaatgttatagaaacctgtaataaatatggtatggctatggcgtttacaggtatacgcttgttccaccattaatattaataaataattagttgtttagaaattgttaaaagcatttgtacaatgtattgagtgttaaaggttgtacgaaaaatatttattatctttcgaaaaaattggagcattacttatattaatgttttgtttagaagtttgttgtatataattgtttttaacagtgtattaaaaaattttgtatttagtgatttacggcatagtcaaaagcggctatgccttttattttttataaattataattaaagagtgaggtataatgatttttgaaacagaacgtttaaaacttagagaactaaatatggacgattttaaagatttggctgaaatattacaggataaaaatgttgtatatgcgtatgagcatgacttttctgacagggatgtgcatgaatggatggagcgtcagtttaacagatatttaaagtatggttttggattgtgggcagttgagttaaagggaagcggtgagatgataggacaagccggtttgaccattcagccatataatgattctgaggtgttggaaattggttacttattaaagaaaaagttttggcataaggggtatgcgacagaatcggcaatgggatgtaaagaatatgcttttgaagttttgaaagcggataaagtatattctattataaaatctgataactatccttcaatacgagttgctatgtctattgggatgagtaaagaaagtgaattttatactcagtattatggtacaaaaagtttacactatttattttatgtaagtaaaaaataaaatacatattatactgagtttatatagtaaaaatccatctgaaattatttaaataatttggtgaaaaaagccttttaattggataagtgttatgttataatattgggcaagctattaaaatgaggtgtattatgctagatataaagaaagttcaaatgtatacagacggagcatgcagcggaaacccggggccgggcggttatggaacaattctaaggtatggggaatttgagaaaaaattgtccggcggcgaggctcagaccactaataaccgtatggagcttatggctgttattgtcggtcttaaagctcttaatcaaaaatgctgtgttgatatatacagtgattccaaatattttattgacgcaattgataaaggctgggcaaaaaagtggaaaagcaacggatggatgcggaataaaaaagaaaaagctttaaatccggacctttgggaagaggttttaagtcttcttgaaaagcatgacgttactcttcattgggtcaagggtcacaacggacacccggaaaacgaggagtgcgaccgaatggcagttgaacaatctaaaaaatttagctgatacaattattttaaaagcaaataaattacggtaaatctacttttcatagattgagcgtataaaaagaaaggtaggaaagagtatgagaatttatgtggacaatgcggctactactaaaatgaatgccgcagtcgcagaggaaatgattccgtttatgacggaattttacggaaacccatccagtatttatttggagggcagggaggcaaaaagggctgttgaaaagtcgagagaacaagttgcaaaggctatttcagcggaacccaaagaaatatatttcacgggaagcggtacagaagcagataattgggctgttcgcagtgccgcgtcagcttattctaataaaggaaaacatattataacaagcagtgtggaacatcatgcggttctccatacttgtcaggacctggagaaacaaggatatgaagtgacctatttgccggttgataaatatggcagagtttctgtggaggatttaagaaattcaattagacctgatacgatactggtttcaatcatgtttgccaataacgagattgggactataatgcctgtaaaagaaataggcgctgtgtgccgtgaaaacggggtattgtttcatactgacgcggttcaggcaataggaatgtgtgaaattgatgtagaagaattaaatatagatatgctttctttgacggcgcataagtttcatgggccaaagggagcaggggctttatatgtgaggcaaggagttaaactgacgccttttattaccggaggagcacaggaacgcggcaaacgcgctgcaactgaaaatgttcccggaattgtagggctgggcaaagcgatagagctggctgcagagaatattcctgagagacagaaaaaattatcggaactcagagattattatatagaaaaggttttgaataaaataccatattcaagacttaacggtcatccaaaggacagacttccgggaaatgcaaacatcagttttcagtttattgaaggtgaaggaatgctgcttcgtcttgacatgaaagggatatcggcgtcaagcggaagcgcttgcacttctggttctttagacccgtctcatgtgcttttggctatcgggttaaaacatgaagaagctcatggttcgctcagagtttcttttgatgaaacaaacacgaaagaacaggtagattatattgttgatgaattggctgatataatagaacttctcagaaatatgtcgcctttgtatgaagattttatcaaaaataattagtcaaaggaggaaaatatatgtatagtgaaaaagttatggatcatttttcaaatcccagaaatgtgggcgagatatctgacgccaatgctgttggacaagttggaaacccaaaatgcggggatataatgaaaatatatatgaaaataaatgatgacacaaaagtgatagaggatgtaaaatttaagacattcggatgcggagcggcaatagccacttcaagcatggccactgaacttgttaaaggtaaaactattgatgaagcattggagttaactaatcaggcggttgcagacgctttagacggtttgcctcctataaaaatgcactgttctaatcttgcagaggaagcagttcatgctgctcttgcggactattatgaaagacatggaatggatacatctgaaataccgcagtgcacaggctgttgttcttcgtgcagtattgagcatgaaggcggcgaggattaagctatgtcagaaaagattgtgataggaatgtcaggcggcgttgacagcagtgtagccgcggcgcttctaaaagagcagggatatgaggttataggcttaaccatgcgcctgtgggacggagaaacagtaggtgatgtctttagagacggaacctgctgttctttgtcagcggtggaggacgctagacgagttgcatacaaattaggaatagaatatcatgttttagactttcgaaaagagtttgagaaatatgttattgactattttgtgaatgaatatcaaaatgccaggacgccaaatccttgtatagcatgcaataaatttctgaaatttgacgctatgttaaaaaaagccaaattgcttggtgcagagctgattgccacaggccactatgcaaaagtctcctatgattcttcatacggcagatatcttttgcgccattcaatggcttccgaaaaggatcagacatacgctttatattctttaaatcaggaacagttaaagtctataagaatgccgctgggagaaattgacggtaaggcccgggttcgcaaaatagcagaaaggttggatttgccgactgcttcaaaacctgacagtcaggaaatttgctttgtgcctgataatgattatgtgtcttttatagagcgcaggactgatagaaagcctgaacccggaaactttattgacgagtatggtaatgtgctcggcatacacagcggtataacccactatactataggtcagcgaaaaggacttggaatagcttttggaaagccaatgtttgtgacgaaaatcaatcctcttactaatgaaattacattgggcgaaaaaggcagtgagttttctgaaagtttgattgctgacaatttaaatttcatttcatttgaaagttttaatgagccttttgaagccttggctaaaatcagatacagtgctgttccgtcttcctgcatagtttatccttatgagaatgatatggcaagggttgtttttgataaaccgcagagagcggtaacgccgggtcaggctgttgtattttatgagaaagacagtgatatagtaattggcggcggtacaataaaagaggggtgattaaaatagattttcttagtttgagacgaagtataattgataaagagtataagaacctgaatgaaagacaaaaagaagctgtgtttacgactgagggtcctatattagtgcttgccggggcaggaagcggaaagaccactgttataatacataagattgctcatctgattaaatatggaaaagcatatatgagccagcatatcccggataatataactgagcaggaaattgaatttttggaatggtatttaaacggtgaactggacgagctcactcctgagatagagaattatctgtcagaggagccggttaagccttacaatattttggcaataacatttactaataaagctgctggagaacttaaagcaaggttggaaaaaagccttggagcggttggaaatgacgtttttgcaagcacgtttcattctatgtgcgttaggtttttgagacgtgatattgataagataggatacgaaaaggcgtttacaatatatgacagcgccgaccagcagacagttgttaaagagtgcttaaaagagcttgaaattgatgataaaaagtacccgccgagaaaagttttaagcttaatcagcggagctaaggataagctgatagacgctgatgaatatatggacggctgtcaaagcgactattatttaaaaaaggttgctgatatatacaagctgtatcagagaaagctcaagagcaacaacgctttggattttgatgatttgatagtgctgacagtaagactgtttgaagagtgtcctgaagtgcttcagtattatcagaataagtttaaatatattttggtggatgagtatcaggatactaaccatgctcagtatagactggtaagccttcttgcaaataatcataaaaatttgtgtgttgtgggagacgatgaccagagtatatataagttcagaggagccgatatacaaaatattttgggatttgagcaggaattttctaactgcaaagtgataaagcttgaggaaaattatcgttctacacagcatattttagacgctgcaaacagtgttataaaacataacgatggaagaaaaggcaaagagctttggacttcaaacggcgaaggtgaaaaaatcagcttatacattgctgacaatgaacatagcgaggcgcagtctatagtagaaaatatattaaatttaaatgcaaatttgaatgatacggttatattatacagacttaatgcgcagtcccgtattatagaggatacactattgagaaatgctattccctataaagttctagggggcttgaggttctatgatcgtaaggaaatcaaggacataagctcatatttgaggctgattgtaaataccaatgatgatattgccttaagaagggtaataaatgagccgaagagagggattggaaataccactttggaaagagtgcattcagtatcggtgcagaacgctttaagcatgtttgaagtttgtgagagagctgacgagtttgacgaattcaattcatcagcgtctgccaaacttaaaaagttttcagaacttataaataattttaagcgtgacctagatgatggcatggggcttgagctttttgttaaacttgttatgaaaggttcgggtatggttgaggcgttaagcactgaaaagacagttgaaaaccaaactagacttgaaaacttggacgagtttatttcaatggttcaggaagcggtccgtgaagatgaaacaataactttagaccagcttttagaaaatatctcactggtttcggatatagataactatgatgaggcacaggaatgtgtgacgctgatgacgcttcacagcgcaaaaggactggagtttccgaacgtgtttttaataggcatggaggagagtgtttttccgagcgcgaggtcgtttggagttctggaggaattagaggaagaacggcgtctatgctacgttgggataactagagcaaaaaagagactgtttttatcagctgcaagacaaagaactttatttggacaaacaaagtataatatgccgtcgagattccttgaagaaatccctgaagagcttgttgataagaaaatagatactccgtcatactctgcaggcagtacagagtcttcgtacaaatatgctggtgagactaaaaatacatacggcggttttggagacagcggtttcttaaagaaggcgccggagaaaacattgcaggatgaaacttcatatattgttggggataaggttaaacacagaaagttcggtattggtatagttgtatcagctcagcagatgggaaaagactgtttggtagtcgtagattttgaaagcgtcggtcagaagaagatgatggccgcttatgcaaactttgagagagtggaatagtatatgtacaatgatttttcgctgatttatgataggtttcaggagatagattatagggaatttataaatttttatatagaggtatttaaccgaaataattatgagccgcattcgattatcgatctaggatgcggctcaggagaaataacggttttgctcggcaaaaaaggctatagtgtaacaggtattgacatatcaagcgatatgctttctatagctcaaaataaggcctttgacaacggcgttgatataacgtttttaaatcaggatatgactgaatttagtgttttagataaagcggacgcagttatatcttcgcttgattgtattaattatttgccgtgtctgaatgatgtgaaagaaacttttagctgtgtttatgagagcctcaaaccaaatggaatatttatttttgacatcaactcagaatataaattaagcaatatattaggcaataatacttttgtatatcaagatgatgaagcatattgtgtttgggaatgcggttattttcctgaagacaaagttacgagttttgagctgaacttttttgtgaaagacaattcaggaaaatacgacagatactttgaatatcaggaagaaaaattgtattctttacgagagcttcaaagtatagcagaagaggcaggattcaaaaaaacagaagttttttctgacttaaattttgaaaaacctaaacaaaacagtgaaagaatcttttttgttctgcggaaatagatagtggctataataaatttagatatggagtaacttttatattataaaagttcagactgttgataaagtatgaaggtgtttgataacattggacaatgctttaaatccactcgttcgaagagtaaacaatcatctttacgtctcaagtagagcatatagtgttttataatcacattctttacttcagttatttttcaggcagcttcctcatctgagtcagctgcctttgtttgtatacttttctcaaaatcactttttctatatgctgacattctaaactatattaatttgaaatgtgtgagggaatattagagcattaggattttttcttatcttctaggttggataatcttagttttatatattagaatttaaaatatagtttttataatatgacgcgcggttgtcatatttaatatgataatatataaaaaaggatggtgtttatagtggcttttgattttaaaaaagaatataaagaattttatatgccgaaagataagcctgaaattgtgacagttccgtctgctaattatatagctgtccgcggaaagggcaatcccaacgatgaaggaggagaatataagaaggctgttggtattctgtacgctgtggcttatacaataaagatgagttataagggaacttataaaatcgacggtttttttgaatatgttgtacctccgcttgaaggtttttggtggcaggaaaatgttgaaggcattgattattcggataagagcagttttaactggattagtgtaatcagattgccggattttgtaaagaaggaggattttgattgggctgttcaggaagcgtcgcgaaaaaagaagcttgactgctcggctgcagaatatttgactataaatgagggcttatgcgtccaaattatgcacattggcgaatatgacaatgaacctgcttccgttgctgtaatggatgaatatatttctgcgaaaggttatgaaaataatttcaatgacagccgtcttcaccatgaaatatatctttctgacccaaggaaaaccgagccggcaagatggaaaacggtgattagacatccaataaagattaaatgaatttaagatactgaaataagatatttagtttataaacaagtaatgtggtttatgcaaaagacagtaacaggttaatttaagatatttcatatttgattgataagttttttaatattagcgtgttttgataacaaatttaatactactgaaaaaggcatatattcgctttagaatatatgctttttctgaaataatgtaagaaaaataaattgaatttatatgaatttataacctataatttacttatttaccgtcggcttttaaggttccacaccatataattaattcttaaatatttttaaatatgtataatctgttatataggaaatgtggactattactccgcttctttattagcggttttaatgttcttaatcgcatacataagtcttacatattgggttatttgaataactttactgcataggaaatgctgaattggatactatttatgtgtcttgaatcattcgttttatcttttacgtctactgttatatttttgtgtaatatctcagtgtatattctttattttccacgactttaatatatttatgtcagatacgattattagattcttcaacttttacaattgtttgtatgtaaatatttgctgagataattctgtaatttattttccataattatttattgaaattatttctttacaaataatttcaagagtattttttatctaaatattcttgtacctaaaagatttaataagaattataatgctgttcctttcttaggcacaaaaaagtttgatatatctgccttttcaagagaaagcagttttatctttttatcaataccgcctgcatatcctgtcaggcttccgtttgagccaactactctgtgacatggcacaataatagaaatcggattatgacctaccgctccgccgaccgcttgggcagacattttagaaagacctttttgtttggctattatatcagagatttctccataagtcatagtgtgtccgtaaggaatagtttttaaaatttcccaaaccattttccgaaatggcgttgttttaaataataacggaggtgtaaaatccggttttttgccttgaaaataattatcaagccatctctttgtttcattgaaaactgataagtctttttcttcatatttttcaggtaaagtatctccgaaattcttttgtccataaaaccataacccggttaaggcttcaccgttgctcgccagcataattccgcccagcggtgactgatatttaaaggtatatgtcattttattaaacctccgataaaatattaaatcagcagatactttattatttgcaaatgtgtatgtatcaaatattaaataaattttgatatggtacttgattttataaaaatattttgtacccaacaaaatttaatttaaacgtgtttagcatattatattatgtaagaattatttatatataattatgtatacaatgttagtgatttgtcaaatttgattttatagactaaatttgattatactaattgtaatgtcaatatttttttatgtaatcgaacttaatttataaactgctcattattttcagtcgacaaattgatagaaaccaatccgtgtggcagcatagtatcacaatctataaaaactgcactgtttatttcttcatcttcatttaaatagatagaatttataagtcctttatatccgcctaaaaatagtaaatttttacttttatctaattcatttttaattaaaatacttagattatcttttacttttttaatatcattgaccctatctattttttcttttttattatttataattctatttaagtaattaatcattctttctattttttcttttgttacgaaattggcattttctaataaatattcgactgtttccatgctatctgtatatagcttgccggttaatgttcctttatcttgatttcctttgaccatttcaacgcctacgttatcaaagaatggtttcaaaaccgtttttttattggggtcatttatatattgtattttatataaattacgcaatactatcatatcattgttgattttaatatcgtcaaccattaattttatatctttatttgttctctttgcatttggatttgttagtgcgcctttaactgatgtgccaggtatatagtactctgctttttcaggagaatatgaatcatatattccatatcgataaaatggatatattatttttaatttatcataattcaaacatttattattaatatctttaatacatttttcttctatactattatctaagtctctatagaacgctctatcactgcgcggagaaattataaggcttgattttatagtgattttatactcaacttcaatcatttttaacacctccaacttcaggcataggatataaaaacgcattaccaaaaacaatgcttttgctgtcaaatggagattctatagatttaacagcgtcacgacagttatttggaattgaaattacgctgccctctttaataaagcttatgtatcgtctctcaaaatcgctgttccagccgcctgatatttcatacggtcttcgctcagaagtaaataattgtaatgttgatttaacaaaattaatattgtcaggcagcagcatacctgtatttaaaaacatattttctgaattattgattatattgtaatctataattttattaagctgaaaaatatttaatccttgtgatgctcttttacctaatataatattttgttttaaatttacggcattgataatcattttaaaaaattcactgcactcaacactatcatctatttgaagaaaaaagttaaattcagtaataacactgcctggagaattcactgtatcaatttttaccggtgtaatataaggtacagaatataggttgctgtccagggcggctgtgtccaatttaacgctttctatagaggcgcgcagctgttgtctttcaactattttaacatatggataaagttctttattgcataatggattttttaaaattttattgagattatctttctgtaaataatgtcttttctttatatcttttcttactttttttatatccagtttttcattattatcagtattatgtaatttatctacaagatagtctactggggtgggcaggtaatcattaggcagaagattagacagcgccaaaaatatttttttgtctaaaatatctttaacaaatttgttcgctttctctgtaccatattcatctgaaaacatgtaaaccaatgctccgaatatcttttgagaatcgggcatctgagttatcccaccgatagatgtaagtaaaatcttatatgttttcaaagttaagacacctcacaatcatctatagtaacctcaatacgtccatagccgcggcttttggagttccccagacggtatactccgttattaaactgtattaattttttaatgatataattccggcatatattcacagcattttcacccaaaaggtcaaatttataaaagagtatttctccttcaaaaacaagaccgcttcttgccgctttatatgttctgggattagacaatatagtatcgccgctgctttctattgatgtttttgtgtcaatagaaaaacattcagatatattttcaggtacatccttaagatgtaaatcatttattattaacttaggcgaattgttaaatccttctattccaaacagaaattccgccttagcgtcaatattgtaacgttcttcaattctgcgtatcgtttccgcatcataattatttttagaatttttccagttattattcatttcattttctatatatgtttcatataattttgctatctttatggcgtcttgtgttttatcatcatgaaccattccccgaagagtgccttttagacttgaagccggaatatatggcaaaccttcatatgtagtggctgtatattggtcaaccccgccgatttcgaaaggaggaggtgcgcttcctatcattaagtttgattttgtttttattaaaatttttattttttctttcatttttcttcctccttgaatataccattgagttttatattcatttcattatactggtacagcagcattaatgaatcaataaaagttgaattccagctgtttttggctgcttttttaaatttatcttcatcaaaacacatatgactagatgtattttttttattttctttagtaacatttgaatctttattttgacacacctgattttttaacttaatcaattcagcagctttttcaatagaaactttatctgtatctctcaatttaaagaacatagatttttctatatttaaacgtttaaaatatatatcacttgaattattgttttttgggtcatctttattgataaatatattgagtagattactatcatagttatacagcttttcgtataaataatttatagtttctttcaataaaaatttatgagcattttctatttgacttttttcagaatcttcagatgaatgttctatactatttaaattataacgggggtctgttagcaaaattaaaagttgaatataagtttccaaacgatgttttgagttgtcatttaatactattgtatctttatatatctttttatttgcctttttatatttctttttaattttctttttgtcttcatctttatttaatacaacatatagctgctttatgattctgcttttaaataataattctttatttcttatatttgaattgtcaaggtgttttaatcttaggctgtacagcaaaatgttaatatattctaattctttctcaagtgaaattttatcattgttttcactaacatctttatcacaaattttaatacttgagagtttttccagcagtgagtataaaaaacttgtactgcaaatctgctccctcatctccttatcggaattaagtgactgaaaatcttttatatcatttttaaaggatctccaaattggattactgtttaaatccttgttgatagcttcaattttattattaatttcatcatagtccacatcaaagaaagtttggttgttaatagcaattgttgtttgtaaaaattcttgtaatgtttcggggcacacagcatttttagctttatccaattgatcatttaccgcttcaagataatatcgtataggttccctgttaaacgtaatggatacgccaatacccattgatagctttttaatatcacttttattttttatctttgttttattatcttcattttttttaataagagcattattaatggtaataaccatttgtctgcatacgtctattcccttaaaaaggtttgttactgaaacagcgaaaaagatatcgtcacctgccacataaaatggatatatccaagcggcatcattatcctgacatgtattttttgctgcgtcgagaagtccaactaaagaaatattttcttttaaaatatcactaactcttttatattcttcataatcgtttatgcttgcaaacatatttcccatcccatttaaatctgcttttatgacagcaatagggaagtggttagcttcgtatggattttttgtattattttcttcataaggataaagttcattaataccttgaacaaataattcatatttatcttttgaatcagatgaattatctgtttttttggccttttgaaaagaaaataatatatctttattactttcaattattttacttgtacattcggagattttaagttttgatttagccttttgaacatttaatatattatttttattttcatcattataatgattctctgctataaaatatgtatattttaaaaacttttgaccttgagactcactataatagttttgaaatagttgatttagatgtttaataatttcatcttcagtgataccgctgcatttaaaaataactacgccggaacattttaataatatctctttagagatttttttaaaggctttatcaacatcttcaaagaacccattagatatttttttggatgcactttttatttgtcttaatgtaccggtttctttttgcttttcttgttcatgcgaatgaatgacctcgaaaagcaaagtctgcactttatctattgagagcgctataatatactcattaaatttattaaacattttagcatatgctatatgcggaaatagtataggattatttatcatcataagaatctgatttaactgaagattaaatgttagcaaagaaactaatttagtttgttttttaattttatctttataaccgactttataatcttctaattcaacatctttaattttatcaatgttatatgtttttttatcaatttctgctagtcctttagaatgatttaatgattcataccaagaatataaattgcctttactttcatctatctctatatttaaacattcttttttttcattagccctgataacaatatcaaatttatttttacaatattctttataatcatcatttaaacagcacaaaatccgtattggtctggtagatgtttgtgttcgtggtttagtgggattatgctcagagcctatattaactccgttaaacattctaacataagatctctgagaggtttcaagagatttaatactttctacccaattttcaagattctctttagttaatgatgaacttttgcattcgattacaactgctaccgcttcaatcggtataaattttaatttgtcatatttaaaaatatatggtgtatatgtctcatcaaagatagctaaatcaacctcttttgatatatttcctcctgaatctattataaacacagattgttcgataacgaactttttaggtattatttgttcaaacatccctttccaaatctcttctctaaaattgccaatggttgtgccgtgaggagttttaaaaaatagttgattgaccaaagtcttttcgctttgaatataattttcaataatagcttttatagctttgtttttaatttctttatcttcacttttttctttactttctgtaggaatttcgctcatactaaaacactccttttatattttaaataaactcaacatctatgcgccccatgccaaatgtggtgtttccgccaatatgtaatatttgcgcggcatacagccagggaacaaataaagataaatctccatgaaaagacatacttcccattaatcctccaaaatccattttttcatttgttctgtttgaatatcgctccatattaaccaattctatatctttttttgttgtgataatctttgacgacaatttctgaatatgctctatcttttctgtatcaacccatccgccgtaacgtccggtaagagatttaatcctatatgttatatttctaataatcgaggaaaagtcaacgtctttaagcaattcattgttacgccgcattcgcagaggagttagaaacttaattgtcacactttctacattatccaatgttttatagactaaaggtatttttcgcattgccgcttgataaaatgttctattctgccaaatgactctttggtctgttttatgaacagccttatcaaatatgaatttatttctccgcactccgagacgcagaccgccttgactgtttaatgcgtcaataacatttttagcatatttggcgccgtcacctaaaaacattatatcaaaattaagaatatcatttttatagaataattttttaccaatcatcggtggaacaataatataaggatttaaaacttcttttcttttcttatccaaacgacggttgtcatataaataatgacaagcttcagtgtcgtttctaagaacgtgtccaattgcaccgcgaagcgtggagccgaggtatggcggcaatattgatttatcttgagctataattgagaagttgataggtaaatattctaaataaaattctgtattttcgatcataacacattgcttacctttcctttatagaaaatagacaaaaaatgttttattttgtattattttatcatatatttaaaagtaatacaagtgtaaataatatatttttgaaaattattatatttgcacataaaaaataataaataaaataataactgataaaaatattttattatttatgtattaaactttgattaataggaaaaatataagagaaatttaattatgtatgaatacaatataggcatctgtaacttttttattaaattgttaagactaaaaatgtataaattttttaattatagagttaagtttaaagctctttatagcaatcaactgaataaaaattaaatatatacatttttaaaatttaaaattaaaaaatatgtcgaaaaagataacataaaaaatttaaaaaattttaaaaaatgtaggtttgtcaatgatgtgttacaaaaaagattaaaagagttcaccgaaattgataaaagagttgatgtagtcaattggagctttccaattacgaatggcagcctttgtcacgccgtgtttaaaagaatattcaattaatacttgcctaaatctcatagtttgtgttatagtgttcatatacggaaggctcctttgtgtatgtgatattatggtgatataactataacacaatttatgagttttccgtattctttttttctatatcctcataggacaaaactccatcttgataagcatgaattgcgctattaatatttattctttcctgtccaacaacttgaccttgatttgaacagtaatcctgtataggatcttgatcctcaacatttaccagcccgcttggatcaacaaagtttacgggattattaccacagtacgcataccagttcagtccgtccattaccgggtcttcctgtgtgaatcttccattcgcattatacatatatcctgcgcttactgttccgtaatctacttctgtaagtctgtccaatatgtcatatgtatatgaccctgtcagtattgtatttgttcctgctttttgtgtataatttttcctgtttccgtttacgtcatatgtaggtttattaatacaaagtgatttgtatcacacacactttaaaaaagtgtggtcacagccctccgaagcttgctaaatcacattttttataataaatttttagaaattaatatcttcaaaacagtattttttggttaacatcggtagggtgtgcgtaagcacaccgcgttaggtgagcaaccatctcacacgaagcgtggaacatcggaaggtgagcggagcgaacacgtgaggtgaatccacatcgcacgcttgcgtgcacaacccaaaaacaaatttataaaacataaaaacccaaataaaaaataaaaatcaatgaacaacggtaggtgagcgaagcgaacgcgtgaggtgaatccaccccgcacgcttgcgtgcacaacccaaaaacaaatttataaaacataaaaactcaaataaaaaataaaaatcaatgaacaacggtaggtgagcgaagcgaacatcggaaggtgagcggagcgaacacgtgaggtgaatccacatcgcacgcttgcgtgcacaacccaaaaacaaatttataaaacataaaaacacaaataaaaaataaaaatcaatgaacaacggtaggtgagcgaagcgaacgcgtgaggtgaatccacatcgcacgcttgcgtgcacaacccaaaaattataaaaaatgtgatttagcaagcttcggagggctgtgaccacacttttttaaagtgtgtgtgatacaaatcactttgtattaataaacctacaatgtcaaacaaacttaaccgcatataaatccggcagccatgttgaactgtttgtaaatgttaaagatccttctgtcaaatcctgcggcagtgtaaatgttattgcgctcagccatagttccctggcgcttccgtcctccgttattacaacaggagtctgagttcttgtctctgacaccactgttcccgaaccgcttgctagattcattgttattcccctgttgttgcttcccaggtaatacattgtatatgttccggctgacaagtttactccgctcacatacgggtccccttttgtgctgcttgaacccgagtttccaataaagtccttataaaccttaacgtactcattatcaattgttgtcccgtcagaactgaacaacgtttgtatgcctgtgcctgcataagaggatttcagcgtaaacgttccgctctgctcgttttgtcttccattgacaaagtcctctgcaatatatgtcacctcaccggttacaggagccggttccggcgttgggattaccgcctgtttaacgaatgctgtatacataaccactcctgacggcggtccgtttgttcccagagttaccttatcgccttggttaaagtttttctgatatattttataggtcacatcatttgacgcctgcagtatatagtcgttagctgtccatccactcagccatgacggcagattcgacactcgggtatccaaccctacatacactgtgattgcacttccagcagtgaactcggctacatcagactgaagattctttgaatcgcacgctattcttatccattcagcgcctttgagataattagatacattggtaaaagtattggctctgtcgccgtagattacatcgcctgtctgcagattgtactggattgaccagtccgcagcgttggcagcgtcttttattgtcaatgacttaatcaaatttccattaagaattggcgccgcagttggctttggcgttgccgtcggcgtcagttcgggcgacaatgtaacggttcctttcgggaacgaatcaattgttaaatcatggctgtaatactcaatattgttatatcctttcccctgataatcacctgttgcatcgctggcgctgttaggattaagaccgcgggcaatctcccagctgtcgggcataccgtcgttatcagaatcaacgatctgttttgatgacgacgatggataataagaattataatccatatgtttaatgccatatttagttatagcgtccaaaacagcactgtctgtcactgttgaaaaatcacgtccgcctgtaagtgatccggtgcctgttcttgtctcttcaataacctgcttgtcaatcttaggacgtgacgccgcatttattcccgaacctgcataagcaagcacatttgaataagccgcgtcagcgctttcgggattttgggcaactgatacgttaaccccatttacattaatcggataatgggaattagaacgatagtatgcttcgtcatatccggcgcttccaaaattgaatccgctccagttattgtttgtttgtttactcataactgaattatccggattaaccattttattgcctgttaagtaaaacttataattctcaggcgcggtcccgcttgaaatgttaataaagttatacccgccctttgtggatgggccggcttttaagtaattgtttacatagttctcatgtccgaatgttccatacgcggtctgactgccccagtcatagattacgttattaacaaaatccattgcataagttccgacaaccttgcctctgaagtttcttgacaagctatgacaaatcaagttatgatgccaggaattttcaccctttccaaacataaccccaaatccatgagcgcccttggaatgatatgatacacagtcagaaggcccgataatggtatactgaaccgtttggttcatattattggaatacaatccaaactgctcgtcatttgcccagcctatcgaacagtggtcaataatagaattagagccatttgaaccgccccaggcatcataatcaccgctgcctttttcaccaggtctagatgaaatatagcgaacgataatattatctccgcccataccaatcttgccgtttttcagggttatgcctgctcctccgggagcagtttgtcccaaaatagtgacgttgccttttacaacaacatcgctcttaagcgttattgttccgccaacgtcaaatacaacgattctgtttgatgtaccgacagcatccctaaaagagcctgagccgctgtcatttaaatttgttacatgaaccacctgtccgccacgaccgccggttgcatacataccgcctccctctgcaccagggaaagccggaagagtattagccgcgctaacctcgcttgtatcaaatactgttattaaagagactaacataaacgccgatattaccatacacacaatcttttttaacattattgttttctcctttaactttatattttatttaataccacaaacacaacttataccacaaatacaataatactattttgtactcctcctttactattatattttttctgccctcctttctaattaataattttttattttgtttctttttctttgttaaaaattaaagatgtgcattcaaaataaacgcacagcccgactatgaataaattaggtaagaaacaaatttttgtttcaagttatcaataaaaaatttaaacagctatataataggaaaataaaataaaattatagagtactgactaaaatttttaatgcagccctagggggatagatatctatccccctaattgtttccgtttaacgattatatagactgtaaaaaactttttaacgtcttttatactatcttaaccgcatacaaatccggcagccatgttgatagatttgtaaatgttaatgtaccgtttgccaggtcctgcggcagcgtaaatgttatcttgctcagctgcagctccttctctgctcctgccggagtcaatgttacagggctttctattctctccgctgttgccaccactcctgaaccgtctgacaggctcattgttattcctctgttatacgccccaataaaatatactgtatgggttccggctgacaagtttattccgttcacatatgggtctcccaaagtatttgaagcatttggatttcctataaaattcttatatccttttacatattcattatcaatcgtcgttccatttgagcagaacatatactgaacctctgttccgataaaatcatcacttattgcaaacgttcccgcctgctcattctgtctgcctttcgaaaaggaaatgtgacatatgcggaatatgacaatttgggcagacagatatccacaaggaatcctgacggaacaacagtaacggttgaatatccgaaagcttcatcatccggacagatattggagaattccgtaataacaaaggacggaagaggaaacaaaacaaagtatatatatgacggtttgggaaagataacaactgtgttcaattgtgaaacaaaccaaacacagacggcctatgagtatgatacggtaggaagaataagcaaaataatagacggaaacggaaacagctataactatcagtatgacaagaagagccgcaagacgaaaatggaagtaaaagacgcagcgggaagcttggcatatgaagagagctatgtatatgatgatgtagacggagacctgtccaaggcggaaacgataaaaggaagcggagccgggaagacagtaagcgcagcatacacagacaagtatggaaacactgtcaaagaaacaacaggagagggaacggacataagcgagacagaatatacatacgactatatgggaaacaagctgaacaccaaaacaccgaaagccaaaagcgaaggaaaaggttatacatacagaacagagtacggaaccaaagacggcggttcttgtttcataagacttttcagctctaaaagcgtcttctattgtcattgcaaacgcttctccatattgtttttctatataactttttatttttagttttgtcgcttctacacttaattgtttttaatatacttacttacgaataaaaaactgaaacggagttatatgtatttcttaactatttaaaaaggaagtatttaatggatttttattttaaatagttaattatttttatatagcctctttgacgaagcttaacccaaaacacaacaagtccagcattgggattacggcggcgcatatcagtaatcaatttcaactcatcagcggtatgctgattgggatgatggtgtgtatgtgatattatggtgatataactataacacaatttatgagttttccgtattctttttttctatttgtaacacatctattgtaatcctacaacataaattcacattttttaaaaactatcttgacaaactaagagaaagatactattataaaaataatttaaagtaggctctcttcgactgacttagagacagctccgcaagcaagcttgctgattaaagataaaaggtaaccgttaaacggttgtcacaaaattcgacattataataatatagtcgtcctttgcacgaggacggctatattgcttttatgacaatatctggacaatatactgccgtatcatgaattaatatccgttctgcattctctctatcaatatccgctctatctcagcataatcactcttattgccatcgctgtaattattaaggccgggcgatttaactactcctctgtcagctttctgcccctcgtattccgcccatttctttatcgccagtaaataatttttatacttgtatcccttaagctcaattccctctgacaaagtttctatacggtcagaccaatcgtttggatagaattgtttaagctctgaaaattcctcatcagataaaaaaacatttttgtattttccataaacatttttatctgaattatcttttcttttattattttcttttaaaatagttttgtcttgttttgttttgtcttgtttatataatggtctactcctctgattactaccttgattactttcttgcctgctatctgcaataccgcttggacacttttcagcaatgttattacttattgatttaaaatcttcgcagaatgaattaatcgtatatcttgcggccttccctttaaaagccttaaaatctataagccccaattgtttaagaacctcacggtttttgtatatccctgattttgacaacccggtgtggagctctaaagtgataaccggaaccgtaaaccattttttccagccgcttttattgtctatatgcatgagagcgtaccaaagcgcaatctgtcccgaggaaagccgctctctcagcagcaaatcattaaacccttttatttcggttatataattcatatgtatagctccttttcattttgttaagagccattatacaactaaatttgtgccataacgtgccgtcatgattccgtatgagaactgagaattttagacgcaaaaaaagccggaatattccggctttcgctgattggtggagatgaggagaatcgaactcctgaccccctgcttgcaaggcaggtgctctcccagctgagctacacccccatatttcagcaacgacagatattataacacaaaattttcaacttgtaaagaccttttttaaacttttttatattacgtagctgctggtatctaacagtctttgctcatcgactaaatcctgaagcgttgtgttgtcgacaacactttttatagcgtcatcaagttttttccaaaccataagggttgcgcacgcgctttgcctctgacatgtattaatatcaccgtctaagcaggacacaggagccaggctgccctcggtgagacgcaggatttccccgactgtatactccggcggacggcgggttagtctgtatccgccgtttgacccacgctcagatttaacgaatccggcacggttcaaaattgtcattatttgctcaaggtatttgcgtgaaatatcttgacgctcagctatttcttttgtagaactcagtccgttttcgccgtttatcgccaaatctatcattagtctcaaagcatatctgccctttgtagatattttcataacccagcactcccaagaatattattatattcttatattatatacgtttaccgggaaaaatcaagtctgtctactcatgattttcagacataagttttttaaaataatttatagcttcacatatcccttttatatttcctttatcattgagcttctcaaaattgaatctgcatatatcgcaaatcttaatattcctgccattatatttagtttctgtcagctgttcagcttctcttccgcataaaatacatttcttcataactttcacctggctttgtcaaactaacttttatttaattttgtccactattacaataccatagtatttttaattagtcaagcgacaattatattatagtattataataattgacagggcggtgaatttatgttgagcgaaaaaataagagaattgcgtaagtcacacagaataagtcaggtggagctggctcaagtactctgtgttacaaagcaaagcgtttcaaattgggaaaatgacaacatacagccgtcaatcgatatgctgataaagatagccaagtatttctctgtctctacggattacctgttagaccttgataataagctgacaattgacgtttccggacttactcaggaacaaattacgcatataaaacttataatttcagatataaaaagccggaaaaattaaaataattctaaaaaaagtcttgatttttatattttattatggtatactaatacgcgtgtcaaattaagatttgccggtgtggtggaattggcagacgcgctggactcaaaatcctgtggtagtgataccgtatcggttcgaccccgatcaccggcaccatatcggagcaagcaaagcttgctccgatttttgtttgcgcaaaaatcaattatctgcgcggcttatacgcagatttcatctgcattgagtatttaaattattgccattaactataatgttattattatgaatgtttaaataaaaggaaatggttcaaatatttattataagtaaaataatacatattatatggggtcatatacaaagtaaagttatataatgaacactgcgtgttcagatgataactcacctaacgcggcggcattgccgccctaccgatgttcgtcgaagaccagcttttttgatgagttaaataaaataggaactcggaatatctattttcacggcagtatacaaagtcaacgggaaagtaacaaggctttttcatcttgaagcgcagattcaagatgaaattagcggggagcgagcgccccttggagccgtaggcgacctaagcgagcaagcactttttctttggtgaagcgtttctttttcttgccagaaaaagaaatggttcaaacacctattataagtaaaataataaatattatatggggtcatatacaaagtaaagttatataatgaacactacgtgttcagatgataactcacctaacgcggcaaactacgtttgcattgagtatacatattaatgacattgcaggctatagcaaaacaagtaactttgataacacgcgcctttcagctgcggtcacagtcacacctgccgatgttcactagaaataccatttttttatataatttatttatgatatacttgacataatacttttttagtttgcagactttttattgcataaaaatagagcatcatagtctgatgctctataaaatatttctctcgatggtcattaattgtctgaccttctatttttgttaactgttacaaataattgcaaacagtccataaaccttaagcagtatcaattctttttagcagtcatccttgagcgggaagttataagcgtcaagatttatctgatggcatattattaaaattccctcaataaatccccaaatacttcctacgccgcaggtaatcaaagttaccactatttgtacaaccgcacgggtagtaaatcccaaataaaaattgtgtactccgataccgccgaggaatattcccaaaagacccgctaacagcctcgatttcggaacatagttcataggcggctggtatggcggctggcgatagttctgacccccgaaattattctgacctgcgttgttctgagcgtccccgttattgctttgtgcactgccgtttattggcgtgccgcagttggtgcaaaaatttgaattgtcacttacttctgttttgcagttaggacaaacttttgcggactgaccgttatctgcagctccgcataccgggcaaacgtttgcgccgtcttcaaattcctgaccgcagtttttacattttttcatgttttacagtcccttctataagtttataaaatttctaattattccccatgttataaataccgccgccaaagtaacaagcgcggcggcagcgtattttgaaaaattctttcctgttatatatatgtaaggcagatatatcaatatgtataaaagagtgaatacttcaggataaaacattaagttgaattttacaggggcaagaaaatctccgtttaacagcgccagcataccatttgtattgccgcagccggggcacttgaacccggtcaaatcccgaaacagacaccgaaggccaagctttccgttaagcaaaagatatccggcggcaatgcccaaaacaatcagaactaaatacaataaaaccactctttttatcctgacagcctttcccatagaatccacctcttacagtaagtacattatacagcatatgcaaagttattgcaatgcttttttaaaataataaaatttttgtcaaacaaagaaaattatacttgtgcggtctttataataatgatataattaatatatagactactttgtgaggtatagtgatgtttaaaggcaaattgatatacagaacggtcgctttgtttatggccgttgttatactgcttattgccgcattcggcgttgcggcagttttttgtgttacccggaattatgaaaattcttttattgctcatgcggactctgcaatacagtcaggactgcctgattctcttcaaactattctgaactcgtcgaaaagagagtttgtaaagcaatacgagattaaaaaactgctggattcatactcttctgttttaaagctggacgaaaacaggaaatgttatattctatccggcgccggaggagaagtgattgctccgtcagcgcttatgcaggaaaaagttcaaaaaactccaaacctgaccaatgcgcttgataagcacacaaagggaagcaacagtaatttctcttctgatgttcttgactatgcgtactatattaagccggtgactgatacggccgatggttatattatatatatcagggataataaaaacgtattgcgggatattataaaccaactgctgtgggtcttgttatggacgcttcttgcaggaatagctttggcagttttgacggctgtgtatgtttcccgttctgtgaccgtgcctctgcggaagctttccaggcgcgccgacagctttgcaagaggaatatatgaccttcctgccgaaacagggcgcaacgatgaaataggtgcgctttctaaggcgtttaaccatatgggcagtgtaatgagcagaacaataagccagattggggctgaaaagcataaagtcgacgttattttggagcatatcaccaacggtataatggcgtttgacactgaccaaaaactcatacatatcaatcctgctgcggcggatatgcttaatattgattctgattcagtttcagaatttgacccgttttttgaaaaactgaacgccggagtttgtatggcggagtttatgtatttggataaatacgctaccgaaataagagatataacatatgacggtaaacacatccgcatatactttgttccgtttaagatggacaacgacaagaccgccggaatcgtttgcgtatttgaagactttactgagcagttcaaccttgaagttgcgcggagggagtttgttgccgaggtatctcatgagctgaaaacgcctttatttataattaaaacccatactgaaacacttttgaacggctacatggatgataaaaaaatggcgaagaaatttttgtccacaatagaaaccgaagcggataaaatgactgctttagttcgaaatcttttggatttgtcaaaatttgacgtacagaaatttgaaatgaaaaaacaggtattttcaatcgaccaaatgctgcgggggatagtaaacaggtttgcgcttgaagcggagatagaggatatagaactgaaatatctgccggcaaatgagctgccgcagatgtacgcagacccggaacagatagagagggctatagtaaatatagtatcaaattctattaaatacggtgaaaagggcgggtatgtgaatgtggccgccggaagtatgtataatgaagtatatataaaggttgaggacaacggtcacggtataccaaaagcggacttagagcatgtgtttgacagatttttcagagttgacagagcgagaacaagagaaaagggcggcacgggccttggtctttccatagctaaagaaataattgaaagccacggcggttctatagtcatagagagtgagtatggcaaattcacaagggtcacaatcaatctgccaaccgccaatgtgaattgagttgttttgcattttggtttatggggttatatatgttttataaattatagaattataaagtaaaatttttatatgaccccatatattttataaatcagaacaccatgttttatacttacacatatataatttaaccaaatatttataaataaatttgataaaattagaataatttacatattgtaaaattttatggtttgctgtataatatcatatgttgttcgctgaaaagcgaaggatatgcacctttagctcagctggctagagcacctgactcttaatcagggtgtccggggttcgaatccccgaaggtgtaccaaatttttaagagaatgggacaagtcccccgatattgcggggcttgtcccatttttgttttttcattaaaatgttttttataatttgtcagacaccttgtgtattttggagttttccacaaaatcaaggcgtctgatttattctaaattaaacaactgttttaataaattattcctctgtataaagcggttgcatattgccgtcccaaacaaagacctttaccaaatctccggagcttacaggtaatttaacatcgcttcctgtctgcatgtctgtaaggcattcgtccctgtatactgcggtgtatattacgctgttgcttgtgtcaacgccgtcgggaataactatctttgataaaacagagtcattttcaataacagaattattttttatttcattcccgttttcatcatatatttttagctgagtatttttttccgcttctgataatgtcacgttaaatccgaattctgccgcatactttatcaaggttgatgaactgcatgaatcctgagcaacacccaaataaaccatttcaggcagtgttgtgtcttcaataatatacggctgtcttatattatctgtgaagtcagttccgttttccgagacggacattgttagtcgctgtccctttcttgtcattcttagatatttcggcatatcgtatgttattgagtcaacattctctaccggggtgccctcagcgtcaaacatatatgagtttgtaaccgccgttccttttacgggtctttcaaaaacccttatgttttcgccatacttcagccagctgtccgcaagaagatacatttcagaactgctgtccaggctgctcctcaccataagtcccgacttaacattgttttcaaacttaggcacattcttggtttccagtattatatcaaagtcccctgtaaactcacggtacataaaaccgaacgaatccatcttgccggcgctgtttccgccgactgaaccgctcgcaataatgctgaacccgtcctcgttttgagtgtatccgcctttatacggcacactgccaatatctgcatatagccactcgccgtctgacagcccgcggatatatattattgatgtgtccgacgacgtgctttcacctttgtcgttataggcgcggcttgttatataatgagtgccggtagatagattaatcgttatgtttattgcctctgttccctctgacatctcaattaattgttcaccgtcgtaaacttcaattttggttatttttgtaccttcggcaggttcggatacagcgccgtattctatacttcttttgtctgttgaaatatatggagtgttgtcataaatatttgcatatccggttacggtttgcgttccgtctgatacttttgatattgttattttgggattggtcggcgttattgaatttgtccagccggattcggtatacgacagtttttcaatctcatcaaacacataagcttcaagccaggtatatcctttgtataaaccctcgctgattatatcagtttcatccgcgtcacccatgttgtttgcttctttccaagactcggaaattttaaatattctgcttttgccggacatatcaacgtatccgccgacctcatatgccttattgattaaacgcccggtctgatttttcatatcctcaaccacacgcgcgtctatgctgtctcgaaccggcaagactgccccggcgctttttacagctttgtcataagccgcctcggcgctgacttcattcactttatactctcccatgtcgaacggttcattttccctaaccgcgttagccatgttatgaatgagcgcctcgtccgcccagttgtcattcaggccgttattgttattttctgattcatagccgtaaacgtagttaccgtttatataatagtgcgaacctgttcctgagacgtcaaatatcttatactttgcctttgtgctcggtccaaacttgtagtatgagttcaccatattgacttttgtataaaagttttcagcagtcgattcaccaccgtaacttgaattgccgccccaattatatattacgttattttttagctcagtatagattacattgctggcaagtcttgggtttctgctgtcatgatgggctataatattattatagtagcttgtgttggttcctccccatatcgctccgtaaccgtgtgcgcctttataatggtttgacagacgcaggctttctgatatgagacagtttgaaattgtatagttaccggtgtcagcgccgtctggattaaggccgccgtacagggacataagttcatcaatcccccagctgacactgcaatggtctaagacaatatcatttatgtgcgcgccgcccaaacagtcccattcaccttcaacactgtctccggggcgaactctcaaatatcttactatgacgttatctgctgcaatcagaacgtcggttccggcaatggttattccctgccccggcgcagtctgtcccagaatcgttatatttgagttgccgattttcaaacgttcggtcaagttaattgttccgcagacatcaaaaacgacaattctgccgggacgcgatacggcgtcacgcagcgttcccgggccgtcgtttgcaagacttgtaacgtgatagacgcttatgtttttatttcccctggcgccggtggtcttttttccgccgccttgaattcccggaaccgcgtcaggagatactgtatcatactttagcccggcgccgtaaaagataagcccatattttccggtgacatatatgtatacagggattccttttttaacctgcataggctcagtggttatcattgttttgccgtcaaggatgaacgagcctaacactataccgtcctgcttcacctcaaagcttctgagacctgatccttccgccgccacgttatacatatcaacaaacagcatactgtcggtttcaggtataatactcacggcgcagtcgggattttcaacatttttacatgggcttagaaccgcccggttgacgtaggttctgccctcaaactttttgacgctgggattcacggtaatgctgccgccgcttgcgtgaacatacaaattattaggcagaataatatcttcagtgattttaccttctccgacatcgctgaaatcatagagatcagttatcgttgttatattttccgcgtttacagatacggatattaacagtaaaataactaacactgtaatcggaaatatctttctcataataaatcctcccagtcaagcaaaattaataattttattataacataatttttgaaatttgtatataagtaataaaattacaattttgcgacttgttatgacgtaaaaaagtaatttgctaaaagcatatttacataatcgttttataatgtcttccttgcttatatagatatataattaaaaattgcaggcgaaaatataacgtggattgtctgcacaatagattagtaaaatccatatttaggaatactgagataggaaaatagtctgctatgataattatgcaatatttttttagtttataatataactgtcatatgctctaggcagtattttattaagctaggcataccggatatcaattattgtgataggtattgaaaataatactatcttatgatataatgcaaaaattgtgatataaaattttgtttggaggaatagaaatgggattatatagcattatccttgcggccggtgagggaaagagaatgaaatcaaatattgcgaaacctcttcagcaggcggcaggaaaagcccttgtggaatgggttttggatactgcggaagaaaccggaagcgatgaaaatatcgtcgttatcggtcataaggccgaagatgttaaagcatatcttggggacagggcgaagtatgcctatcagtatgaacagctgggaacaggccacgctgttatgcagggtattgaaagcataaaggacgtagacggcactgttatggttctatatggggattcgcctctgatagaggctgagactttaaagagggtgcgtgaagaccacagcaaaaagatgagagccgctacagtaatcactgcgatagccgacgagccgtatggatatggaagaatagtcagagaaaacggtgaaatcgtcagaatcgttgagcagaaagacgcttctgaggatgagcagaaaataactgaggttaactcgggtatgtatttctttgatattcaaaaactaaaagaatccttgtctaaaattactaatgataattcccagggagaatactatataaccgacgtaattgaaataatgctgagcgaaggcgaaaaggtcggagcgtatgtcaccgatcttgaacagactatgggagtaaacgataaactccagctgtcacaggtcggaaagattttgaaccgacgcaaagttgaagctttaatgcttgccggagttacaattattgaccctgacaaagttcaggttacaacaaatgttaaggtaggaagagataccgttttgtatcccggaacagttcttgagggagacactgtaatcggtgaaaactgtgttatcggctccaacacatctttgaataactgcaaggttgggaataatactaagatattggagactgtgggtatcgacagtgaaataggctctgatacaaatgtcggaccttttgcatatctgagacccggaaccaaagttggttctgaagttaagataggcgactttgtggaggttaagaattctacaatagatgatggaaccaaggtggctcatctgacttatattggcgacgctgacgtgggtaagagggttaacttcggctgcggaaccgttgtcgtgaattatgacggcgtgaataagcaccgtacaattattgaagacgactgctttatcggctgtaacaccaacctggtgtctcccgttgtagtaaggcacggcgcatacactgcggcagggtcaacgataacagacgaggtgccgcctgaatctttggctatagcccgttctaagcaggttgttaaggaacagtggacggcaaaaagaaaagacagcaagaaaaaataataaaatttacttgaggtaaatataatgtatatgatagtgggattaggaaatccgggcagaaaatatattaataccagacacaatatcggttttgatgttgttgacgcgttctgtgccaagaataatataaagtttaagtcaagcaagtttagggctgaggttggaacgggtatagtatgcggcgaaaaggtgattgcggttaaacctacaacttttatgaatctgagcggcgaggccgttgcgcctattgccgattattatgatatacctgatgaaaatattattgtcatttcagatgacaaaactatgagtttaggaaaactgagagtgagaccaagcggcagcgccggagggcataatgggctgaaaagtattatactcaatcttaactcagaccagttccctagggtaaaactggggataggcggaaatgatatggatgagcatgaggatatatgcagctttgttttaggaagattttctaaggcggagactgaaatcctgactgacacagcggtaagagctgtgaaagcggttgaggagataatcaggacagatgccaggacggctatgcaaatgtataacggataaggattgtatgtgattggctatgaaaacaaacggtttttatgaagttatggaagaccttgccgactttgaggagctggcaggggctttacaaaaaaatattacgcctataaacgtagcgggtgtgtcggactctgtgagggcacacctggctttttgtgtgtccgaaaaatttcaggctccgattttattggttgccgaaaacgaggctgccgctatggaaatagccgacgacctcagatttttctcaggtgcggaggttctgtattacggaaactccgatatacttttttacgatgtagatgtaaagagccatgagatacagaagcaaagacttgaggtgctcgactatttgttcagaaacaaaggccggcgaacctatgttgtgaccacgtattcggctttgctcagtgtgactataccgtttaagaaatatcaggaaaacgttataacattaaaagttggggatgacattgagttagagacgctgatcggtaagtttgaaagtttaggatataagcgtgaggaattggttgagggagccggtcagttcagcgtccgcggtggaatacttgattattttccgtattacagtcagtatccgctgagaattgaattttttgacacagaggttgactcgataagaacctttgacaaggacagccaaagaacgattgacagatgtgatgaggccaggataactccggcaggcgagctggtgccggatgataaagaacgtgctaaattagtaaaaaagctgaacagcttgcttagcgatactgagaagcctgtatccgaaaaatcggcttcggtgttgaacagggatattgaaagacttaagcaggggattagattcccttcaatagaaaagtatattccatatatatatcgtgaaaagcccacaattttggattatttggcagatgatacaattattttttggtgtgacggccgcagaataagcgaggcgtatgaaggcgagacggtaaggtttgcggaagacataactgagatgactgaaaggggaataatccccaaggcggatacggaatactttttgccgctgaagaaggcggtaaaacggctgacggcgcatagatttgttggggtcagcggtatttcaaattattcagctgaatatagggcaaagagaacctatgctgttggctccaagtctttggcaggttttcagggtaggcttgaattcttatatgagtccctcagattctataaatccagccaataccgtacggttgtgctgggcggttctgagataagggctaagaacctgctgaaccagctggaaaacgagggttttaactgtgcgtacacagacgttttgacagagcttcctccgcccggaggaatagttataactcacggttctatctcgcatggatttgaatttccttccacgcagacagtggtgatttctgataaagagatattcgggcatgaaaagaaaaaaagaaagcgctacggcaaggttaaaggcgaaaagattgacaactttaccgacctgaatatgggtgactatgttgttcaccgaaattatggtatcggtcagtatataggcattgagcagctgaatgttgatggcgtcagaaaagattatctcaaaataagattcaagggcgacgactttttgtatgtgccaacagaccagctggatatggtctacaagcatatcgccaaagacggagcaagaataaaaatgaacaagctgggcggcggagaatggagccgtaccaaacagagggtaaaagctgccgctgccgatatggctaaggaacttatagacctctacgccaagcgtgcgaatactccgggaatatcattccctaaggatgatgagtggcagagcgattttgaagccaagttcccgtttgaggaaactgacgaccagctccgaagcatacaagagatgaaagaggatatggaaaagccgtatcctatggacagactgctgtgcggagatgttggatacggaaagaccgaggttgcgctcagaggtgcgtttaaggcggtcatggcagggtatcaggtggcgtatctcgtgccgacaacaattttggctacacagcattttaacacgtttaagcagagaatgaaggattatccgataaacgttgcaatgctgtctcgtttttgtaccgcggcggaagaaaagcgtattgtaaaaggtttggcaacgggtgaaatagacgttgttataggaacccataaactgctgggaaagcatatcaaatataataagctgggacttttggtgattgacgaggaacagcgctttggggttgcccataaggaaaaaataaaagagataagaaaagaagtggatgtgctgacgctgtccgcaacgccgataccgagaactcttcatatgtcgctgaccggaataagggatatgagcataataaacgaacctccggcggagcggtttccgatatcgacttatgttcttgagtatgacgaggacgtaattcgggaggctataaataaggaattgggccgcggcggtcaggtgtattatctttataatagaatagacggcatatttaaagtcgccaacagaatagcggagctggtgccgtctgcaagaatagccgtggctcacggcagaatgcacgagaacgagctggagcaaattatgatggacgtgtcagacggaactattgacgtcctggtctgcacaacgataattgaaacagggcttgatataccaaatgtaaacacaataattcttgaaaacgctgaccgcttaggcttagcgcagctgtatcagctgaggggcagggtcggacgttcaaacaggctggcatacgcatatctgacctacaggcggaataagagtttaactcccgaggctgaaaaacggctgctggcgataaaggagtttactgagttcgggagcggttttaagatagcaatgagagatttggaaataaggggcaccggaaatcttataggcgcccagcagcacgggcatatggaagctgtgggttatgagatgtactgcaggctgcttgaagaggcgacggctgagattaaggggatagagacgaaaaatgagaccgagacacagatagatttacctgtatcagcatatatttcagataagtatataaagaatcacagtcaaaggatagcagcatacaagcggatagccgcgataaaaaatcaggatgagctgtatgacgcgtatgatgaaatagaagacagatacggaactgttccgccggaggttgaaaaccttatggaggtggccctgattaaggcgtacgcttcaagttataatataaccgaagttataggaaactcagagaggataacggtaaaatttgaccctgaaaatatacccgatatgaaaccgtgtttggaactgatagacaaatatcccggaaaaatatcgatattgacgcccaataatcctaaattggcaataaaacttgttcctctgtcctctgacaaaggcgggaagaactatttggctcagataaaagaaatgatgagttttttatcagaacaaagcaaggcaaatttgaataaattgtaaacatttgaataagttttaacaacaatagtggaaaattaacttgctttgatgtataatagaaaaatattttgggattgtgtagttatgcaggtcaatattttgggactgtgtaagtattcgggctgtcccgggttttatgagatttaaaattatttaaacataacataaaaggagaaaaaaagatggctaatgacaaaaaggacattttgaacgatgaaaaagttcaaaagatgaaagatgacgtaagctctaaaatagctgacgccgcgtctgaaatcaaggaagaaatttctgaggctgatcaaaaggcaaaagaagttataggcgataaacttaatgacgccggagaagtgatttcagaagccggagataagcttgaagactctattacagagataaaagcagacgcgctggaaagcgttgataacattaaagaagttacagaagaaaagaaaaaaggcgtcaatatttctgtcggcgctttggttggaatcatagttggatgtgttgcggttgcagcgctgatagtatttctgattatgaactttacggccgcacagccaaagtatggcaaggctgagggcaagacagttgcaacggttaacggtgaaaaaatcacagataaagatttaggttattatatctatgctgaagctatgactcagtactatgatattgaaggcgaaagcgcagacggcgacctcagcagttttgactgggatcaggaaatcgacggcaaaaaactttctgatactataaaagaaaatgcaatgaaaaatgctgttgccgatatggttacaggacagcaaggcgaaaagctgcttacagacgataatgcttggacagagaagaacgaccagcagattcagtctacagtagacagctatgttcagcagttcggcgaggacggattcagcctgagagcaagaagcatgggtatatcttctgcaaatgaatatgctagaatgtatacaactgttatgaaggcgcagaatgttcaggcggcaatggaagaagatatttcaaagtttactccggaaggcgttgaccttcagaattatacacaggatgacagagcgtctgttaaacacattttgattgagacaactgaccctgcagctgcagatccggccgcaacacctgacccaacagctgttgacgacgctacaggattagctacagctcagaatgttgcgcagcaggctaaatcgggcggcgactttgaccagttaatgactcagtataatactgatacaagcgaaacatcagccggatataccttcaaaaagggcgaaatggttgaagaatttgaaactgcagcattcgctttgaagcttaacgagatttctgaaccggttaagaccaattatggttaccacgtaatcatgagaatccctggattatatgagatacagggttactgggttgaacaggctaaagtaagcgaaaacaaggggaaccttgataaggtttcagttaaggcaattttggatgatgttcaggcagcaacagaggaacttgaaaacgagcaggctgctgcaagcgccgcttcaggcgccggaacttctacatcaggcggaaactccgcagcagatggaaactctgcagcaggcggagctgccgctggggaataatccaaatataaattttggttatataagattgcaccgcttaggcagtgcaatctttttatatatttgtaataataaaggttattttttataaacttatattatctgaattaagataacaaacaaatcatataagttaaggggtaggtttatgcctaagttatctgagcttgaaataaaagaaataaaaaatattaagtatttgatagttttggggtgccgcttgtttggcgtaactccaagccgatgcttatatgaacgtctctcagccgcgctgaaactggttaaagtaaaccgggatattataatagtctgcagcggagggcagggagataacgaggacacaaccgaagcccgggctatgaaagatttttttgtcagtaacggtgtagaggaaagtagaattatccttgaaccggattcacacagcacttatgagaactttgaattttcaaaagaaaaaatattaaagaccggaggaagtatagaaaacaattctgcatttgtaaccaacagtttccatgtctttcgctctaaaaaaatagccgagcttattggatataaaaatattgttaaaatttcagcatatacgccgaaggcttccaaaataagcaactatttaagagagggtttatctattataaattactatctcaatctgcggcggaaaatcaaaaaaatgcaaaaaaacagtagagactatggtaataatataaaatattagtttttgatactacaattatgttacatgactaaaaaaaacttgacgaattatatgttcattatgtataataaacacaaagaaattatagacatatatagaatataattgaaattttgttaaatttttgtcatattatggagttttttccttaaccatgcagttttttctgcgtcttaatgattttagaaaaaatcccagtttttttatgtatttgtaaaaaaataaacttatatattttgttgttatgggaggttttacaatgggtattgtagacattgcaccgtggattgttttggccgcttcaatatgtggtctggcttttgcgatgtacaaatttttctgggttaaaaaacagcctgagggaacaaaagaaatggcgaatatttctgctaaaatcagaaaaggcgctatggcgtatttaaagagacagtacaagacagttggtattttctttatcgttatgctgataattatttgcgtaatggcagcgtttggtcttctcacatggtttgttccgttcgcatttgtatccggcggatttttctccggactttcaggatttatcggaatgaagattgctacatatgctaactcaagaactgctaacggagcccaaaatagtttgaataaaggcctgaaggtagcgttttcaagcggtacggttatgggtcttacagttgttggcttgggtcttttggacataagcgtttggttcataattttaaaagccgttctgagtgatccgaacgagattatggcggctatgctgacgtttggtatgggagcaagctctatggctttgtttgcccgtgtcggcggcggtatttttacaaaggctgcagatgtcggcgctgacttggttggaaaagttgaggccggaatacctgaggatgaccctcgtaaccctgctgttatcgcagataacgtaggtgataacgttggcgacgttgcaggaatgggcgctgacctttatgagtcatatgtcggttcaatcatatcaacaggcgcgcttgccacagcggcaggtttgggctttaagggcatagttgttccaatgatgattgccgctataggaataatcgcttcaattataggtacgttctttgtttctacaaaagagggcgctacacagaaaaatcttttgggttctttgagacgaggcacatatgtttcggctatactttcagctatttcagccgcagttttgatatttacactgcttccgcagaatacaggcgtattttgggcagttatatcaggtctggtagcaggtgtgctgataggattctttactgagtattatacatctgattcatataagccgacccaaaagctttctgagtcatcaaagacgggaagcgcaactataataatcgacggtatagcgctaggtatgaattcaacagcaattccagtagttatagtgggtatctcaatccttgtcagcttctttgccgcaggcggcggcggtttccttgccacaggagatttgagcagtttctcattgggtctttatggcgttggaatatctgctgtaggtatgcttgcaactttgggaataacattggctacagacgcttatggtcctgttgccgataatgccggcggtatagcagaaatggccggccttgatgaggaagttagaaaccgtacagacgctttggattctttgggtaacactaccgcagcaaccggtaagggatttgctatcggcagcgcagctttaacagccttggctttgatagtttcttatactgataaaattcaggctcttggaggacagcttcagttgtcgctcacaaatccgcctgttttgattggtttgtttgtgggagcaatgcttccgttcctgttcagtgcgtttactatgcaggctgtaggacgtgcggcacagaaaatagttgttgaggtaagaagacagtttaagcagataaaaggtttgatggaaggcaaagcggaagcggactatgaaacatgtgttgatatctgcacacgttcatcgcttagagagatgattttgccggcggctctcggtatactcgctcctatagttgtaggtttggttctcggagtaaacggagttgttggtatgctcgcaggagctttggtttcgggatttgctattgctatcatgatggctaattcaggaggcgcctgggataatgcaaagaaatatatagaagccggaaactttggcggaaaaggcagcgacaatcataaggcggcggttgtcggagacacagttggagatccgtttaaggatacttcaggtccgtccgttaatattttgattaagctgttatctatggtttcaatcgtttttgcagcgcttattgttaagtttaaccttgtggatttgattaccggtttactcaaataaaggagtgacgattagatgaaatattgtaccaaatgcggcaatgcgatggacgataacgccgctgtatgcccaatatgcggagaaactcaaaagacagagggttctcagaaccaaagcggtacatattctgattttcatagtgttaaggaaaaaggtccggtagggacagctatagccagttttataattggtattataagtttggtactctgcaatacggttataggtccgattgttggcctaatactgggtatagtggggacgaaacagtataaccctgcaaggaatacgagtaagtggatgggcgtttggggaatagtactaaacgcattgtctatcattgctttaatcgtttttattgctgtcgttatatatttatactcaacggggcagcttgaaccggatatagatatagttaactaaccgtattgcaaaaatagaaattgttatatataaaaacagcaggttaagatatatgcaatatggggttgacattatataagagatatggttaaatgttaaattaaataatcacgctgttttgccgccgggtaaaacagcggagcgtcagactttctatcattaagtccttgaagatagaaagctggcgctttttatgaataaggagacaagatatatggagcagacaaactgtttaaaagactttattcgctatacttcgcttaatgttctcggaatgataggcttatcattttatatattagcggatacgtttttcgtttctaacggagttggggcgaatggtctgacggcgcttaatttggccgttccggtatacagttttattcacggaagcggtttaatgtttggtataggcggcgcgtctaagtattctgttttaagaggtcaaaaggcataccaagattcaaacagagtatttacaaatactgtatacgcggcaggtcttctgtcagtgatttttgtgctgctgggagtgtttgcttctaataaaataactgtccttttaggcgccgataatgaagtgtttgatatgacaaaaacttatctgagcgtgctgctgtactttgctccggcgtttataatgaatgatgtgctgatttgctttgtgcgcaatgacgggaatccgaaactgtcaatgtctgcaatgcttgccggaagtttttctaatattatacttgactatatctttatatatccatttggtatgggtatattcggcgcggttttggcaaccggttttgctccgataataagtatgctgattctgtcggtgcatttcagaaataaaaactgctttcgctttaaacttaagagacctgatttaaagcttataggcacgattttttcgttgggtattccatctctgattacggagctggcttccggcatagtaataattgtctttaatataatcatactggctattcaaggaaatgttggagttgcggcatatggggttattgcaaatatttcgtttgtggtcgcgtctatttatacgggtatcgctcagggaatgcagccgatagtcagttctgcatacggcaggggtaatatcagcagcgtaaagcttgctttaaagtatgcggtggtaacaatgctggcggtttcagttttggtttacacatgtatttctatatttgccggaccgataacaggaatattcaacagcgggaataatggtcttttgcaaagtattgcagaacagggattaaaaatttattttacggcggttccgtttatgggtcttaatatagttatttcaatgttttttatagcggttgaaaaagcaattccagcgcaggcaatctcattgctccgcggaatcgtgcttataattcctatagcgctacttatgtcatttttggcaagtcttataggggtatggctgacattgccgataacagaagggcttgtagctatcctcggcattgtgttatattgccgtgttaagaaaagattattatagagttactgatataaaggagaagaaatatgtttagagagatgcgcagaaaaaaacagtcattgtccggtgaagaaatatcggagatattaaataacggtacctcgggcgttttggctctgtcgggagacaatgattacccgtatgcagttccgctcagctatgtgtatgacggttcaagcatttacttccatgcggcgaaaaccggacacaaaattgacgctgtaaaaagaaataataaagcgtctttttgcataatcggtcaagacgacgtggtgccggaaaaatatacgaccaattataagagcatcattgcctttgggaagattcggattttagatgatgagggagaaaaaagaagtgcaatcgaaaagctggcggtcaaatattcttccggggataagacggacagagaggccgaaataaaaaaggaatgggataatttatgtatgcttgagctgcagattgattatattaccggaaaagaatcgatagagctgacaaaaataaaatagaaaaaagaagtataatatttttaaggttaaatagcgtatacgaaattgatttatattttaattagaaattaaaatataaatataagaagcatgcaaagtggaaaaaacgcaaagtaaatttgacgatttgtttaagtttgcttttatgtgttatacccatatttaaaaaactaaaatgaatttcagataaaatactgaaaagtaaatcgagctgtcaagaacagttataactatattttaattgagaacattgtaaataattctttatagtaaaaagttatgtggtttattataaaagcaagtaaattttcagtctgagagtacagaataatatatttaagtaaaatatgataataaaaaaacttaatatttcataacttcggtttataaagtatgtttttatataaaatacgccgcctgttttcaggcggcgtatttttattaaattatataataaatatagaaatcttagccaagttcagagaaatatttgattgttctaaccatctggctggtgtaagagttctcattgtcataccatgatactgtctgaacctcatagaggtcgtcgccgatttggttaaccattgtctgagttgcgtcaaataatgaaccctgagtaataccaataatatctgaagatacaagctgttcctcagtatatccgaatgatgctgattcagcagctttcattgcagcgttgataccttcaacagtaacatctttgcccttaactactgaaacaaggatagtagtagaaccggttggtacaggtacacgctgtgcgcttccgataagcttaccgttaagttcaggaataacaagaccaattgctttagcagcgcctgttgagttaggaactatgttaacagctccggcacgtgcacgtcttaaatcgccttttctctgaggtccgtcaagaatcatttggtcgcctgtgtaagcgtggattgtagacatgattcctgattggataggagcgtagtcgttaagagccttagccataggagccaagcagtttgttgtacatgaagcagcagaaataatcttgtcttcaggtgtcaaaattccttcgttaacaccaaaaacaacggttggaaggtcatttcctgcaggagctgaaataactaccttcttagcgccggcattgatatgagcctgtgccttatcctttgatgtatagaagcctgtgcattccaaaacaacgtctacatcaagctctccccaaggaaggttgttagcgtctgcttccttataaatttcaatttcttttccgtcaactgtgatagaagactcgccggctgtaaccttgtcgccgagagcgtatctgccctgagctgaatcatacttcaaaaggtgagcgagcatagtagggcttgttaagtcgtttatagcaacaacttcataaccctccgcgccgaacatctgtctgaaagccagacggccgatacgtccaaaaccattaatagcaacttttactgacatagtaaagtacctcctaaaaagatatatattgttttatattttgcagatttatctgctatcggaacagcgaagcctgtaagtaagaataaaaatacgcctcttagccgacagcagtattattttacctcaaacggataaaatattcaagtattttttcgatatttttttaacgattaaaaaaataggacaatttaactatatgttgacaccataaagaaaatgaattagtcatttaaacaatgcaaatgttttcaatctttgcttattagtatacacaaatcctttaaatatataaacaagcatcagaatataagaacaagagtgatataatattaagatttttattacagaatataatatagaagattaacaaattataatgtgctgaagcaatcatttgtttattttaggattatcggtacgcccaactagataatctattgacacattaaaataataaagcaggtgatttaaaaatatgataaaactgtatgcaagtatagaggttatacagttagatacattttattatttacctatttctttaaaatcctttattatgaccggatgataacttctcaattctaaacaaaataataccattaaaaaagacaaaatcaagtcataaatttaaaaaagaataaaaggaagtttcaagcgtgaagaaattttaaaatacataagttggaggggaaacgtttgagtgtactgaaagaattgtattacggaaatataaatcctcatgaaaaacgtgttgtcagcaatttagaatttgaaaaacatgtaaaagttatattagaaaatgaagaaaaactaagcataacactgaagaatgaggaaaaatatctttttgaacagttattagccgcacatgaagaagtttcaagtctggaattattggaatattttattgaaggatggaaactgggcagccgctttatgcttgatacttttattatatagaataaaataacattctggactaaagttttaaagataatataaaaaataatatttttatatcttaagtattatgcagttaataaaaattattaataataaagtcaattgccgtctgtaaaatttattttaagtacattatagtagtatctaactaaaattattgtttatatcctgcatgttgcaatgtttgttcccggacatgcggtttcagatgtatttagactataatataataggtttaaaattaggccgcttgtataataagcagctgatttgattcatcttgttattataagcgcagtaaaagtttttttggctcgcctttaaaataatctttatatactcaaaattgttataattttattgtgcaatttatacaaaagcggcaatgttgaaaaaaatcaaatattacagaaatgttacagaaatatttatcttatgttacaaaaaatgaccgcaagatattggcatcaaaaattttgtaacacaatatattgatttttaaaaataaaattatataaaaatacggaaaattttgtgggaaatattttggccattttgtgaattgcaaattaacaaattgtgaaaaaatcgggattttacttgattttccgagcctgccgtggtatactgtgtgcacagtttcggttttgaaattggaatgcttgctgaaatattttgtatattggcgcaccagtatcaggagttttcagcggcaaaatttttgaggtgattattttatgcgaaaacacaaactattagcaggaacagtactaatactgtcgatgttaatatttgctctgccggttataacggcatcagccagagaattctctgacgtacctattaccgcttcatattatacggcggtggataagttgagcaatatgggtgttattcaaggtagagaagatggaaactttgctcctgaggctcagactacgcgtgccgaattctgtgcgtttatgtcaagggctacaggctataatgaaacttattacacagcgggagacataccgttctctgacgttcctgacgggtattgggcaaataactacatatcttattgttatgaaaagggatatataaacggtatgcttgacggttctttcgctccggctgatccggttacatatgaacaggtggttaaaatggtcgtatgttcatccggtgccggcgatgaaagcctaagaagcgttggcccttattggtattcgggttatgtggctgtggcagaaaagtatggtttgcttcagaacacgaagaagactgtgggtaaggacgctaacagagcgtttgtggcacaaatggtgtataactctttgagttttattaacggcggtgatttggacgattcaaatcagtcgtcgggtgacgcttccgatttgtcaaataattcagcatatcctacagcggaaccggaagaaccggaaaacacagatatttccggtgaagatatatttgatgctaccccggctcctacattagcgcctacaccggacccaacagcgtttccaactccggatccgacagccaaaccggcattggctcctacgcctatgccgacattggctccaacaagagaaccggttattaatgaaccggtatataaaccttcaattccgtctaataatggtcttactgttgtaatagaccccggtcacaattacagcggcgttgatacaggcgctaccggaaacggtttgagagagcaggatataacctattatatcgctgaaaaggttaagcctctgcttgaagagagagggtttaatgttgtaatgacgcgtaattctgtttatgataactgttctacagaatctacgtcagccagccttgcttacaggtcaaatttagctaacagtattggtgcggatttgtttgtatcaatccattgtaatgcaggaggcggaacaggaaccgaaacatattattattacggcaatgctgatggcaaaaggttagctacatatattcagaactatgtgacaagttctcttggtacctctaacagaggtgttaaagaggcagggtttgcagttattaaaaataccagcatgacggcgatacttcttgaaactgcatttattgatactgccgccgacgcagctaaactggccgatgatggctgtcagtggagctatgctgaaagtatagcgcacggtatttgtgattactttggtgtagcgtattagttgatgtttattaataatattgagtaggcagcgcacagcctgctcaatattatagttatttaaaatggtttacaaattaatattagggtgtcgggcacatatattatgtgcctttatgcgtgtctagggaaagatagggggttaattagatgaatagagataaaacaattaaaaaaccggaactgttggcgccggcagggaacttggataagctgaaaatagcattaacttatggtgccgacgctgtttatatcggaggagaagaattttcgctgagagttgccgcggataatttcagcgcagatgatattcttgagggtgtgaaatttgctcatgaaagaggtaaaaaagtatatttgaccgctaatgtgataccgcataattctgatataaatgaatattcagagtttttaggaagtgttaaagacagcggtattgacgcggttattttatccgatttaggaatgtttgcgttaactaaagaaattgccccggacttggatatacatgtgagcactcaggcgaataatgtaaattggaaaagtgctgaaacatggtataacatgggcgcaaagcgggttattttggcccgggagatgtctttggacgagataagggaaattcgggagcgtacaccaaaagagttagaactggaagctttcgtgcatggggctatgtgtatatcatattccggcaggtgcttgctgagcaactatatggccggcagagacagcaaccgcggtgaatgcgcgcatccttgcaggtggaagtattttctaatggaagagcagagacctggcgaatatatgccggtgtatgaaaatgaaagaggtacgtttatatataattctaaagacctttgtatgctccagtatgtggataagctgatagaatcaggtttgagcagttttaagatagagggcagggtgaaatctgaattttatgttgccacaattgtaaaagcgtatagaaagtctattgacgattattttaattcggatgaaaattatgtgtttgacactaagctattagatgaagtgaaaaaagtcagtcatcgtgattatacaacaggcttctattttggaaagcccggcggcagcgaacagcactatgagagcagctcttatatacgcaactatgatatggtaggaatagtaaccggatatgacaaagagacaaaaatggctgaggttattcaaaagaatagattctttaaggggaatacagtagaatttttaaggcctttcggtgattttcacgctcaggtgattgagtatatgaccgacggggagggcaatgagatagaggttgccaatcatcctcagagcgttgtatatattaaaagcgagattgaactggagcccgatacttttataagaatggaaagaaaatagaaactaaatactgctgagggttatattggattattttcagctgctatgcttaaattagccgaataataggataaatattcagtggttataagttgtttatctattgacttttttcgataaacatgataaaataaacttcgcatttatgcgtcatatttgtgcgcgagtctgtttggaatttaatggacaagcataattatgaaaatttatatatttataaaataaataaatatttttatttggaggggtaaaaaatgaaaaacattaaaagagttttgtgcttggttttgacgcttttgatggttgcgtccactgtatctgtttttgcagctttcagtgatgttccgacaacagtgtcatatgaaaaagccgtttcagcacttaaccaattgggcattatcaaaggttatgatgatggaacatttaagcctgataatgatgtaacccgtgcagaatttactgctatgctgatgagaactatgggagccggttctataggttcgtcctcatctgcagatttaccgttttccgatgtttctgaccagaattctgatatttcatggtctatcccgaacatcaataccgcttataaaaatggtatcgttaacggttatgaggacggaactttcagacctaatgacaaggttgcttatgaagaagcagtaaagatggttgtttgcgcgcttggatacggagaaaatatttctgttgacgcaactccgtggtattcaaacttcatggctcaggcaaggtctttgggtatcttaaaaggcgctcagaacttaggttctgctgagaagccggcttcacgtgcttgtatagcgcagatgctctatgattcacttgaggtatctcttgttgaaaacggcgtagtaacaacaaagacattcctcgctgattatctaggatacattaaaaatacagggtatatttcagcaaacgatttgacaagtcttgacgacccggatgttaacctccgcgagaatcagatacagattcgtgcaaaagagccgaactctacagtttatgaagttcatacatacgctgtagataacgcagctgaatttacaaataagctcggatatcaaattgatttcttctatcctaaaacatcagctaatgatacaatccgtacgctgttcagttatgagataaaagaaaatgcaactcttgaactcaattcttcaatgattgaaaaagacgagtctaataatacaacaattaagtattatccaactgagacatcatcgcttacaaacgctaatttggcatctgacaacattgttatatataatggaaagctttatggttccaatgcggacgcaagcagattctctacagatatgttccctaacgtaggtacaataacagtactggattctgataaggacggcaagtatgacgttgttactatttgggactatcaggtatattatgtatcaaagaaatctacaagtgattcttcgatagttgataatgcatcaagagcgactgataaaactttgactttggatgttgataaagacactaatcttgaaatagtagataaaaatggaacaaaggtttcgttcagctctatttctgaaggtaatgtaatctgctatgcagtgagcaactatgctgagaatggcggcgaacagtattcaagagctgttgtggtaactgacaaggctaccggaaacgtatcttcaacaatttccggggatgaaatgtctattggcagcaattcatataagttctcagacgcggctccttggatggagaatggaaatgacggttcacttgaggaaccaaagactggtgacaatggaacatatgccctggatattttaggtaatgtgtttgcgtatagcaagagcaatgaggtagttaaccaatattatggatatgttttggcttatgacgagggagaagctactttctcatcaatagatgattttcaggttagaatactaactcaaaataattccaaaacagattttcatatcagaaagggaaccactgttaacggtgtaagctgttctacagcatatgactttttggacgctttgagagaaggcgcgtcttatcagaagaccggagaagttggtcatacagacgtgcagcaggtagttaaatatacttatactacttataaaggaaaccagtgtatagatactctttatactgtaacccctgacacggatgtaaaagacggacaaactgttgagtcagataagctttataattttgctaatcttgagcgaggagaagtttcattaaaatatgctaacagtaaacttagcagcggaaatattcagctttcagtcggaagctctatagtttttgtagttccgccgcaggatcaaagaaatgatacggataggtttaggaaagcaacaaacagctatttcagcacaaataagacttatgacagcgttgaggcatttgatgtttcaaacacaaattccgctaaggtagttgttgtatacggcggaagcgccgctacggaagttgacgacagctcgccgatatatgtatttaatgataagccgagccagcagataaatgcaaacacatctgatacaatgtataaagtttcaggctttaagatttctaaaacttcaactaacggaacttttgacgattgggcttcgctctcatctaatagtgtagttaagaatgcacagattggtgatatctacagagtgggcgaggacagtgacggcttcaagacatttaaggatgaatatcgtctgtatcctgctgacgaaggttatatcgaagtaggaagcggcagagtttcaaattggagcagcgctgatttctgtgttatttacggaagcgtatatgcttcagattccagcgaaggtatggttatcattcctaagtatatagaccagaatgatgatgtaagcggcgaagaccagtatactatttctgcttcaagcttctcaggagctaaaattcttaaatattccgagaatggcggaaagacggaaatagttgacgcaacttctgataaagaagcaattatggatggtatagctgagtataatgaaggtcttaacccggctaaagtattgatttatatgtctgaaggaagagttaaacttttagctgtaacagaaggatattaatatagaagtaactaaaacatttgaccgcgggtatttaatatccgcggttttgttttatttatagaatcactttttgtatataatagtagaatatttacgtattattataaaatattgacattatgtattttgtgtgttaaaattatactcgttaatatttatggcagttagatttaaaaatttattttatatgcgtgagtaatggacctaatatttaggaggactgtttggttatggttattttaactgaagaagaaaaacaagaaatgtgtattgagcttgcggatcatttgcctaaaatcagagaattgctgaagctgtcacaaaaagcattcggcgaaagatgcggtatttcaacacccaggatgtctgtgatagaaaataaacactttgttatgacctggtctcaattaacatcaattatgtttgttatagtctgcaaccaaaagacaaaggaatacttttttactaatagtcttcttggcccaaagtttttgcagtttatacagcaaaaggaagaaaacagtgtgcctgatgtgaatattatggtagacgaagtttatgttaacaggtataaaaaacaattctttgatgaatacataaaaataatggataataataactaagattatacgcggcgctaagccaatagtgaaagtatttatcaggacgcattaaaccgtgtcctgattttttgtattatgtaagatttcgacttatttagtatattatttgtaatatattagggaactaatagcacaaaattattaaaaactaatgaataattgcctcattgttttggtttgattgactaatattaaaaattaatgtataattgactttgtctataatgagaattttatctacaaatgcaggtttgcatttgttaatgatacataattgctcattaaaataatatagtaaaagtttattttaatatattttagggggaattggaatgaaaaagttgagaaagtcaatggcattacttctagctatggctatggtgcttgctactttcggaattactgtcgtttcagcggcagctttttctgatacaagcggtcattgggcagagtcagtgattgacaagtggagtaatgcgaatgtaattaatggttatgaggatggaactttcctgcctgacgctaacatttcaagagcggaactggcaaaagttatatctgcagcaaaacagttcacatcacttgctgatattaatttcagcgatgtttcaggtgatgaatggtttgtatcagatttgagaaaatgcgttgctcagggaattatcggtggatatgaagacggaacgttcagacctgatgacgctgtaacgcgtgaggaagctgctacaatgttccagcgtgcttataaaataaattctataggattgttaaacttctctgataacgattcaatttcagaatgggcaaagacctcagtaaccgcattggttggagcaggtgtaataaacggatatgaagacggaacgtttatgccttccgctcctattacgcgtgcagaagttgtaaagatattagacggaataactgcagctgctgagagtccttcacagacatctaatcccggcggcggtacaggaacaaccggcggaattggcaacttaggcggaggcggttcttcaggcggaggcggcagcaataataatcagaacagcaattcatcaaatgtaacgctcaacgccaacggcggtaagttttctaatggctcaggcacaaaaacagttactgttgccaaaaacagtgttctaggttcaaaagcagttatgccttctcgtgaaggatatatttttgacggctggtatacatcaaaagacgcagcggattctttgatagcgtctaagaaatgggatgtagattcagacgccgtaactagaaatatggttctctatgcagggtggtatgcagaaggaaaatccatagtttcttttgaagtaaacggaggaactccttcagtaagcagtcaggaggttgagaccgggggttatgcggctgagcctactgatgttgtaacgcgtgaacattatacgtttgttggatggtatgccgacaatacttctaaaactccatttgattttaaaaacacagttataaccggaaatacccgtatatatgcaagatggcaggttaatgctgagtatgcggcttcagagattactatgccgacaaaaaccgtaggtcagtatcagaacggcacaattttgcctgttcccccaacagttttacccggtgaaaaagaaacaataaatattattcctccggatggtttttctgttgacagaattcctgtgattacttatgtgtcaagtgtatcaggcaaaaatgtgacaatagatgcaaaaaatataactgataacggagacagctcatatacatttgtatttccggaagacgtgcaaaagggttctattgaggttgctgcacatttcgagcagattttagctacgccggcaccaacttcaacacctgaaccgacattggatccgtcaaagccgaccccagctcctactgagcagcctttgggtgatcctacatattatttctcggtttcgccgtttagtgatttagatggatcagttatgaaagctaatgttgagacaggtggattgacagtatcgaaagattctacaattgcggacagtaataagaagttcgccggaagcggatatgcttatactaagactttgaagagtggaacagctactttatcatttaaggttacagggtcttgtaagatattactggatgctgtgtctgccagcggctcagaaagcagatcgtattctgtacttgattcatctggcgtaataggttcaataacctgtgaaggaggagctacaccgacgcttgaagttaatcatgccggcggtgctgatacaataacgattaaacctgacgcaggtataaacttctatggaattttcgttgtttatggcgatgttcccacacctcctccggctggaactgctacaccaaagccaacacctgaaccgacacttgatcccaatatacaatacaatattaatatttcaagcgcgattgaaaatggaagtatagttgtaaataatggaactatttcaagtgatgaaattaagtcggtaaaatggcttgcagatgacaatatacctgcagatgcagttgcagaagatacaaatatttttggtaatggaaaagctgtattaaatataaatggcaaggacgacagtaacggtacaattacgttttgggatgcggtacagtggtactatgtcgatgttgacggagttcaaactaaagtaattaaaggtttggataatccatcaattgcctttccgttctcggagcatgatccgggcggaaacgtatttagtttcacacctaaagaggcaggatatttatccttagaattattcttgaatcctaataaacctttcaatttatatgatgacacagaaggaagttatttcgaaaaggactactctccttctaaagctgagattaatacttatgttatacctgtagagcctaacttaagctactatgcttgggcaaacggatcaaagattggtataaagagcgtaacatattccaatggtattctgtctgcgaaggcaggaacaaaaattacggttacaactaaaccgaacagtgggttcaaagcatctgatgttactaccgatcctgatgttaaagtaacaaaagtgtcagataatactttcactttctctatgcctgcatccgatgttactgttggagcatcgtttgttgacagcactgctaaagaatatactgccactgctccaaagcctgaaaatggaacggtaaaattatctaagggtgctgcagaacttgcagcagaaaaagtcacagttattaattcaaccgataatttcctgatgtctgacggaaacggcggtaagtgggttatctctgctgacggtgatgcagaaaaggttgttgacgataactctgatattggaggaaatgcttcttcaaagatgaagttaatggataaagcggtacaatatgtattggcggacagcattaagaccggagaatttgagctctcatatgatttttatgatgacaatacgaatgcagcaggtcgttctttcagaacttatcttgataacacagctcatccgtatgatgaaacaacaggtcaggctacagagtttaacagtgactcagcattcttccatatgatggatgttggttcaaaggtctttgtaacaaaatcggtggatgatgtagccggaaaggctgaggcaggaattcaggttggttctgccgctttagaagcttcaaagtggtatagagttgtgataaagggagaacttggagcaacagatccatttactgtttcatattatctgcatggaacagacggaacatataatcctgacaatatttcggcaacacctgttctgacgacgtcagaagcaccggttactgacggcagagctcctcagcttgcacaaattaagtttatgaggacagcaagcggaaacctttactatgataatattaaacttacagcggataatggaaaagctgaaaccgatggatttactctgaaagcatataacggagaaactgttaatattgaagcgattcctgacagtggttatgatgtacaaagtatggaagttgtcgattcagctggttcaaatgttgatgttaaaaatagcgcatttgtaatgccggccagtgacgttaccgtaaacgttacatttggtaagggtgcgccggcaacagcaacaccttcacctttgccaaccagtataccgggaccaactaatggacctgagccaactgtagatcctgccggggaaactagtgcctgggaatatacagttgagaattgcagttctttgggcgaagttgacgccaatggaaaattaaagataacaagtaattcaaattataatggtatgactatttacgctagtccaagcaaagctattgagattgatgtcagcaataagacttttgacgacggcgaaaaatattcaggaagattaaaactcggcggagccggaacaattgatggagaaaattcaagcagggccataagttttactccggataagtttggaacagtaagtatatactttgcccatgcgtccagtcagggcgctccgcgcgtaatggttgttgagcagaacggaataaagactagaaagagcgtagacgccaatactatgtcgatatttacggtcagcgtttatccgggagctccggtatatatttacggagaaggcgcattgaacatatatgcggttaagtatacaaaatctacaatggaaaacccgccgacaatgccgccggtaccaacctcagcgcctaccaatgaacctgaaccgacaaatgtgccgattgaaaaaccgacaaccgctccggagccatctgcagatccggttgttccaactgcggagcctactgctgtgccaagcgaaaaaccaacagaaggaccggcagcggagacagaggttttatttgaaagcacatttgctaacgaaacagttgggacagtaattgatgcttcaggcgatagtcttggcggaatggcattagacactatggctgaaggcagtacaattgagattgttaacggcgaggaagcaggcacagatgtaaatgtagctaaaatattaaagaaatccacgcctgcaaagacagatcagataaagttattctggacacctgaaaatggtgttgaaataacaaaacctgttattatgacagctgttgttaaaaatgcaggagcaaacgttggtacagatatgtgggggctgtatgcaaattcagccggttcatcagtaaactatactgacaaaaatggcgtttcaaaaacaacgacagttatagcacgtattggcggaaagggtacagttttaaaatatacggcgtttgaagaaccaacttcatacagcggtacatgggcttatgacgaatggcttacaatgaaagttgttattgagcctcttgaaaataacagttataaagtaactgattatataagccaaggtattgatacaaaagattttaaggagctcacaagcagaacaataacttctgaagacggagagtttaatggattgcttacaaatgtaggtttcctgtcaggtactcaaacttcagccgattcatcattctatgttaaaagttataaagtagagattgaaaaatagaataagcatataatagcatagaaataaaacacctgtgcagtaaatatgatttgatatcattatttgctgccaggtgtttttatttatttaatgtaaaatttttcgagtatttctgccgcatctcctactaagtcaacgcatgggcgttttttataatattcttttgagcgctctgacggaatatggctgtcagcctcacctctctttagatccaatcctaataattctctgcatataatagaaccatttttttctttaaactttccggcgcattcctggacgcgtttatagtgttcagttttctccgcaaatgcttttggattagaatatccaaaccttagccctaaaaccataagcatgcctgagacagtgccgcaaacttcccgcatcctccccattccaccgccaaaggacgaggagattagcatggcagttttaaagtctatttctatatcatcagaaaacgctcctaccactgcctgacagcagttgtatccagctttaaacagtttcattgcttcttctcttttactcatttcttcctcccgattataaatagtaattattataaatataacagaaaatttaccaagttacaatatcaaattaaaatattgatatttaaattaagatgtgttaaaatacaattataaaaataaagggtggttattgttttgaaaaagagagatagtttttcggggagaatcggatttgtgttagctgccgcgggaagtgcggttgggttgggaaacctttggaggtttccttacttagtcgctaaatatggcggcggtatatttttgcttatatatttgattttagttctaaccttcggatattcaataatgacattggaaattgcaattgggagaaaaaccggcttgagcccggtgggagcatttagaaaatttagtcaaaaatatacatgggtaggttggctgactgttataataagtactattatattaggatattattcaataataggcggctgggtcataaaatatctggttacattcataactaacagcggtccttttgcggctgcagacgggtattttaacaatttcatttcacagccgtatcaaccgatattatatggcgtaatattttcactggccggtcttggagttctgctcggcggagtcagaggaggaatagagaaggccggaaaagttttgatgccgattttgattataatatcaatagttatcgctgtatattcagttactttacctggagctattgagggcgtcaagtatatcttaattccggatttttctcattttggatttgaaaccgtagttggagcattggggcaaatgttttattcaatgtcgcttgcaatgggaataatgataacatttggctcgtatctgagtaaggacacggatattgagagaagtgtaaaaaatgttgaaatttttgatacagcaattgcgattttagcggccttcatgataatacctgcagtttttgcatttccggccggcgatacaccccaattagatcaaggcgccggtttgatgtttataactttgcctaaagtatttcttaagatgccgtttggacaagttattggaggggccttttttattctagttgcttttgcggcgttaacatcgtttatttctatagcagaagtgttaatatcaaccctgtgtgatatatgtaaggttaagagaatccctgcggttttgattgtggtggcgtcggcctgtattttaggtataccggcttcgctgggatatggcgcattggattttgttaaaatattaggtttttctattttggactttatggatttcatagcaaactctctgctgcttccgcttgcaggccttgcaacgtgcgtcgtatttggatggtttgttggtcttggttctatctctgatgagatagagctgacatcaaaatttaaaagaaaacgagtatttataattgttgtaaagtatttggctcctgtatttttaggcgttatagtgctaagcaatatattgcagatacttggggttgtcaatatatagcagtcttttgaaatttttagtaaattattattttattatgttcgaatatgagtgaaagtatttgatttttgataacaggagctttatataactgtcaaaaatgaaaaaaacggtcaaaaatacaattctttcaagcaaaataactgtaagttttctgataaatttgtgtttaattgttcttttcattgacttttggaacaaaaggctatataatgtatagtacctggctgtatctatattttttgatacagttatgaattagataaatattaaatcattatatatttttagggggaattaaaatggtaagaaagaagcttaaggctattcttgcgttgcttgtagcagtgatgtttgtgcttcaggcggctccgatgtattcttttgctgaagaatcagctaaagatgccggaactgtgactgcggagcagcagtctgagcaggcgcaggaaactgctaacgatgaaaatgaggttcttcttaattatgccattgatgaaaatggcaataaggtagaactaacagaagatgcagatactggagcagacgaggatattgctgcgacttcggcacctgaaagtgacagtttgtacaaagctgacgctgatggtttttttcagtatgatgaggaagatgttactcttgaggctgaaaatgtaatttacagtgaaacatttgacggatacaacgttggtgatactagtatccccggatgggttcttacgtcagtatcaaagagcggaagtgagaaaaaatctttagtaaaagtagataattccagcgccggcaatgctctcagactgcagaagaataaaaacggcgcttcaaatggaagtgccgcatccggtgatgagggcgtttttgcaattcacaattttgacactccggcacagggagttattgcggtgtcagctgatgtttatgtagaaacaccgggaagacttggtctatttttctatggaaagacagacgacgttgaaacagcagtaagtggagatgattttccgtatttaggacgcggttatttttgggattcaggaaaatctgatcaggatcccagcaaaaacacaccatacggtatttcaacctggagtgataataccagaacacctgataccggtgtttcatactctaccggtaaatggtatactatgagatgtgacattgataccgaaaatggtacatatacttattcggttaaagatgaaaacggtgaagttataactactaaggataagcttagtataaacaaagagaatcttgcagcttcagaaggacttgtgcaaggtgttggttttacaattatgaacgatcctaagtctcttggcgattgtcttgttaagaatgttaaactcattgataacaataacgctaagcaggacgcagaagacgtagctgccgacaaaacagctttaagtcttcctgtagatttggatgcaaataaagtaacagaaggtttttatgttccaatatcaggagctaatggctcggaaataaaatggacttcatctgataccaagattgctacaattgataatgcaaccggatatgtttcaattacacgtcctgatttcaccggtgcaggaagcatggcagtaattttgacagctaaccttgaaaagggttcagcaaagtcaacacgtgaatttaacttaaaagttttagaaaatgcccctgctactgatcaggaaaaagttgcaggcgatactaataacttggtattgccgtctgatttgaagcagacagcagtagaaaatgattttaatatgcctgttgaaggtgattacggttcaaagattgtttatacaacctccaatgatagtattgtaagtgtagataatgcaaccggacatgttactattaacagaccagcatttactggttctgatgttcaggaagtaattataacggctacattgacatttggtgcagcttctgagacaaagaacttttcaatttctgtaaaagagcttgatccgacaagtgatctcgaaaaggcgaagtatgatgctgaaaacgctctaatcggcggaattgatataaacgatgtaagacaagaaagcttttatcttggtgataagggtacttattctgcattgagctggtcttcaagtgatgagaactatattaagatagaaaagaataaggaagttaacgaggataatgaagttgtggatcttggcggttataaagcagtcgtaacaagacctgacagaaacgcttctccggcaatagtaacattaactgttacagcaaccttaaacggacaaacggctacaaaagactttactttaagtattactcctgatgacgctattaaagcatatcccggagttgaaggttacggagcatattcgaaaggcggccgcggaggtcaggtttatcatgttactaacctggatgccgatggcgaaggttctttaacatatggactggaacagattagcggtgcaagaacaatagtttttgacgtaggcggagtaattgatcttactactttgggaagacctatttcaatcaaaggtgagaaactttctaacgttacagtagctggccagacagctccttatcctggaataacattaaaaggttatggtataactgtaggaagtgcccatgatgttataataagaaacctgaagattagaattggtgatgtatttaaaactggcgaagttaaccagtctgacccgcttagtatcggttcatcaaaacaagttattattgaccattgttctctgcaatgggcgattgatatggatttccgtgtaaccggcgaacatgttacaatctcaaatacaataatggctaaatctctaaaggagaattcgcctcatgaaaaaggcggacactcctatgttggtatgattaatgagggtgctacaaaaacatcctttattaaaaattacttgggagatagtactcagcgtacaccgcgtataactgatgcggattggatagacgcatataataacttgctgtttaactgcggtaatggttttgatatttacaattatgagtggcaggataagaatgccaagatgaatgtttataataactgggcaagaaaaggtcctagtatgtcaaatgctactccatacagagccggccgcggccgtgtttattcaggcggcgcaatggtttactttaaagaaaactatggagttaaggataaaacgactttacaggaaagagcaacaaacgcttccggttcattccattatgtattagactttggttcagagaatggtaagccgggaacaaattatgacttgagtaatgttacctatgaagaatggaataacaatcctgcttcatatgataatgaaggaaaaattgccattgcggcaacattgacatatatgaactatcctttccctgcacctagaggaaatgttttagcatctaataagcttacaacatatgctcaaagtgataatggaatgggtgcaacaagaccggcaagggatctgtatgatacaatggcaatggttgaaatgcagaatggaacatcaaaaagtaataagcttacagctgaggaagtatctccgttctttgaagaactggaaagaagaaccgggaatgattattcagaatataaaactcagcgtgactggaacacaaaagaaggtgaaggacctgttcttaaaggcgcttcagccggagctggccaaactaaacctgtacattgggatgatttcactgatgtaaataagaatacaaatcctaatgcttccagcacatatcaatatacaacaaactttgaaataggcgactggtggggtgagttctgtggttcaccgggacagcaaacggtttatacactttatgacaataagtgggatcgttatgtaacaacaactgatgcgaattatgatcagacacgctattctcttatgggagaatctaaagagtatttagaggtaaagagaacagttgctgatttatacccggctgattgggtaaagaatgatttccctgaaatcgctgattttatggattcttatagagagaagaattatgcaggaagacctgactcttataaaatcgcttgggatggcatgggagatggtattcctaactggtataaagagtacagaggctggagcacttctaagtatttggcaacagagattaatcctgaatccggatacacatatcttgaagaatacatgtcatttatggctgacgatcaacctttagaagctgataatacaccggcgtcaattgaaaactttaaggtaaataagcttggttattctactgctcagattttctggaatacaaattacagaacaacatgtgtagttgagtatggtactgagccaggtgtttatacaaagagtgaagtattgacttatgatgaaagaacagattattatcatacctatcatgctaaaacattgattgatttgcagcctgatactcaatattattataaggtaactgctacagatgaaaatagtaacgtgactgtcgcagagtatgatccaaacgatgctaatgaaaaaaatatgaccttccgtacgacggtggcgcctgagggagcaggagatttgcttccggataagcctgttattacaaataaggttccatatttgaagcaagttagattgaattggacaggaaacgttgctactgatgaaagttatgagatttattacgatacctcaaaccacggcagcgactatacagcatatgctcataaacttacaggtatagacgccagaaccaacaaacaagttgttgggcatcttgaaaatggaaagacatattactttatagtagttgcagttaatgacaacggtaagacagcatctgatgttgtttcagacacaccgagcagtcagttgttaaattatgactttactaagatgtctaaggaagaacgcgacgcatttatgaaaaatgagtatatgtatactcttggcggaagcgtaacaatggctaacgacccggataccggagagtattgtctgcagttattggatgagacaaactcacatggtgtaaatgcagataataagctgaatgtaacgcaagatgataagtttacttatgaaattaagatgaaaattttatatcagaagcaaactgacgctcttaacagacagggtgattttagtaagaagggtgataaatcacagataacaagtgatgcgtctgatgagcataacactgttcagctgaacttctataaggattctcttgtaaacgaggataaggattctacaaattctgcattgtgggaatcagcattttctattttcttcgatagcgaatcaagtcctgtttcgagagagtttgtagttaataagtggcagactaatccgccggacgaaggaagctggagatttgacggaacggttgagaatccgatattaaagtttaactcagacgaagtcggttcttatagtataggaaaaactcctatggcaagtgaaaagaaaaatagagtgctgccttctaataccggatattcatctaaatattatcaatttgatacaatagccggagacgcagtttactctgatattgcacaaaccggaaagactcttcacggcttatggtattatgagaaaggctcggctgactatgtaacttataaagtggttgtagactttgctcagaagaacattaagttgtatgctgatggaaagctagttcatggatatggtgagtttactgatgaagatatagatgattataatgttggtaaaattcagattaagtctcgtaacgatggatattcatgggttaatattgcaagtattaaagcgtataacggtgatggaacagattccggaaatatagacgtaaaacccgttaatcctggcggcggcggtggcggaggcaattatgctacagctacacctgctccaacagaagatccgagtgttacagaggcaccaacagctactccagcagtaactcagaatcctaatactaacaagtattttaatgatttaaatgattacgagtgggctgttgacgcaatcaatactttagctgagaaaaacattgttaacggtacggcagacagagtattttcaccttcttctaatgttaccagggcagaatatgtttctatgttaatgcgcgctttgggtgaaagtgtatcaccggctgaagaagttccatttagtgatgttgttcagggtgaatggtattatgagcctatagctaaagctttaaatcttggagttgcaaatggatacgaggatggaactttcggaataaatgaaaatatttctcgtgaagatatgatggttatggcttatagaacattgaatgctttgggtattagtattcctgccaataagccttacgcaagtttctcagaccaaagcagcataagtgactatgcggttgaggcaatagaaagaatgtactgcgcagatataattaatggcgttggagacaatatgcttgatcctaagggagctgcagaccgtgctcaatccgctaaaatcatatatggattattgaagatggagggaactgttaatgagtaatatcaaaagagtaatttcaatgttactggcagctgctatgattttaagtatgtctactttcgtagcttttgccgaagattcaaccacaaatgaagaagctgccgacgctgttttaagctcggcagcaggaacagaacttgcgtcaatgcctaatgacgacgttcagtatgctgacgcttataagtttgactattctatgggcctttttgaaatgctggaggatggttattggcagaacgaaaaggttactagagcggaatttgcaacaattgttgcaaaaatgcttaaggcaaacacagccggatatccgagatacggcagctcaccatatgttgatattgacgcgtcaaactttgcatactcatcagtatgctatttgacagaaatcggtatcctgagcggtgacggaaattctgagtttagaccaaacgaccctattcttgtaaacgaagcttcaaagatgattatgtgtgcacttggctatcaggacgcttgtgaaattacaaacggcggatttcctaacggttacacaacgtttgctttgagacagggcatttataatggtctgagcttgagctatactgattcaatgacagctatgcagatggcaaagatggttagaaacgctatggaagcatatttgatggaaactgtagtttacagagcagacggtacagcagatgttagagtaagcgattcaaaaactttgcttactgaaacatataagattaaaaatgaaacaggttatgttgaaggaacttacttctcatatttgacaggcagtgaagttgacctggaaaatgaagtaataattgatggcacttgctatcagttctcagataattatgacatggaatctcttcttggatatgaagtaaattattattacatggaagatgtttcaggttatagaagagattatattgcttactgcgagccaagaaaagataagaataaagaatatgatataatggcaaaagatatcgtttctttaacagctgataagattgtttacactgattcaaatgataaagaaaagactcttacgtttgatggttcaacactgatttcttataatggcaagccttattatgagcttagcgatgtatcaacagtaataaaagagggtcatgtaaaggttgttactcatgaaagcagtacgaaagccagcgctgtaatgattcaggaacaatttgacggattgtttgacagatataataagtcaacatatcaggttatattccaaaacagtatgacagttacacttcctgagttaaaatttgatacttcttatcatacaagactaactcttgatggcaaaacaatcacacctgaagaattattgaaaaatgatgctataacttattgcgtaagtaaagatggacagtatattagaggttatgtatcaagaaatgttgtttccggaacaatcagtacaacaagaactgagcagtatacagccggagagtataaggttgttacacttgcaggtaatgagtatatagtatccgcttattgtgtaaaggatataacatcaggctttacaagtgatttccaaatcacttatgatggcagactcttaggtactaatacttcaacatcaaacaatggtaactacggttatttaattaagtttgctgccggcgatgatgtttttgaaagtaattttagggttaagattcttgataagacaggaaaaataaatgagtatgtatctgcatcaaaggttaataccaatgtgatggaaaaggatgataactcaggcagaacagatgaagctcagcagagatctgcttcctttattattaattccggagcatttgctgacgctcagttagttgtttatgaaattaactctgaaggcaagttgaagacattatacaaggctgtagatttcacagaaaattatgatgcagatgatgatttaggctttggtaaatatttcagcggtgaaggaagatattccagaagtcttatcggtaactgtgcaatagaagattctacaatcatatttgatgttccttttgtagatcgtgaccgtgatgaagattatactgtattaacaaagcaggatctagcagatggttcttatacggcagatatatatgacctgaacaggggagtagccaatgtaatggttattcaggataaagagcctacaaccttagaccaaactgctgatacattggttgttgacaagttcgcaacagcttgggatgaggaaaagcaggagaaagttcttgaagtaaacggctggtcaaaaggcgagtatatttcattaaaggttgatgatgatgtaagtcaggttgatcctattacaccaacagggactatggcaaacgacaaaaaagatatcaaggatttagttagaggtgatgttatccagtacaatttgggttcaaatggatatttgtacacatacagagtattgtttaactacacttacagaacaagcggcggcggttactttgaatcaagtacttcgcagcgtgacagacttggtgtcaataattacaagataacgaacgacaaacttatgactgtatttggtgaagtaagaaaagtatttgattactttatggttgaaagtgctaatgttgcagatggcagattctatagagcatatcctacaacagatgtgaatctttatatctatgatacaagtaaagatgagattactataggtgaaccatttgatattgagccgggcaatcaggtatttatcagaactaaatatattgaccaagcgattgacatgctggttattcagtaatatagagtgtctcataaaaaggcggcagggcttaaagcccgccgccttttataaacttatcaaataaattatatagacatatgaaaataaaaaatttatataattataaatatatatacaaaaaactaaatgtgtttcataagtgcagtatttacaataattgatgatgcaaactctgaatgtgcaaaataaaaccggcataaaatgtataaaaaagatgttatttttatgtgattatttcggcaatctattagactgaaagctattgacaaagcccgaaaaaaggagtaaaatggctgtaattagggttataattatgaggccgtggaggtaaacgtgctgaatattttgttttagaatttggaggaagttatatgaaaatcggtattacaagagccttattatatcagtactattacccgttttggcggtcattatttgagaggcttggatgcgaggttgttatttctgatacttcaacaaagccgctggttcaaaaaggcatagcggtgacagtccctgaaatttgttttcctataaaaatatataatggtcatgttattaacttgatagaaaaaggcgttgactacatattttgtccgagatttgtgcatatagagaagaattattggttttgtcctaagtatattgggctgcctgagttggttgaaaagactgttcccgaggcaaagcttcttattgctgaaattgattgtgaccgtgaggatacggcggctttgaagtgctatcttccggtggctaaaaagcttggcgtttcggctcacaaaatgcgaatcgctttggagggcgcagcagaggattttaagcggttcagagaatactgcaatatgggtttaacgctcgatgaagccgccgaggtaatgtttgagggcgccaaaatttctgatttcgcattgcctgagtttgatactacgataggattgctcggatatgtttataatgtatatgatccattcataagcatgaatataattcagaaactgcgtgagcttaaagttaatgttataacttttgatatgctggatttaagagaccttcacaaatatagagacgagtgcaccagacctatattttggacatttccggataagttatatcaggcggcaagcgttatgataaaggatttagacgttcaaggaataatacatataacagcgtttggctgtggtcctgactcagtggtgggaaaagaaatagagcatgattttgcagattccggagttccgtttatgactctgagaattgatgaacatacaggcgaaagtcatctgcagacgcgtatagaagcgttcacagatatgattaagaggaaaattcggaaggttaatgaggtgattaaatgaaagtatcttttccgcatatgggttgtgtaacaggatataaaaagctgatggaaaagctgggtcatgaagttgtaatgcctgatcctccatctcaaaagacaatggaactcggcgttaagtatagtcctgagtttatctgttttccttttaaggtaatgatgggaacatatatagagtgcgctgaaaggggcgccgaattgatagtttcatcaggcggcaacggtccgtgccgtgccgggatgtacccggatgttcatcagaaagttttgcaggagctgggatttgatacaaaagtaattgtttttgataatatgtttaatgattttaaggcattttatgaaatcgctatgctggtcaaaaatggaaccagcaacttcaaacttttgggtatagcaagattttgttacaatctcattaagaaaatggataagcttgaaaagaaaatgaaaataatgagagcttatgagattaatcaaggcgatttttcaagaacatggaaaaaaataaaaaacatgtttgataaatgcgatacatattctgaaattaataagacgtataaaaaagcgctcagaatgtttgacagcataccgatgcgtcaggttgaggaaagcaaacggattagagttggcatagtgggagagatatatgttattatggaacccactgtgaataagaacgttgaggaaattttaaactctatgggcgttgaagttgaaaacgttcagtacatatctgattgggtagaacataatttgattccgaagtggctgccgtttcctaaatcacatcgaatatttaaatcatcagataagctggcgcctataaactgcggcggccatgataaagaaaatatgggttgggtaatggattttgcaaaacgcggttttgacggtgtggtacatcttatgccttttgcatgtctgccggaacttgtaaacttaggtaaatttcctgctgtatcagaggagcttaatattcctattatgtcattatctttggatgagcagatgggagaggctcatgtaaagacaagactggaagcgtttactgatttaataagaaataaacatttcgcaaaacagaaaaacacattgaataatgtggctgactctcttgagaacgctgcacaatcagcggcaagaagagtaggtacaaaggtaggagaggttaaggacaatttaaagacttcaccgacttcgcctgagtatcaaacaaaataattataggagttatatatgaaatattatttgggtattgatattgggtcggttagtacaaacgttatcgctatggataataattataatgtttgttttaaccaatatattagggcaaacggtcagccgctggagagcgtcaaaaaaggcatgacaaaactgaaagaggctataggctgtcaggatgacgatatactaggtataggaaccacgggcagcggaagagaacttgcaggtgttctcgtcggagccgatgttataaaaaatgagataacagcgcatgctacggcaaccctccattttcacccggacgctcaaaccatttttgagattggaggacaggactcaaaaataataatcctccaagacggtatggttactgattttgctatgaatacagtgtgcgctgccggtacgggttcgtttttggatcatcaggcggaaagacttggagttcctattgaacaatttggcgagcttgcattaaccgctgaaaaggatgtaagaatagcaggccggtgtacagtgtttgccgagtctgatatgatagcgaaacagcaatatggattctcaaaggctgagataataaaaggcttatgtacagcgcttgtgagaaattatattaacaatttgggccgcgcaaagacattaaagccaccgtttattttccagggcggcgtcgctgctaatgttggaatcagaaaggcatttgaggacgaggtaggcgaaaaggttataataccaaaatattatgatgttatgggagccataggctgtgctattcttgcaaaagaatatattgaagaaaataatataaccacacctatgttccgtggatttgaacagctggaacttgagtttaaaccaacgagttttgagtgtaacggctgctctaatatgtgtgaggtcataagggtaatctcatcagacaatgaagttttggctgtatggggagataaatgcggcaagtacgccggaaccagcaaggcctcaaggcagagtgttcgttaattgcatatttggaggtgattatatggagtatacatataaaaccagagggacgtgttcacgtcaaataaagtttgatttagtagatggtaaagttagtaatgtatcatttgtcggcggatgcaatggtaatttgcagggcatatcactgctggttgaaggaatggaagcgtcaaaggttattgaaattttaaaggatatcgactgcaatggcagaggtacatcatgtcctgcccagttagcaagagctttaaaagaagctgttaattaataagaaagcgccggcacatatgagtgccggcgttttttaggggtataaaatgaaaaagagcgggatagattaatcaaagagttacgtaactatatttatgaaaactatttttatttattacaagcgctaaaattcatttttgcattttgggcaaataacctttgaagtgtaaccaaaggtttggtttttgggagttacaaattttgttttgcatacggggcacctgtagtaattatagttctttctgtctctatgaataaattctttggcttgttcaaacttttcaagaaatattctgttttcacgctgtctggcaaattcctttttagataaaaatctgtatataaatactatatcaagaattatagccatccaattcaagaggggaagccaaaacagccttgataacatagataatacaatggacgcaattataataaacagccctagtttgtcaaatccgtatctttcctgcataaagtttcgaaaactttccatattcttcacctcgtaaaattattacagttttactctaacataataaaagacgaaattcaatgaactttgtgtaaacaatttttatatttttaaaattatttttactattgcttgtaattattagcgttttgtggtagaatataccatgtgtaagcagtttatatggagggatattaatgatcaaatttacaaaaatgcatggcataggtaatagttatatttacatcaactgctttgaagaggaagtttttaatccgtcaaaaatgtctgagtttgtttcggatccgcactttggaatcggaagcgacggcctagtattgattatgccgtcggaaaccgctgattttaaaatgcgtatttttaacgctgacgggtcggaagctgaaatgtgcggaaacgctacaagatgcgtaggaaaatacgtatacgataatggtttaaccaaaaaaactgatataacgcttgaaactaattcaggaattaaagatttagagcttgatgtaatagatggcgaagtggtatctgttacagttggtatgggcaaggcggaacttgaacctcaaaagatccctgtcagtatagacggcgatagagttataggttatccgattagcgttatggataaagaatatgagattacggcggtgtctatgggaaacccccatgctgtaatatttatggatgatattgatagtttggaacttgaaaaagtcggtccactatttgaaaatcatgaattgtttccggagcgtatcaataccgaatttataaaggttattgacgaggatactttgcaaatgagagtttgggaacgcggaagcggagaaacatgggcttgcggaacaggtgcttgtgctgctgttgtggcagctgttttaaacggatactgtaagcacgacagagaaataacggttaagcttagaggcggaaatttaaaaataacttatttgcaggacggcacggtaataaaaaagggaccggctacatttatctgtgaaggagaagttgaggttccgccaatagccagatagaaattaattaataataaaggagtgttgaaattgagattaaatgagaattttttaaacgttaaagaaagttatctattttcagagatagctaaaaaggttaatgattattcagcccaaaacccggataaaaaaataataaggcttggtataggtgacgttaccttacctttggttcctgcagttatcgaggcgcttcataaagctgtggatgagatgggcgcacaggaaacattcagaggatacggaccggaacagggatatgactttctgagagaaaagattgtggactattataagaaaaatacaattcgccttgaacttgatgaggtctttgtaagcgacggcgctaaaagtgatgtcggtaatataactgatttatttgataaggataatgttgttttgattcctgatccggtctatcccgtatatgttgataccaacattatgaatggcagaaaaattgaatttttaaacgctaatgcagacaatggtttttgtcctctgccggagggaaatacaaaggcggatattatttatttgtgctcgcccaataatcctacaggggcttgttataccaaagagcagcttaaaacgtgggtggactatgctcttgaaaacgacgcggttattttatatgacgctgcgtatgagatttttgttcaggatgaaaatctgccaagaagcatatatgaaattgacggagcaaaaagatgtgcaatagagttctgttcactttcaaagacagccggatttaccggaaccaggtgcggatatactatagttccgaaggatttaaaggttaaggtaaataagctgaagctcttaaagattgacagtgatgttgttgagattaacaagctgtgggtaagacgtcagaccactaagttcaacggcgttccatacattgttcaaagaggtgcggaggccgttttcactgaagaaggtcagaagcagataatggaaaatataaattattaccgtgcgaacgcaaaagttatagctgatactatggatgagataggtataaagtattttggcggtgtgaattctccgtatatttggctgaagtgtcctaacggaatgaagtcatgggaattctttgattatctgctggagaatataaacgttgtgggaactcccggcgcaggttttggagaaaatggagaggggtatttccgtttgacagcgtttggggataaagataatacagttgaagctatgaaccgcttaaaaaagctttttggttttgagcatcagactgagcctgaacaagaggcagaagagacaaaagaagattcagaataattttatcacatagaatttgaaatcacttcatatatattatggagtgattttttattataggcggtgatggaatgaaattcagcgatatgcgttctaaagaagtaatttgtgcaatggatggtgaaagactgggttttgtgtctgatatggaatttgatgaaaacagcggtcagataaagtctcttctggttccgggctcatacaggtttctgggtgttttgggcagagaagacgacgttactattccatgggataagataacaaaaattggcgacgacttaattataattgagagagactgaagaatgaattaaatgtcgaaatttttgtcattaaactttttgcattaaggtatatattacgatataatttttatagccgaatatagcaaatgttacaaaagaaaggatgacaaaaatgttattagactatttaaaacgaggcgtcgaaacagaagcctctcaggaaaacgaagtgcatgaaattgatagagtaaatatggagattaatttgacggacgtaactcagaataagaggataaggacacatggaaactcgcaatccataccaataaacagcataaaaccaaaccccaatcagccgcggttggaaattgatgaaaactcattaaacgagctggccgcgtcaatagaaaattatggtttaatgcagccgataactgtaagacaggttataccgtttgagtatgaactggttgcggggcagcgcaggcttgaagcgtgcaagcttttgggaatggattacatacaggcaatagttatgagggttgatgagactgacagcgcaattttggcactggttgagaatatacagcgtgagaacctaaattatattgaggaggcggaagcatatttaactctgatttcagagcatggaatgacccaggacgagctcgcctctaagctcgggaagaatcagtcgacagtggcaaacaaaatccgtattttaaaactgccgataaaagtcagagccgtattgtgtgaatatggattaactgaacgtcatgcccgcgcgctgttaaagcttgagaatgaggagcagcagatgtcggctttgaatgaaataactaaaaaaggtcttaatgtggcaaaaacagaagctttagtagaaaaaatactaaaaaagtctcaggaaaataataatgaagaagagaaaaagccggggcaccttcctcaaactttcagagatataagaattttttctaacactataagaaaagctgttgatcttatgaaacagagcggtgtaaacgcggtaaccaagcggcgtgagagtgaggaatatatagaatataccattaaaattcccaaataatatagaatgttaactgtcgtaaaatattcattttattccttgcatatcaaatgaaactatgataaaattggaatgaaactaaagagacgctgagaaagcggcgtatttttataaatggaggaatagaaatggatattgaaattagaaacccgtggcatcctgatgatgcaaaacattacactactgacagaatgagaaatgattttttgattcaggacttgtttattcctgataaagtgaagctggtttacagccatgttgacagaataattgtcggcggagtatgtccgtcagaaaaggttctgactttggaagcaggacacgagctgggcgtggattactttcttgagagaagagagcttggagttatcaacatcggaggcccgggaacagttattctagacggcgaagaatatgatttgtcctataaggatggtttatatgcaggaatgggaattaaagaagtatcatttaagagtgacgaccctgcgaatccggcaaagttttatttgaactcggctccggctcaccatacatacccaacattgaagattacaatggaaatggcaaataaacgtcccttgggaagcgttgaaggatgtaataagagagttataaaccaatatattcatcctgaagtttgtcagagctgccagctggtaatgggaatgacctcgcttgaggtagggagcaactggaatactatgccgtgccatactcatgagagaagaatggaagtgtatctgtattttgaattgggagaagatgatgttgtattccatatgatgggcgaacctcaggaaacaagacatctcgttatgagaaatgaggaagctgttatttcaccaagctggtcaatacattcaggcgttggaaccaaaaattatacgttcatttggggtatggtaggagaaaatcaaaccttcgatgatatggatgatgttgatatgaaagacataagataataaattataaaaagtcagcccgttttataccggactgacttttttgttctaaattaattacttttttctataaattctttatgatattgctgcagaacttccagagtgattttggctgacatatttacaattgtttcagacaattctccaatagccccggcaggaaattctatattattataatgttcagttaccgcctctttaaaatctttaaaatttttgtgtgccataagtatctctccagtcatttttttctttaaattataacatataagtgattgcagaacaataaaatatatcaaaatatttgtgttttattatgctatcttatgtaaagcatgtattgactaggtcgaatattgtgttataatttaataaacataaaaagaaagaggtatttatatgatttgtcaattttgcggaaagcaagtaggcgacaatgataagatatgcaagtattgcggcagctctttggtgaggccggcggtaaacaataattatgatgtgaagcatgataataacgttaaaaatattgaaacgtctgaaactgagacatataaaccggtacaaagtgcaggtagaacaaacagaagacctgtcaatacaaatttagagaataatgctgatatgactgtagccattcccaaaattgacggcagggggagcggctttgaaaacagccgggcggcagaggagacaggaatttccggcaatgaatatcaaggggaccgaaacaggagacattctcagcctgtcaaaaagcaatattatagatataacccggatcagaaaacgaaaaagaatacgcgcagacaggatcagcagttttatgctgataataattatgaaggtaaaagagttaagaagccttctgcaaaaagacatccgggaaagtttataataaaagttgccggtcttgcaataatagggtttattatagggttattgatatacatagtttcagcaaacgcttcaaattggtttaaaacaaggagtaattcggctgatattccagcgtcggcacccgctgcaactgtaaaaccgaaaagcagtaatggagctgcctcagatacaaaatcgagcggtgataagtcatcggccggaaatgacaaggaaaacaccgataaaaacacacaatccggttcagactcaaaaccgaaagatactactcaggaaaaatctactcaaagaactgacaccgaaaaaaagactgatagcggggaagagaagaaaactcaacctgcagacagcagagaagaagacacgaaaaaggcggaggagcctgtagaagataacattgacgatgccaaaacaggcgacgacgcaaaaagtgacaccggcaatgaagaaagcgctgagaatgctgaatcgggtttagaggattaaaataataaattaatagtttaagagttataactgcatatttaagtaatagtgctaagtatttgtcagtcggatgttataacaataaataacattgaccataaaaaagtatttaagccgggcatattaaatgacttgaatattaattgtctaaattattagcgttacataaattggatttgatacattgatgactggagtttctcagagacctcagcgacagcggttggagaattggttattcggagaactacgatgatgtgataaaagatagtttaagtttttaagcaaacaaaataggatatgcaaccaaaattgcatatcctattttttaaagtaatattagcgggacattataaatagaaaactatatacaaacaaaataaccaaagcagaagtaaataatgggtaaagaatttgtgaaaagtaaagtgaaaaaatatattgacaagaagggtaagaatatgataagataataaagctttcggctgaggcaagaaaagctgaaagatagaatactgtgagagtaaaaaaggaagtatgtgatattatggtgatataactataacacaatttatgagttttccgtattctttttttctatttgtaacacatctattgtaatcctacagtttttcggtattatatagagtggtttcacttgacaaatttgagtaaatgctgtaaaataacacatgcagtttttgtcttttgagtgtaaaaagacaatgctgccttaaaagttaaaataattaatttatataagcatagcaggagtaaacagattgtttttaagttagagggattgtatattcttgctttgactacaacaaggagggtttaaatgaaaaccttaaagagaacattagcaatggtgttagctttggcaatggttctgacagctatgggtgtgactgtcgtttcagcggcgtcatacagtgatacgcaggggcattgggcagaaagctacataaacacatggtcagacaatggagttatacagggcgacggaggttatttcagacctgacgacgctatcacgcgtgctgaagtagctcaagtaactcaaaacgtgataagttatgttaataaggctgccaatacatttactgatgtatctgcatcagattggtatgctgacgctatattgaaactggcagctgccggagctctcacgggaaatggtgatggaactatgtctccaaacaactatatgacgcgtgaagaggcaatgacaatgcttgcccgtgcatatggactcacagttgagaattcacaggccggtattacccagtatgctgattatcagaatatttctgattatgcaacaggatatgttggagccatgacagctgaaagttatgtcggcggttatgaagacggaaccattcgtcctaaggattatatctccagagcggagtttgttaagattcttgacaatatgataaagctttatattaccgagcccggttcatacggaagccagtacgtcggcggtttggttatgattaagacaggcggagttaccttaagcggtattatcgctaagggaatggtagtatcacctcaggtaaacggagatgttactattatgggttctcaggtttcaggaaatattataaacttgtcttcaacagcgaacgttacatctaattcaggaaatgttgtaagccctaacgcttcaagcaatcctaatgtaattattaacggaaacaatggcggaagcaattcaggcggaggaacaagcgcaaacactgttactgtaaaattttattacggcgataattatggtacagttaaaacaaagagtgtaacaaaaggaaagaaattgtctcagagtgctattcctactcctaaagagagtaactgggatggtctttggtatacttcaaaagctgcagctgaaaagtgcagcggtacaacatttgacccatcggtttcagctgttaacaaaaattataatttgtatgcaggtcatataagcagttctgatttgacagacgttgaaattgcggtaggtaataaaactgattacgttaacgtatatgtaggcgatacattaacggcagcaaatcttgctccggcagctgctaaaaattatgtttcttatcagtggtacagagcttcagaaagccatggaacaggtgaaaaaatttccggcgcgacaaagagctcatatacagccactgaagctgataagggcaagtacttgaaggtagtagttacaggtgacggaaataaatataatggaaccatttatgatgtttcttcattagttttggcaaaggatgctccttcggtatatcctgaaagagttacagtatcttatggaaacgacgcgtcaaccacccttaccctcagcgaaggtatgaatgtaaccggagttgcagatgagagcggaaagatgctgaacgctgaacagtacacatataatcaagaaactggaaagctgacaatttcgaaagattattttgccggattaacagatggattaagtgcgttcacaattattgtatctgaagacgctgtatacaacccaatgtttatggtttctattaccggaggtcctacagcaggtccagtgccgacagaggaaccggaaccgactgctactgttaatccttcagaacctacagagggaccgacagaagagccggtagcaacagcaagtcctgaaccaacagaaggtccgacggaagagcctgtagtaacagcaaatcctgaaccaacagagggaccgacagaagaacctgtggtaacggcaagtcctgaaccaacagaaggcccgacagaagagccagtggtaacggcaagtcctgaaccaacagaaggtccgacagaagaacctgtggtaacggcaagtcctgaaccaacagaaggtccgacagaagaacctgtggtaacggcaagccctgaaccaacagaaggcccgacagatgaacctgtagcaacagctacagcaagtcctattccttcggaaggtcctacctctggtcctgtaaccagtgaggtttggaactttaatgacattgccggcggaacatcttataataccggtgatacaataagtaatgcaaacggcaaaaatatcatagtaaacgttgcagaagctgataccattatgccaactgtaaaagtaagagctgacggggataattaccttgagtttaatgatacaactacagcaggaacagcaaagcaggatggttggtcttatgctgcagaatcacctatggatggagatagatttacagctgaattagatttcaaaaaaggcgatactttaaaagatactatattaatgagattttttgatactaacaacgctgatgcaaacaacacatattccagcgacggacgtgtgtttgaacttaaaacagccgataaaggagctcttgccattgttgactatttttcagttggttctgacaacaaggctgtaagcgtcccaataagcggatttacttatagtccggataagtggtatggagtaaaagtagagtatacaaaagctgacaatatagtttctatctatacaaagaatgatggtgaggcagattatacgcttagaagctcaattgagcttggaaatacaggcggaactaaaaaagtggatacagtgcctcagcttgcaataaataaagttggcgcatatactcccggcggaggaagcgcagttttgggcgttgataatatcgcattcaaaacaaaaacatatattcctcaggatattaatgtaacaggcaaagcctacactatattctcaaatgatttgaaaaacagccttgaaccatatgacaattccataaatgctgttttggctttcacaaagtccggtgagtctgaaccgtacgctacagctgttcctgacgcagatggtaactataacgtttcactgtttacaggagaaacctacgatgtatctgttattagcggcggagatggatatactttttctccgaagtcaacatcgtatagtcttccggttgtagttgatgagccaagcaaaaatgttttgtttatgaaaaacagagaagcggtgccatatgctgatactgtatatgttggatctgacaaagagtataaggatataaatcaggcaatggcttcaatccgtactatgacaggcagagttaatgaggatttaacttcaaatcctgtaactatagttcttgaccctggaacatattatggtcaggtaatagttgatgttcctaatatcacaattaagagtgctgatgaatcgaatccggcagtcgtatcaaattattatggtataggatatgtttattactcaatgggcagcaataattattatgatgctgattgtgcagctgcaaaggatacgaagaatactgcaacaagatggggcgctactattcgtattacagcggataatttcctggctgagaatattgattttgaaaatacatttaatcaatatgtaacggatgctgaaatagctgacggcgttgaaccgggcggaccggataaaaagaattttacaagaaagaaaggcacaaaagttactataaaagactctactgaaagagctgctgctgtagcaattgatgcagataacgtggagttctaccgctgcaagatggtgtcaagtcaggatactttgtataccggcggcacagcttatttaaaggaatgtgatattttgggtaatacagattacatttttggcggtaacagcgtagtgtttgaaaattgtaatttaacatggtatggttactcggataaggcaaatggcggttatatttcagcttgtaaaacaagttctgaaactgacccaggatacttcttcacaggctgtacagttaagaacagtaatataagcggtatgaaatttgctcccggcggtttcggaagaaactggggcggtgcaagatgcgcagttttctttaatgacgttactttagacggagtctcaaaaccgaacggctggacaaaaatgggcggagagctgagtacatcgaaactttatgttaactatgtacataatattaacagcactacagatttgactgctgatagggataatccaaatgataaagcaacagaaattccaagtcctgaagattatttttatggatggactcctgttcattatgttgcagcaaactaaacgtttaataagatttgaatttttatattatataaagtaacaaaaaaacggttggagcaatccaatcgtttttttatttgatgaactataattaaatacataaaatttttattaaaaataaaataatagacagaataattgcgttaattatttaacatcgtagacaaaaaactacagatattttataatgaattcaaatttttttgcatggtttaacctcgatggcaaaaataccgttattttaaacaaaatattacaattatataattgacaacgagtgcaaattatagtaaaatgtttaatatatatgaaagtgactaaagttttttacagatttattaccacatttattgaaaaataataataaaatataataaggaggggttttagatatgaaatcctttagaagaacactggctttggtattagctgttgcaatggttttgaccactttcggtatgactgttgtttcagcggcacagtacaatgatacagagggacattgggctgcaagctatattgatacctggtcagggtatggagttattcagggcgacggcggctatttcagaccggacgacgcaataacccgcgcagaggtagcgcaggtgactcaaaatgtaataggctatatagacaaggctaacaacaaatttacagatgtgtcagtttcagactggtttgctgatgcagtgctgagacttgttgcggccggtactctcaccggtaacggagacggcacaatgactccgaataattatatgactcgtgaagaagcaatgacaatgcttgcccgtgcatatggtttgacggttgaaaattctcaggccggtattacacaatacgcggactaccaaaatatctctgattatgcaacaggatatgtcggtgcaatgacagccgcaggatatatcggcggttatgaggatggaaccatacgtcctaaagattatatatcaagagcagaatttgttaagattattgataatatgattaagctttacattacggagccaggttcatacggccctcagtatgccggcggaatagttatgataaagacgggcggcgtaactttgaatggaatagtcgctcagagtatagttatttctcctcaggtgagcggagatgttactattacaggttcacaggtttccggcagtgttgtaaatatgtccagaaacgctaatgtgtcttcaaatataagtaatgttgtaacgccaaacgctacagcaaaacctgataatacatatttcagacccaattcgggcggaagctcaggcggcaatgtttctccgtcatctgatgttaagcttacgttttatgtggattcaaaactttatgcaacaaagactataacaaagaatacttatttgcagaaatcaaacagacctgaggagccgtcaaaacaggggtttgactttgttggatggtatttgtcgcagaatcttgcaaatgacgcagaaaataatgaagcttatgattttgacagcaagagaataacaaaatctatgaagttttatgccggatttgtcagcaacggaagtccaactgctaatcctgaaccaacagcaactccaagttatgaacttgagtctgttgagatagacgatcaacctaacgtatatgttggcgatacattgacagcaaatgtgcttccggaagcagccaaagaatatgtagtttatcagtggtatagggatataagcaccgaagcttttgaacctatagagggtgcagattctgaaacttatagtgttcaggaagcggatcaaggacatattttgatggtagtagctactgctgcagcgccgtacaccggtgaaaagtttgcagaattagcatatccggttaaaattaacggtacagcttcaatagaaccgcaaattgtaaccattgattcaaacgatacagaagcatcaactgttataaaatttgctgaaaaagacagttttgatggtgtgagtttgtccgataagccattgagcagcaatgattatgtctataattctgatacaaatacattgacaataaataaggattatttgtcaggattacaaaatggtgtttatgattttgttattaacacaacaaacacggatagtgataatcctgtatttagggtagttattgagaatagtgttgtgccaacagctgttccggaaccgacatcaacggtaaagccggatgaaccgacagcagagccaacagcaacggcaaaaccggaagaaccaacgccaattccaacagcaacggcaaaaccggaagaaccaacaccaattccaacagcaacagcaaaaccggaagagccgacaccaacaccgacagcaacagaaaagccggaagagccaacaccgacaccgacagcaacaattggaccggatgagcctactgcttcaccgacaatggctccgactcctaatcctgtttatatgtcaacagttagcgtaactggcggaacggcagttttgaaacagccaaacggagagccgtatccattagctaaaggtgttaattataaaattgatgggacaaaaacatatcagccgggcgaagaagtttcagtgggtgaaaagcttaaggttacctttggaacagctgatgatataaaagataatgtgtttaacacggctgttgttgagcctgtaatgattggaggcgtaatttatgacgcgacatctacaggaactcagaatgctaagaattattcaagtgcagataaaggatcaaacggaaccccggacagtcctccaaacggcggtgcattctatatctttaagcctgctgcggacggacgtgttgaagtagctataggctggggacagactaagcctctcagtgtagtaagaattacggaaaatggtgtatcaggtgaatacttgactgacgctgtgaacggaaaagaatataaccatttaaatcctcaaggagagggtactcttcagacaacagtaacatttgatgtgacgagcggtgctacatattatttgttccttgatggttcaaagccgaatatttatggcttcagctttactgaattgccgatagacacaacaaaatatttagtacagcagggcgcagaagttgttgttgacgcagtatcggatgatgcggcaaaatatccaaatgtaaaagtagtggctgaggataaaacagatattgcaacggcaggcggaaagttcattatgcctggacagaatgttgatgtaaatgttacgttcggtgatactcctgacccaacagagcctccggcaagtcctacgcctacagctgatcatgatcagcctacaccgacagtggctcccgagacaccaactccaggaccgccgaccattcctccggctacatttgagccaacccaaactcccggtccttcagcgaatccggaaaatgttttaactgttgacggttcaaaggatacagatgaagctcaaaaaacttttaagactgtttcagaagctttggtatatgccggaaagctaaacaatcatgccagcgaggcggacagaatcgaaatcaatattgttccgggcacttatcgtgaacagcttgatataactgttccttatcttacgatgcagaagatggatggcacagaaggcgatgttctgctgacatggtattacggtatcggatacatgtactacagcgcagatacagacggatattacagcaaggaagcttatgagagaaataaggcgcttggcagagacgctcttaatcaggcagtagcaagatggggatgttcaacgcatttgaatgcgggcaacttcattggtaaagatttgatttttgaaaattcatttaacagatatgtgacagaagaagaaattgatgacggtgttaaaccggcaccggttggaggagtttacagcgacaccggcggtaagcctgaaagaactttagaaagcgatgtatatagcagatcgtttactgaaagagccgctgctatagcgatagaagataacgataaggttgaattttataactgttcattcaagagcagtcaggatacattgtattcaggttctaaaggaagccgtgtatatttcaagaactgtacaatagagggacagaccgactatatattcggcggaaatacacttgtgtttgacaactgtaactttaattgggcaggatattcaaagagcggcgagacagccggaggacatgtgactgcctgcaagaatgcttccactaagtatggatatttgatgtggggcggaaaagtatcaggtgcttctacagcaaatgctaattttgcccagggtgatttcggaagaccgtggggcggtaaagattcaccaacagccgcaataggtgttaaaattgataatataactgttggcggagcatctaagcctgctgttatggattcaggatggggcaactggtcgacaattgctaaagaatccggatactatgaatatggtacggttgacgcttccggcaatccaataaatcttgataagagaaattgtctcgttccgaacgaatgggaagttctcgctatcaacccttatgattatttaattagagagggcgatgactgggatccaatggctgcaaagacaatgtggggaccggtaaaagagaagataaagacattagaacttcctgagagcgacacaatcaagaaattggattcagattcatatgaggtatcaggtgactttacacttccttcatttattgaaggatttgatggttatgatgttcactttgagtctgagagcgagtatttgaatatcagtgaaaacggcgaagtttcagttataagaccggttagtgatacaataccggctgagattactgcttatatcagacgttctgataataagcttatcggaacttccaagactataaacataactattactagagacccgtcaattgacccgtcagtgtttaatgcggctatgcaggctgcaaaggacgctattgattctaattatcaggaaaaagctgaaaacggtgacgctgtacttgacagaactgttgttattcctgaaatagattcaacaggtgacgtagccgttaaagtttgggctgaatattcaggatttattaatgatgacggaacaataatcagaaacccatacggagaaagtaatggaataggaaatgtaacttatactatccaatgcgtaaaggggtcgacattgctcaaagaaactgtatcatatgatgtatcaattcctacggataaagctgatatattgtatgctgattttgagaacaagacgacgaaaatcggcggaaacttgacagctatcggaggaggaaataactccggatatgcagttacaaatccgtttgagacagcgtttaatattatgcctttagccggtggtatagttaaggtttcatacgatgtctatggaaacacatccggcgttgtaacgcttaaagaccaggcgggagcggattatttagcaattgttcctgaaggtcttgaaagcggaaagtggaatacagttgaagccgttattaatacaactgataatactgttagtgtaacagtaaacagcggaaccccaactgaaactaccgcgcagacagcaataaccgaaagtaacagaatagcgtcgatttcatttgctgaaggcacatatgacaatattgctgtagcggcaaatactgataagtcaaaggcttattcaacattttggaaagctgacccgtcagaggtaggaacacctcagggcacatacctcatgagaggtcttactattctctattcaccggataagcaaggcaacggaggaacagttgacggcataaacttcccaatgggtctgtcaagcggctcaaataacggctcttggtcaaacggagttgttcctgacggaaagaacggactgaagtttgttgctcccggagacggaacatggacagtatatgctttaccaggaagcggaaagactttctatatgggaaatgccgagtcaagcgttagtcttccgggaaccaatgttgctgtaaaacaagatatagccgttgaaaagggtaaaacatattatgcaacagttgccggctcaaaaggaaacttcctcggttctaaatttacagcagcggttgaaggtgaagacgctgtagaagtatatttgacagctacttgggatttccagaaaaacaatggttttacgcaggttgtaaacgctggagaatcatatgattatacagtgaaggattcagagaatgcaggcaagaccatgacaataaaagctgacaccggaaaattcggcggttcagaccatggcgattggatagcggtaaacccagaggttactctaactgttccggttgttaacggaagcgttataactatgggcgacacatattatggaactgagcagtacacaataaacggtgaaacatttacaggcggtaataagtcgtatacttattatggtttagagaaaacaattgatattgttttgaaagttggaggattttatcgttctgtttcaattgtttcacctaagtatccgtcaacagaaataccaacggctaagccattgatggaaataaatggtatgattacaggattgacagctgctgacagttctgccgaaggaattaaactcattggaaaaatgggcggcgagctggttgctttagatattaaagacggaaagtttactacaactcttcaagcgggcaagagtattgatgttaccggtattttaggcggaagcagcgcatatacaattcctgctgacacgaaaataacatctgataatgctgcgccaactataaacgcggttgcagttgttgctgaaccggcagcgggaagcagaacatacaactttggggacggcagcatagttccgcagtcaactgcaattggatttgataccttagtagctcctgacggactgcttactttcagaagcgttaagttccatgatactcagcatggcgttcagcagagcgcaggcgcaatgacagtagagattcctgttgctgaaggcagctctgcaatcgtatttaaaggctgtgcttatgcttcagcaacaattacagcttctactgagggagtggctcctgcttcggcttcattaaagaccgctaacgatggggattcaattgagtttaactatagcggtgaggctaaaacattagtatttactattgacagcggttcaatatatgttcatggcttatctgttacaacaaaagatgcgtcagaacctaccgcaacacctaacttaaataagacggttacatttagtttaggagagacgggtgcagagggtgatgctccggcggctgttgaaatggcggcaggtgcagaggttgaaattcctgtaaacagaactgtttatcttgaaggcaagacattaacaggttggactgacggaacaacaactgttgatgttggttcaaagtatacggttcaggatgatgtgacattaacacctgtatttgttgataatacagcgtctctgtcaggaacggttgtgtatgatttccagagacagaacggaacacctacagttcagtggcagggtgttagtaatttcttagtatatcaagcagtaagcggatccgacaaaatagatgtgaaattcgtagttgatactacaagcggaaagtttgctaatggaaattggacagattgggcacaggttaatacaggaactaaatttacggttcctgtagttgagaatagtgttgtaaccgttaatagtatttactcagaagagggaacatacacgattaatggagtaacaaagacaggttcaaaccagagtgaaacaatgctggcggcaggaacgtgtgatatagttgcaggaagtccaagcggaagctactggaaatctgttactgtaacatatcttgaatctacaaatcctacagcaacacctggagcaacagatgaccctgacgcaacggtatcccctgagccaagtataactcctgagccgagcgcaactccggcttcaaataagactgttacctttagtttgggagatacaggagcggaaggagatgcaccggacgccattgaagaagcggttggtacagaggttgaaattcctgttaacagaacagtttatcttgagggcaaaacattgacaggctggactgacggaacagatacttttgatattggttcaaagtatacggtacaggacgatgtgacattaacacctgtatttgctgaaaacacagaagctctgtcaggaacggttgtatacgatttccagagacaaaatggagcacctacagttcagtggcagggtgttaataagtttttggtatatcaagctgtaaatggttcagctaaaattgatgtgaagttcgctgttgatacaacaaacggaaagtttgctaatgcaagctggacagattgggcacaggttaatacaggaactaagtttacggttcctgtagctgagaatagtgttgtaacagttaacaatatttactcagaagagggaacatacactattaatggagtaacaaagaccggttcaaaccaaagtgaaacagtgacggcggcaggaacatgcgatatagttgcaggcaatccaagcgggaattattggagatcaattacagtaacatatcctgaatctttaagcccaacagaagctccaacagaagctccgaccaatccaccggttgaaccaataaatttcacacttgatttaactgatatacctgtaggtaatatagctaacggagagacagttgccggtttaaaggccgggctaggaactgcagcagaaggcgatatatctgtagctgaggttaatggtgaaaaagttattgaagtgaaagacgcagcagcaggacagaatagtgtaacttgggaggctccgagcaatattactacaggagttatcacaataacaactgaatttactgctataaatgagagctctgcggctgatattaatttcaatagggtaaatggaaagaattttgcttatttccaaaccaaatttggaagcacaaaatcaaaattttatttaaatgccggaaacaaagatgataaactaaaactgacaaaagataaaaaatataagttagtatctgtatttgattataatacaaataatgtaacgataacactttccgaaggggataatgttttggcgagtcatgacagtgacacggtctctgcgtttactgaccttgctgcacagggagcgatttcaaatatcatgatttgtcaaaccggaaacggttatactgccggtactgtttcagctgacttatatataaattcatttactgttagtcaggaattgtagtttttgtcgtttgttttaataaaaaatatttataatagaataatttatatgatattagctattataataagtaaaccgtcagaacttttatagttctgacggttttttattcgtgttgcttaataacttaataacggaaacggaagaaggttaaggtgtaggcggactgcccaaatctctatggatcacacccgttttacaagcggagtcacgccttcacttcttaacatacaacatttgtaataaataattaaagaattattttcttaatgtacggcatttaaagtgaatatcggtagggggtgcttgtgcacacctcgttaggtgaactgccatatcacgcggagcgtgaatatacataaaaaagttttttagaatccaatttaattaaaaactttaccacggctgcgcgtcttacgcggcagatttcatctgtattgcgtattcaagttattatttgcgcattcatattatttacattgcaggctaatctaaacaagtcacttctttgtattaccccatccttcaggtgggggcatagacattgtaggcaatgacaaaacaagataacatgtataacacacttttttaagaagagtgtggccacacctaccgatgcttacaaaactacattttatatactttttattatcccataacttgatttattacttaaaattgtaagaatataatgttaaatgtttacaatgattataaaaagtatatatgatttttgcgcattattgacaagatgaattcactgtgttatattgtattaagagaaacagattatgctttattatttagatatttcgagttttaaaggagaaatataatgaaaaaacgaatttctcaggtgtataaagtttgtatacttcttattgttgtattaatgtgtgtctgcaccgtggcatatgctgtctcaacatatattgatgagggaaatacaagctatagttatcgtcttgttccaacgggagttggcaaccaaaacgattattcgagcggctctggcggttatggaggaggatacagcggctcctcggattacggcggatacagtggaggttacggaggttacggcggttacatgcgttatggaggttatggcggcaattttggcaacatttcgtttatatcaattggaattgtaatattattaattatatgtattatatcgattataaaaaataatagcaatgatgctaataccggcaatactgccgccccgtcggcgcctagaggcgggtatgttaaaccatctgtaaacccatcggttgagattcagcggacggatcctaatttttctgaggaggcatttcttgcatgggcccgcgaagtatttataactttgaatgtcgcttggactaaacaggattggaaaatgataagaccgtttgagtctgagcagctctttagagagcattctcagcaattggatgaatatacccgcaacggcactgttaattatttggaacgtgttgctgtaaaagacagctttatcaataaagtttatcgtgatcaaagttatgaatatgtagaggtaaaaatgcttacaaatatgatagactatgttaaagaaacggcaaccggaaaaattattgccggcaatacaacacatttgtgggaaatgattcatactttgacttttatgcggacaattggaacaaaaacatctgagcaccctgaatctttgagtgttaccaattgccctaattgcggagcgcctacagaaatcacctccgctggggaatgtccttattgcaagtcaattgtcacatcaggaacctttaattgggtactttgtaaatttattggtgaaaatctataaaaaggagatatagtaatgggacttattaaagctttttcaggagcttttcgttcagagcttgctgatcaatggaaagaatattttgtttgtgacagtatggctcaagagacgctgctgcagttaggacgaaaacgcattaacacaaccaactatcaatccagcaatactaaaggcagtgaacatataataactcaagacagcctgctggtagtaaatgaaggtcaggcaatgattgtgacagagcaagggaaaataattgattttacctgtgaagctggagcttatacttttgatagtaaatcagagccatcaatgctgaatggtaatttttctgaaggtctaagagaatcgtttcgaaaagttggcaagaggtttacttttggaggcgatacaggaaacgaccagcgcatctactatattaacacaaaagagatattaggaaataaatacggaactgcacagccaatggcctatgatgacccatattataaaacggtgttatatattcgctattatggtatgtttacatttaaaattactgacccgttagtgttttataacagcattgccggaaacgtcagtgacacttataacagcgaacagcttttagaacaatgcagaagtgaatttctgacagcgttggatacgtcagttaataagctgtccggtcaaggtgtgaagttcagtgagattccttcgcaccaaatggaattatctgattttatgagtaatatattagattcctcatggaaacaggggcgcggcatggagattatctcggtggggattgaaaaaatcactccggatgacaaatcacgcgctagaattgaggagtttgacactgccgtgatgcttggaaacactcaaggtgctattcaggggcgtatgactgcggcacagtcagctatgttcgaaaatatgggaaaacagtccggcggcgttaatggcggtgatataaccggcgctgtggttggaatgatggggatgaatatgatgaatacaatgatgcctaacagacaaaccgctgattctgataataagcagcctgaaatacctgtagttgattctaaaatgtctgatgatggctgggtatgtaaatgcggaaccaaaaaccatggtaaattttgtatagaatgcggagcaaagagaccgttttataaatgcggcaattgtggatgggaattctcagaactaagcagtttgccgaaattctgtccggaatgtggttttccgtttggtgaaaaaacttctgtgaagagtgattaattgttcaagttatttgaggcagcgcagctgcctctttttacgtctaattttagttagccgtgcatagaataataatatataaattttaaaattgttagattacaaggtttttttattatattatcagttatgttatttttgcacgtcgttaagttcggaacggaataactagtttaatatcgttgaaatttaatttatctcagcttaaaatgttacaaaattattgctgataaaaatttgaaataattaatagttttcgtttttatggtagttatgcaattttttaaaatattatattttaaagtttgcttataaaacaaaataagtgtattattctgatttgcggcaaaatataaaatcaaatgagaaatagtttggagagtgagtgagagaacaatggaaagtgaagcgtttgaagaacctataatgaaagatcaaaataagttgtttaatattataaaaaagaaagttaatatttataattcaactgattgtataaaatgtttgtttgagggttttctaaaatgtcattatgagacaaaatttcatggcagaccggtgactgtagaatattcaatgacgatagataataataaatatcttccatatggaataaaagcgctgatgctggacaaggacttggagatagtcgatgaatttgcagccagaaagagatttgccactgtgagcgaatgtattgtacaaatggaaatgatggcaaaagatagagttttgcctaatgatttaaaatatattatatagtttgcttatttaatattgttatagtataggttatgtattctaaagtaatattgacaacaacagcttattgttttataattatatctacaataatgagccgccggcgggcggcaataatccaatattgaattttggagtgcgaaaatatgaaacttaatgatgctaatactgttgccgcaagtaatggtgttcataaagatataaataagaaaaataatccggcatttaaatgggcgtttattataattggcgccgttgttgtggttatgttagccatgtttttcattaaaacttttgttatatcagttgttacggtttcaggaaccagtatggaaccggcaattcgggaaggggaaagctggctgattaataaaacaaatcaaaactatcagaaaaacgatataataacattttattctaatgaagacagaaaaaatgctgttgtctcaagaattatcgctgttgaaggagatacggtttatatagattttaattccggagatatttatgtaaataatgaaatgattgacgagccatatgttagcgaaaagactaaaaccggaggaaagtatataacttccttgatagaagacggaaaatatggcgccggaactcctattgttgttgaaaaagatcatgtctttgtgatgggggataataggaacaacagccgtgacagccgggaattcggacctatatctacttcctctgtttttggaattatttttaaaaaaataaaataaaaagagccatatttgaaccgacctcctaatcgttagatttttggtctaacttttggggggcatatcaatttggctctttttgttatctaaaattacagtaatatgatgtcaaaaaaatgtttactgcatataatattaagcggtattataagttgagtgtttcatattaatggataaattggtaaaaattgtttgatttttttaattaaataaaattattttattaatatatcacgaaaaatcttgtatttattctagaattgtgttattataaacctatatgggacgggatttgtataaaattggtaagccacgaacttttagggggaaacgtaatggcaagaaagatttacaggggagagtataaccctgcacataatattgttaaaaaagagcattatgaaatatttaaaaatattcagcccaacaaaaatttgtggtatttgtttgtaaaaagaactgctgatattatttgttcactgcttgctcttatttttttatcacctttatttttggcggtttctattgcaatcaaaaaagacggcggtcctgtttttttatgcagcaaagaattggtaaagacggcaaagcttttcggatgtataaatttagaagcatggtcgttaatgctgaagagatgttaaaagagcttcagagtaaaaatgaagccagcggacctgtgtttaaaatagagaacgacccgagggttactaaagtcgggcgttttattagaaagtatagtattgatgaacttcctcagcttataaacattttaatcggtgatatgagtatagttggtccgcgccctccgcttccaagtgaggtagtcatggatagtgaatacgatatgcagagacttaaggtaagaccgggtcttacgtgttattggcaatgcgggggaagaagcaaaataagttttgaaaaatggatagatatggatctggaatatataaatgaccaaggtatttggtgtgacttaaaaataattttaaagactatcccggcagtgtttaatggtgatggtgcttattgatcagaaaaataaatgggatgtggaattatgcgtattaccgttgcgggtattggatatgtaggtctttcaaatgctgtgttgctttcacagcataacaaggtgactgcgtttgatataaatactgatagagttgatatgataaacaaaaaaatatcgcctatagttgataaggacgtcagcgaatatcttgcaaataaaaatttggatttatgtgctgtaaatcttccggagacagcatttagcggagctgaatatgtaataatttcgactccgacagattatgatacaaagaaggattattttgatacatcgtctgttgaaactgttatagaacaggttttaaaatattctgatactgctgtaatggttataaagtctacggtgcctgttggatttacagagatgatgagggaaaaatataaaacagacaggctgattttttcacctgagtttttaagagaaggcaaagcgctatatgataatcttcatccttcacgtataatagttggagaaaaatcaaaaagggcggagatatttgccgaattgttaaagcagggggcagagaacaaggatgttccggtattgtttacaggttcgacagaggcggaggcaataaaacttttcgccaatacatatttggctatgaggatagctttttttaatgaacttgattcgtatgcggaaattaaaggactcaaaacatcagaaattatagaaggaatttgccttgacgacagaataggtaaccattataataatccgtcttttggttacgggggatactgtttgcctaaagataccagacagcttttgagcaatttcggtgaggttcctaacagcattatgaaagcagttgtggacgctaatgtgaccagaaaagattttattgccgcaaggatacttgaaagagaaccaaaagttgttggaatatacagattaacgatgaaaactgattctgataatttcaggcaatcatcaattcagggcgttattcgaaggttagaaagttcaggagtaagtttaataatttacgagcctgtcttaagagactgcaaaacgtttatgggagcgaaagttataaataatttagatagatttaaagaactttcggatattattgttgccaatagattttccaatgagattgaagatgtaagtgaaaaggtttatacaagagatatatataggagagattagacagagaggagaaatataaatgactataatcgaattttgggacgagctgggaattgataaggatgaggtgtcggcaagatttgtcggtaatatggatttggcagcaaaatgtactatgaagtatatagacgataacacttttaatgagctccaaactgctatggctgaacagaattacagcggaattgagatagccgctcatactttaaagggagttgccggaaatctaggctttagtgagattcagaaaatcggacagagaatggtggataatgttagagccaatatttatgatagtttggatgaagattttgaaaaacttaagattgaacagaaaaaagtttgtgagttggcaaaacagctgtagtgtttaatatagctgggaggaggtgcggctgtgcctggaaaattaaaagttttggttgttgatgacgtagagatgaataggattattctcagtgaactttttgctgatagctacaatgtgctggaggctgagaatggggaagaggcgttggaaacgattaggaataatcctgatttatccgctgtgcttcttgatattgtcatgcccgtaatggatggtcttgagacgttggaacaaataaaaaaagaggagctgataccatctgttcctatattttttgttacagcggacactagtaatgaaaccttagtcagagggtttgagaatggcatagtcgacagaatagaaaagccgtttaacccttatgttattaagtgccgtatacaaaactcaatagaactttatgattatcgtataaacttggaaaagcgtgtaaaagagcagactgaagaaatagaaagaaaatctcaggagcttaaagaagcaaatgcgtctattattgacgctttatctacggcgattgagttccgtgactcagagtcgggtgaacacgtatgcagaataaggcagataacaaaaactcttttaattgagttggagaagcaggtaggaaataagtggtatgctcatgaggagattgaaaatatttcggcggcatccacaatgcatgatgttggcaaaatttccgtgcctgactatatattaaataagcccgggaagctaactgcggaagagtttgaaataatgaaagaacacacggtcaacggctgtaaaatactggacagtatagatatgataaaatgcagtcctatgtacaagtattattatgatatttgcaggagccatcatgaacgctgggacggccgcggatatccggacggacttgttggagacatgatacctatatccgctcagatagtttctgttgccgatgtttatgacgcacttacgagcaagagggtatataaacctccgtattcacatgaaaaggcggttgatatgatattaaacggggaatgcggaaagtttaatcctgatattattgagtgcttaaaaaattgtcatatggagctaaaagatattttagataaaatggcctttgaaaacaaagtaaatttagaaattccacaatatgagaggaaaaaagtgagttcaaagcttgaacttgaaaactctgaaaattttgataaaacatgtaaaaatgataatgctgataaagaagacagttttacagttttagatgatgatgtgatttttaaatacaataaaaagaatgatataattgaattctcggaaacctatgctaaagagtttggaaaagcaaggttgattactaatgcgcagaaatttttctatgaggatccttcaatgaccccggaggagaaagaaaagttaatgaatagtgtgaataagcttaatattaataatccggttttaaattgcaggataaaagttcgggataaaaacggaagtccggtaagccggaatattagtatatatatgcactattccaatgaaaattccggtgaatcagatggatttgtcggtaaacttgtaaatagttgagtattatatacttagagataagttttattcaagttaattatactcatattgtaaatagttttatgaacggtaactaacgttttaacatattggtagaaagagtgaatatatgaagagtaggacggatattacaagaagtgagaaaagcgctaaaaacttgttatatggcgtcatttctcagtttgtcagcgttgcatttacatttattgtgagaatcgttctggtgcgtcagattggaattctgtcagtcagcttaaacggtttattcacagaggtaattgcaatactgtcacttgccgaaatgggtgttggttcggctatagtttacagtctttacaaacctcttgccgaaagggacgaaaagaagattgtaaagctgatgaatatgtataaaacagcctaccgtaatatagctttggctgtgtttggaataggtctctgcctggttccgtttattcagaatattgttacaaaggtcgatgtgtctgacggatatattcggcttgtttttgtgttatttctaactcagacagcgtcttcttatttattctcatataagagttccttgcttaatgcggatcaaaaggtatatatagtttcaaaggttactactattgttaaaattgttgctgagattattaacataattcttttatttgtttttcataattatattttatatctgattgtggaaatattgcttacccttgccaccaacatagttatttcaggtcaggtagataagatgtatccgtttttaatcaggaaagacgaacttctgaacgtcgaaaagcgaatggtatttaaaaatgtaaagaatatttttattggaagtctttcaggtaaaataactaattcgactgataacattttgatttctatcctggtaagcacttatgaggtcggtatttatacaggatattcgacattggccatgggactgagaaaacttattgaccaggttgacgccgcgacggctggaagcgtaggcaatctgatggctgaggatgaccgtgataagtgtgaccaggtgcttagaaagttaacatttattaattatttttttggttctttgtttgcaagctgtctttattgtctttcgtcaacgcttgtcaggataatgtacggattggaatatacgtataatgcagattctatgattggtctgatggtagtattttgtttgtgtgtaaactttttcttaaccgtgttaagaaatcctctttggaggtttatgtccgtatccggtttgtttgccaaggataaaaatatttctatagcaggcagtgttgtcaatctaattctttctattattcttggaataaagtttggaactttaggaattcttttgggaactttggcgtctctggtaatacaaattattttaaaaatacgtctgctttatactgaacgctttaaaatcaattccggaaagtattattttagatttatattttactctggaataggtattgttattatgcttttagcgaagtttataagcgcagaaattgctgtcggcagtttatacatagattttgttttaaaggcggcggtatccatattcgttccattgtgtatgaattatgtcttcttttgcagaacagaggaatacgtgtatttaaaggaacttatgtggaagtttgttaccaaaatgtataccgcactgacgcctgttattagccggttatataaaaaaaggccgtttggcaaggcataatattgaaaggtgttgctatgatgcggaaagataaaaaaagatttaaagtcgctatgattggacataaaagagttccatcgcgtgaaggcggtattgaagttgtggtagaagagctgtcggtacgaatggttgaaaggggtttaaaagttgacgtatataatcgcaaagacagatttggcaaagcgtataaacagcctcgggaatataaaggtatcaggataattcaaatcccaacttttaaggttagcgctttaaacgcctttgtttattcagtgctggcaagttttcgtgcgctgtttggaggttatgactgtattcattaccatgctgaaggaccgtgcgctatgatgtggcttcctaagctttttggtatacatacggttgccactatacatgggcttgactggcagcgtgccaaatggggcggcttctcaacaaaatatctgaagcttggagaaaaatgtgcttcaaaatatgctgacgaattaatagtattgtcaaataataaccaaaagtattttaaagaaacttatggacgggatacacacttgattcctaatggcattgtcaagaaaaatgcggattattctgctcgggaaataagtgaaagatttggtctccaaaaagacggttatattttgtttttagctagaattgtgcctgaaaaaggtttgcattatttaattgaggcttttaaaactgttgagacaaataagaagttggtaattgccggagatttaactccgggtaatgagtatgtggaaaaaattaagaagatggcgtctgaggatgagagaataattttgaccggctttgttcaaggaagattgctcgatgagttgttctcgaattgttatatttatgttcttccaagcgatatagaggggttggcaatgagcttgctggaatcggtgagctatggcgttccgtgccttgtcagtgatatacctgagaatgtggaagttgtaggcgggtatatgccttcatttaagcatggagatattcaggacttgtcggttaagctggataaaattttaaaaggcgaatattctgatatatggaaaaaagaaaattttgaaactatcttaaaaaaatatgattgggaaaaaattgtagatcaaacgacagcgctttataaaaaaggaaaataatttggtggtatagcgaggtgcggcgaatgaaaatattattaataaataagtatctgtatccgaaaggcggtgcagagacatatactttaaagctgggtgaatatttgagcggagccggtcatgaagttgagtattttggtatgtacgataagaataatgtggtgcataattccgcagagcaatacacacaaaatatggactttcatgacagcggagcggaaaagtttctttatccgtttagaataatatattcatttcaggcaagaaaaaagctcagaaaagtgcttgaaaattttcagcctgatattgttcatatgaataatatcaattatcagcttaccccttcaattattgatgagataaaaaagcatggaactccaattgttcaaaccgtacatgacttacaaatgctttgtcctaatcatcttatgtttgacctatataaaaagaccccctgtgaaaaatgccttaacggctcaaagataaattgtattaaaggaaagtgtatacactattcaaggattaaaagcataatcggtgcagttgaagcgtggctttacgctattaaggggacgtataaaaaagttgataaatatatatgtcctagcaggtttttagaaagcaaacttcttgaaaagaaaaggcttggcgaatatatatataaaggaaaaacagtttcaatacataactacatagaacttccaaaatttgattttgaacacacaaaaaagaattacattttattttttggcagattatctgaagagaagggagttgatatatttattgaagcctgcaagtcccttcccaatattatgtttaaagttgcaggggttggacctatggagaatgtttgtaaagggattcctaatgtggaatttgtggggttcaaaaccggaaaagaactgcataaattgatagcggaagcgctgttttcaatttatccttcaatatggtatgaaaattgtccgctttcgattttggaatcagaatcttttggaaccccggttatctgcacgcctctcggaggaatgcctgaacttgtagaaaacggaagaacgggaataattcttgaagaggttagttccaaagctttgactgaagcaataagcacgctttataatgacagagaattatgtgaaaaaatgagtaaattttgtgaggaaaaaagaactcaaatgacaactcttgacgagtatggcaggcagatagaagaaatatattccgaaattataaaaaagtaaaataactgaaataagcgcggaattatccgcgcttttaatttatcctattatagcttggccaataactcggcccattttttctcttgaaaagtttgttaaaaatgaattccttgcattttctccgatataattatatttgtcagtataaaaaatatcagagataactttatgtacgcttgatttatcttttgttataagcagaccgttttcaccgtctttaatatacatttcactcaaagtgcttggctttgtaacaattattatttttttaaatgacatggatgtcagtaaaactgtatctcccgaacatattctgccgtcgtctattggaagaatcacggctttagagtttattataaatggatattgcccgtctccggttatatcatctattaacaaaacattatcgggcaaaattttaggtttaaacgtgtctgatattataacaagagtttcgttaataccctgccaggaatccaaaagaaagttataatccctgtttgaccgtccaattgccaacacataatctgttgattttatcttttcaggtttttccgaatctttccattgaccgtacatatcgtttattccgaaagtagtaacaataaacttgctgagcggtatattaaaatcccggctgcattgatttgcgtagttttgtgacggaacgtgtataaaattaatatagtctccgctgagacaggttttcataaaccatttatatattcgtcctgaaaatcctgatttttgtttatatgtaaaatttataacaacaactttatttttctttttagtcctaaaaattctgcaccaaaagcagaataccaaagcgtaaaattgctgccagcctaaaatataatcatattggtcacgtttaagaaaatacaaaaaggttatataaaaatacattaaataacgtttgataacattaaaaattcctctgctcccccagtttgcaattatggatttacattcaaaattgaggtcagtttccttgttaagaccgttgagcagggaggctacttcgtcagttacacaatcggcaagcactatattctttttcatattatttctccttatgatatcaaactctttttattttacaaaataaatttccaattgtcaacataaccggaaagttattcaacgaataatataaaactgaaaacttttgaaaagggaacgttttttgttatatattcggagaatattgtttaagacgcttgcaataacgcctaaatagtggtataatatttaaaataaatatcaatgatttggtatttaaagaataaataatacggcggaagcagaaacgacaggtggtagttaatgagtcattttaaaagattgattattcgcgcgcctaagtatatatggtaccttttctgtttggttatattttatccaatagggagaatagcaaaagtcttattccccaaataccgtggtgtttggatagtttctgagcgcggctcagacgccagagataatgggtaccatttttttaaatatataagagaaaatcatcctgaaattaaagcatattatataattgaaaaaaaatcggcggactaccataaagttgctaaacttggtaatatcgtcaaatataaaagtttaaaacatcattttctctttgccgtttctgactataaaataagcagtcacatttttggatattcacctgatgtgttgagttacaaccgttttcagaaattgggtctcatcaagggaaagctggtatttcttcagcatggtataatagttaatgatattgagtggatgttttatccgaaaactaaacttgatttatttgtttgcggagcacgtcctgaatatgaagcggttattaaaagatatggatatcccagcggtgtcgtgaaatatctcggattgtgcagatatgacgctttaaataaaccgtgtgttctaaaaaatagaatattattaatgcctacttggcgtatcgacgtgtgtgcggtggggaaccgtgataagtttactcaatctgagtattatagaaaactccaaagttttattaataatcagaatttaattgattatcttgacaaaaacgaccttgaacttgttttttatcctcattttgaaatacaaagatttttaaaagattttcattctgtgagtccgagagtcataatcgcttcgtttaacgactatgatgtacaggaattgcttatgaattcaaaaatgctgattactgatttttcaagtgtattttttgattttgcatatatgggaaaaccaatagtttattatcaatttgatgatattcattatgcacatggttattttgactatggccgggatggttttggtccggttttgaagaccgaagatgaggttataaattatttagcagaaaaggtgaacgacggatttttagttgatgatatgtataaagcgagagccgaaacattttttgagattagagacgataacaactgtgaacgtaactttaatgcaatattgtctttgtagaaagtttggccggctcgaatcaacagacaaggagaataatgtttatgtctaatttgcagaacaggcaaaattctaaaattcttgcggcgttttatattgtctgtttcgctttggcggttgttcttgattcgggatttggaagcagtaatgcaaaagcaataacgctggttacagttattcttgcagcggctgtaatatttattacggcagattttaataatctcggcaatatatccggatttatggttgtgtatggaatatggcttactgttgtgcttgtctattcctttataatatggatacttaattttgaaacagtgtcatatatgatgaggggctgttcaaaaatagtatttcagtttataatgatacttaatatatttgccgcagcatatttgtttggtgaaaaaggcatacactatatgttctgggggctggcactgggcaatcttgctatagctttggttttggttccgcggtatccgatttcagaaatagtatcatctgtaaccgtttttctaacccagggcggaactgcggaaggatatatgaaagggttagaaattcatgatgtaacgtttacttatggattttttctgatttactttattttctttgataagataagttcaaagaagatgaaagtcataaatataattttggctttgtttttgttcggtcttggatttaagagaatcgctatagctagttgtattttaatgctgctggctgcatgggggcttgaaaagcttactccccgtgtgcagtttggtataatgaaaactatacttatatgcggagtgattttttcatttttatatttattcagcataaaatataatatttttatgatgataatggataaactcggtgtggatgtaatgggcagaaatgttttatatggagctgttgacaaatattataagatttctccgacttatattggtcacggctttgagtatgtccatatgatgatggcagaaatcaggcaggaaggcggtaaagcctttaacggcatgattgacttgcataatgattttatgcgtgtgtatattgaaatgggattttggggattttttgcctggggatggtatactctgatttttcaatataattggataaaatcaaagtttggactggaaacggtaagattattttttctttgtgaattatatatctttttgacttatatgactgacaatacattattttatttctatacaggaaccgttttgcggctgattccaatgtgttatgctcttcacattggaaatgagaacagtttgggaaaagggaagcttaaaagaaagcttgttgttttaaatgatggggaaaagagtgaatttgagattttatcaaagcgcggagaagaaagtgtaactttatataagaaaaagctaaaccataaactgcggtaagacgaaagtcttgtcattattactaagttgggtgattttattgataatttttgaaaagttaaaggaatatattaaagaagattttggaaaattcaaaaatatgaatataaaaaaatctgttttgaataaaaaagaatatatggaaaacacagctgtagttgcagaaaaagaccctgctaaacttggactttcatcgacaaaaactattgtgtttttgttatggaaaaagaagtttaaaattattttttctacaatagcatttatgctgattttgtgtgtcttttttgcatatcaaagcggaaacaccgtaaatactacaatgtctttgaattatgaggagggttctaaaggtcttaatccaaattcaacaagatttaatatgtatgagctaaaatcaaatgcggttttagaacgtgcgatacaatatttgggactcacaggagatataactcctgagcagctttcagagcatatttctgtagggaacgcaaattcaaaagctattaataccgaggagagcaattattttatctcaacaagttttaatgtttcgtataccaaaaataaagaagcaaaaaaatattctgctaaagatattatgaccatgatttgcaaagcttataatgatgtatttcacgagaattatgccgataaaaagactgcgcttacttataatatggatgatataaccgatatggaatatgttgaaataggcgatgagcttacaatattagcaaatcaaatggatgagtatttgtccggaagagtttcagaaaatggtacatataaatctgtagagacgggacagacgttccagacggtaaagagaatggtacaaaacttgctggaatatgacatttcaaaatataaatcgtttgttcttgaaacaggtcttgctaaggaaaaggagcagtttattcagactttgtattataaaaattctgttcttgatatgcagtatcaaaaatctatggcggattacagtgtgcgtcaggacggcatatcaaaatacgatgaagctatgataggaactgttatgataccggctgtcaatgagaaaaacgaatattatatgtccagaaccaatataggtattgattatctggcaaaagacgctgaatttcatttgtcagcggcaaaggacacgttaaaagaaattgagataaatacagatataataaataagttaagtgagagaactccggctgttggggattatgaaaaggctgaggaaatgctcaaaaatataaataatgagtttaaaaatatttctgagattgcacttgccacagacagggaatatattaaatataaaactaaggattatttaacatttaaaaatgtagagctatctttagttcagaagttatcacttaaaaaggtaatagctttgggcgctgtattttttgttttaatttgtgctttgttctattttatgagcaaaagaaagcttagaaataggagggcgcacgtatgagaaactttgaaattttaagatatataaaaaaatggaaatatttgattgtgattgtttgtatcttgggcgccgttctcgtttatcagtatgctatgtcaaaacagacgtatacggcgcagactgttttaagatattctaattcagaggcaagcaatggtttgactcccagcggagatagtttggatgtcagtgagatttattcgtcaaaggtaataaccagtgttcttgaggatttggatttaaataccggagctgattctattcgttctaagtgcgctgtagagccaattattccggcagatgaagagtcaagaaaagaagcgatactaaaagacggagaagaatatgtgtatcatccgactgattacttagttacgttcagcgttggaagtgattacagcaaagggtatgctgcaagcgttcttgattctattttaaaaaattattttattaattacggagaaaaatatataaatcagacagttttgccgaataatgcttcaaatattgaaagcggcagttatgattatattgagagcgcagaaatcttggatacctctgctactgatatttataattatttgtatgacaaaaagtttcattatccggcttttaggtctgcggctacaggatattcatttaacgacctctataatatgtataaagaggagctgaactataatattcctgagttgtactctaagattttaaatcaaaaagtgtctaaggaccaatcagttttgattaaagattatagaaaccgaataagccagtatcagattgatttagctaacctttcagaaaaaatagacccgctttatgctcttataactcagtacagtcaaaaaagtaaggagggtatacagtaccactatggaaagggtactgattctgataatacaagcgattatatattaaaggatgtatatgaagatgaatacaaacatcagattaatactgaaactacatatgacgcacttataaatcagtatgtttctcttgaaattgaccgccagtatacgcaggttgataaagaacacagagaagaacttttaaatatctttgaaacggctgagccggcttcaaatgctgacgaggcaataaaagagatacaaaacaatatgaaagaacttattgacagtctggataagaattatgaaattgttgaaaagacagtagatgaattcaatcaatatctaggcgcgtcaaatattacttctctcaccagtattaatgtgaacgagagaataaatattaagctttatttaatgatagctgttgtgttgttcttaatttgcggctgtctcggcgctattttgctcggtcgtatgcaggactttattgaatatcttatgtatatggacagaaagactaagctgccgaatcgtgcaaagtgtgatatgctgataaatcagtatgaagaaaaaccgttgcctgataactttacctttatacttatccgccttgatgttttgaaggcagtaaacagtcaaataggaagaacagcaggcgatactctgcttggagagtttggacagattttgcgtgagactgctgaggactacggttttgtaggctataatggaagcgaccagtttatgtgtatgtttgaaaattgcagttataaaaaggccgaaatgtttattgatgttctgacgagttatgttgagcattataattcccaaaatccaaaacaggatatagcattttcttatgctattgaagaaacaagaaataagggtatatatgacgcaagaggtttaataagcgcatcgttccgcgatataaatgcaaatacaaatattaaaagtgaaagagcagaaaattatgaagacagagatgacggcggagacgatgatggacccggaggcggagtaaatccaaagaataagtctcccaaaaacggacctaatgacaacagcacatgtgcaggcgatacaacgataagtaaaaattcacaaaaacacagcaaaaataaaaatcacagtggttcaaaaaaaagtgttgttaagcatactaaaactgtcagccaagatgtcaaaagcgatatttatacaggggcagaacagaatagcagaggagtgtataatgaggagatagttaagctggtaacggatgctgttatggcaggaataagggcggaacgtgtgtctgagaaaaaagaaactattcccggacgttcctccggcatcaaatataactcaaaaaatatttcggatagctatccttctattgagtggacggattctaagaatgataagtcgaatgtgaaatataaggctgtaacagaaacggtgtctaatgttaataaagattacgtctctaattctaaagaatctgttatgtcaaaacctgataatattaaaagcgtagatgaaccaaaaaaagatattcaggcgaaattgaatactaaagttgaacacgatatggtttctgatacctcagaaaatatcgaagaagttaaggttcttgtaaaaaaaagtacggataatattaaagattcaagcgtcatatcgaaaattgatgataataatccttatgcgcctaagctgagagtgaaaaaatcatatcggagcaaaaagtctgaggagccaaagagcttgaatcttgatatgtatgctccaaaaaagaaaaaataataaaatcagagaccgttatattggagagataagtctatgaagaaatactttgaattgttttcaaaatataagtggcgtattattgcggtaatattgataattgttctcgcagtctgtgcgtttaatttactgaaccaatctgaaatagatgtaacattttatcaggtgcgttcagataaggtttcggacaatatccgcatagtcgtgcttgcagatttgcaccttaaagagtttggtaaggataatataaggctggtggaacagattgataagttgactcctgatattatagcatgtgtgggtgatatgaacaatctgaaaaatgacgattacagcgttgtgacaaatctttgtgaaaagctcgtgaatattgcacctgtttactatgctttgggaaataatgagtacgaggctaaattatttaaagattctaatataaccaaagaccttaaggctgttggagtacatgttttagacgacgcgtctgaaatagttgacataaaggatacaaaattgaacataggcggactttctcagggaccggagcagtttgagagatatggtcatcaattttttgataagtatattgaggaagattactttaaacttttactggttcactatcccgatgagtttatgggaattttagaagattatcctatagatttggctctttgcggtcatgctcacggtggtcaggtgcgaattccgtttgttggcggactttatgcgacgggacagggattcttccccaagcttgttgatggttttcatcaaataggaaacagtaatgtgattatcagcagagggcttggaagctcgcatattattccgagaatcaataataaaccggagctttgcgttgtagatttatgctggtattagtatagggaaactggttatggaagaacaattggttagtattatagtgccggtttataacatggcggaagtattatatacttccgccaagacttttataaatcaaacttataaaaatttagaaataattatgattgacgacggttctgctgatgacagtttaagagttatgcagcaattggcagctgcagatactagaataagagtttatcatcaagaaaaccaaggagcagccggagcgagaaacacaggaatgtcacatgcgtccggtaagtattactactttccggacgctgatgatagaatcaaggaaaacgccgtggaaaagcttgtttctgctattgagaatactggggctgatatggcggtttgcggatatgaatgggtgaacggtcaagatgaatgtataatgagaaaatcgtataagcctaaatatttcagcggtaaatatattcgtgaaaattatgatgagtttattgaccgtgacagtgaatatggtatatatggcagtatggcgaacaagctgtatagggctgagattataaagaataataaattatctgttcctaaaatcagtaagagcgaagatgaagcgtttaatattttgtttctgtcaaatgccggttcggtatgttttattgaggacgtgctttattattattatatgtctgggatagttaaaaagggagaaaagtatttaaagaattatattgaaagcgttgcagcttttaaaaatttacagatgaatgtagtttataattggaatagagacaataaaaaagttttggagaaaatatgcagaaatttggcggtaaactttgatatatatattcaaatgctgtttctcgctattccaagatataaagtgtttaaaagatataaagcggtaaaaaacgttgtggaagtttttaataatgaacttccctgcagagagtttgagcctgattttagaaagtataaatatttagttgataaaaaaataatcaggctttgcattattgaggatttaaaggtaatgagtgaaataaaaaacaacgcaaaataaaacattgggggatgaatgttatgcaaaaacctctcgtaagcataattatgcctgtatataatatgggagaacatttaagaaagtcggttccgtcggtacttaatcaaacttatcaaaatattgaacttattcttgtggatgacggttcaaaggataatagtctggaagtgtgcagagaactggcggttaaagataacagaataaaggtttttcatcaggacaatcaggggtcgggtccggctcgtaataccggaataaaaaatgcagcaggaaaatacgcttatttcccggatgctgacgattgtatggtgccgaacgcaattgagtcgctcatagaaaagtttgaaaaatattcctgcgatatgatagtgtttggttataaaatgatattcagcgatgggactgaaagaaagttcaatgattatccaaacgaagtttttaccgggagttatgtgagacagaattatgacatattcacaggcgataaacgaagatgggaagttcagggtgcgccgtggaataagattttcagcctggatataattaagtcgaataatgttgagttcccggctttaagacggaaccaggatgaagtatttgtaatgcgttatgtgaattcggctgaaaagatagccttaatagatgagatattttatattcattatcccaatgatatgcggcaggcatttaataaattcccgattgattattttgaaatagtcagtagtttgaacggattcagaatgaaatacatatatagctggaatcctgagaatcgtcaggtattgaatgatatttgttcaggctttatccagagcacaacaaaaagcatgatgcttctctttaacccaaaatgggagttaagctttaaggagcggtataaaagatttaaagaaatttctgtaagatgtgtaaaagagatgccggataaagattataagtctgattctacaatgtttaagcttatgaaaagcaagcattattttttgctttatatagtagtatattttgcgcttagaaaaaataaaaaatatataagataagaattagatataatatgcacctctaaaagttatacgcttttggaggtgcatatttttatgataaaaagcggaaatctactgagtgagtcaatatttttattttttaaagtaccgaaaaacctatgtataggaaatataatactagcaaagcgaccccctgaaatttgtaaaatttctttttaagcagcggcggcaggcacgcaataaggataaatccaagacagattggaatatcaagcatttcatactgcggttcaaaggtcagaggtacgccgaactttcctgttgatataaatgagcatattggtattattaatgaaaggtctattatattagctcctattatgttacctattgacagactgctgtgttttttagcaatggcggtaatagtcgtaacaagttcagggagagaggtgccgatggcgataattgtcagcccgataaccctttcggatacacctaatgcttttgctatatctgtgcctgattctaccaagagtttggctcctactgtaatggctgcagcgcttagcacaaataatgatgaatttataaaaacctgctttttagtcggttttattataggtatcgccggaaggattacatttccgttgctggttttaagaactgtgttctgttttgatgatgaaaggttgttccaagtaaatataataaccactccaaaagcgagaaggcttccgagcgcagataccgtaccgtttttacatatcatcataaggatgaatgctgaagatatgagacatatcataccgaatttaaaatttttggtttctattgttgaacttagaaatattatgcttatagccataatcattgctgtattggcggtcacagacccgacggcgttgcccatagctattgagttgttgcctgaaaacgttgcaatggtggaaaccaaaatttcaggtaatgtggtggctatacttacaattgtcgcgccgattataaactttggtatgttaaatacttctgcaatccaaacggctctgtccacaaatacatctccgccctttattattaaaaacaggccaacaagaaaaagtaaaacagtaatagtcatttaaaagttcctttcataaaataaaaatattttgccttaaatgtattgaaatactttctattatatagtataattgtttccttgataaaattcctaaaatgtgcaaggagatgtgacatatgcaggataaaattaagctttatgcattcaacaatctgacaaaaactttgagttttaatatatatgatgtgtgctatgccaagagtgagcgcgaacaaaaggattatattgcgtatattgacgaacagtacaattctgagcgtctgacaaaaattctatgcgatgtcacagatattattggagcgaacgttcttagtatatcaaagcaggattatgaccctcagggagccagcgtcaatcttatgataagcgatgagtctatgattccttcacagcctcctgtcagccatattacggctgatgaggttatgctgcatttggataagagccatgtaacagttcatacttatcctgaatatcatcctgataatgctatttcaacttttcgagtggatatatgcgtttctacctgcggtaaaatatctccgcttaaagctttggattatttaataggcagttttgattcagatatcataacggctgattatagagtcaggggatttacgcgcgacctggatggaaaaaagctgtttattgaccatgatattacttcgatacaggactttatagacagaaaaacactggagaaatatgacgctatagacgtaaatgtttaccagtcgaatatttttcacacaagaatgctgattaaagatatagatttgcagaattatctgtttaaaactgatgtatatgagttagagcctaaggttagacttgacatcagcaacagtctcagacgtgagatgattgagattttcagcggaaagaatatatattagggggactgatggtttggagcaaagcaaagcccctatttatgaggcgttaaaaagatttaaatcaatgcgtgttgtgccttttgatgttccgggacataagcgaggcaaaggaaatcctgagctgacctcatttttgggtcagcagtgtatggacgtagatgttaattctatgaagccgctggataacctttgtcatccggtgtctgttatacgcgaggcggaggaacttgccgccgaagcgttcggcgcaaaacacgctttctttatggtaaacggcacaacaagcgctgttcaggcaatggtatttgcggcagtaaaagaaggagaaaaaataatacttccaagaaatgttcacagaagcgctattaatgctttggtcgtgaacggtgccataccggtttatgtaaatcccggagtgaacaaagctctggggatacctttaggaatgagtgtaaaagaagttgaaaaagctatagaaaacaatcctgacgcaaaagcagtttttgtgaataatcccacatattacggaatatgcagtgatttaaaaaaggtagtggaaatagcgcacagagccggtatgctggttcttgttgacgaggctcatggaactcacttttattttggtgataatctgcctgtcagtgctatggaagccggagctgatatggcttccgtaagtatgcacaaaaacggtggttctctcactcaaagctcatttttgcttataaataactatgtgagcgaggggtatacaagacagattataaacctgacccaaacaacgagcggttcatatctcttgatgtcgtctcttgacctttcaagaaagaatctagctttgaacggaaaggaaatataccgaaaggttttggaacttgccgattatgccaggggagaggtaaacaaaataggtggatattatgcgtttggcagggatctggtggatggagacgcaatatatgattttgacttggccaagctttctatacacaccagggatatagggcttgcgggtatcgaagtatatgacatgctgagggattattatgatattcaaatagagtttggcgatatagggaatatacttgcgattatttcagtcggagatactcctttgatgattgagcgtcttatttcgtcactgagtgagatagagaggatacatagaaagccaagtgccggaatgttcgaccatgagtatatttcacctgaagtgataatgacgccaaaaaaagctttttattcggataaaaaatctgttcctatagagaagagtgccgggatggtatgcagtgagtttgttatgtgttatcctccgggaatcccaatactggctcccggtgaaatgataacgcccgatatacttgattatattgcctatgctaaagaaaagggctgttttatgaccggcgccgaggatataaatatagattatataaatgttatttagcagttgataaaaggggtgaaaagatggaactgtggtattctgagaatcatagcgaagatgtaaaattttcaataagggtagacaaacaattatataccggaaaaactgattatcagagaatagatgttatgacctcaaaggagtttggaacatttttaacgcttgacggcttaatgatggtggctgaaaaagacgagtttatttatcacgagatgataacccatgtgccgatgtctgttaatcctgaaataaaaaatgttttagtgataggcggcggagacggaggcactgtaaaacagctggtgcggtatgaaggaatagaaaatattgatttggtagagatagacagggcagttgttgaagtttcgatgaggtttttccccggaatgagagtggggtttgaagacaaacgcgttacggtgtattatgaggacggtttaaaatttatcaggtcaaaaaggaatgaatatgatttaataatagtggattccacagacccgtttggtcccggtgaaggtctgttcacaagagagttttacggaaactgttcaaaagctcttaatgagaatggaatatttgtaaaccagcacgaaagcccatattatgataattatgctaactctttagttcgggctcacagcagaataaaaggggttttcccaatccataagctataccaggctcatattccgacctacccgtcaggtcactggctgtttgggtttgcgtctaataagtttgacccgcttaaggatttggacgctgacaaatggaataaattggggataaagacggaatattataatactgacctgcataagggcagttttgcccttccgaattatgtaaaggagttgcttgagaatgcctgataatactattatatcaaatctgccgttttttttaggctgtgacgctgagtatgaggagtcaaggatatgtgttttcggagcgccgtttgattcaacgacatcattcagaccgggaacgcgttttgcacctcagaccatgcgagccgattcttggggtcttgagacctacagcccttatcaggacagggatttaaccgatacaaaaatatttgactgcggcgatttagaacttccgctgggagatactgagcaggtgttatcaataattgaagattttgctgctgagatcattaaagaaaacaaaacccctgtgatgattggcggagaacatttagtcacgcttggcggggtaagggcttgttatgataaatacggcgatgatttaagaataatacactttgacgcacatactgatttaagagatgaaatgttcggagtggaactcagtcatgctacggtgatacgtagatgttcagaactcttaggcgataaaaagatatggcagtttggtatacgaagcggagagaagtatgagtttgagtgggcaaaaaaacataatactataaataagtttgatttaaatggtcttgacgacttaatatgtgagttaaaagaagcaaacttgcctgtctatttcactgtggatttagatgtattagacccttcggtatttccgggaaccggtacgccggaaccgggcggcataagttataaggaacttcaggacgcggtgattaaagtgtgcggcggtctgaatataatagcagctgacgtggtggagctttgtccgcattatgaccaaagcggtgccagtacagcaattgcgtgcaaaatattgcgagaattacttttagcgttgagcggaagatagaatatgtttttaggaggataaaatgagcagagcattgataattggagccggtggagtggccggtgtggtggcacataagtgctgtgaaaattttgaagtcttttcagatattatgatagcgagcagaacgaaggagaagtgtgacagcctgaaagaacgctgtgaagagtataagaaaaaagtcgggagcggcactaatatagaaactgctaaggttgacgctgacagcgtagacgagcttataaagttaattaatttatataagcctgaaatagtaataaacgtcgcgctgccgtaccaggatttgactataatggacgcgtgtcttgagatgaaagtggattatttggatactgcaaactatgaaccgcccgatactgccaagtttgaatataaatggcagtgggcttatcgtgaaaagtttgagaaagctggaataacagccattttgggaagcggttttgaccctggtgtgaccggtgtgttctgtgcgtatgctcaaaaacatatattcgatgaaataaattatattgatatactcgactgcaatggcggcgaccatgggtatccgtttgcaaccaacttcaatccggagataaatattcgtgaggtttcggcaaacggaagctattggcaggatggcaaatggatagagacaaagcctatggaaataaaacgggagtataattttgacgaagtaggcgttaaagatatgtatctgcttcatcatgaggaacttgaatctttagggcttaatataaaaggtataaaacgtatcaggttttttatgacattcggagagagttatctcacgcatttaaaatgtttggagaacgttggaatgacgtcaatagaaccgataatttatgagggccgtaaaattataccgctgcagtttttaaaagctgtgcttcctgatccggcttcattgggacctagaactgtgggtaaaactaatattggatgtatattcaccgggaaaaaggacggggaggaaaagacatattatctttataacgtttgcgaccatcaggaatgctataaagaagtcggctcccaggcggtgtcatatactactggagttcctgcaatgattggcgctgcaatggttctcagcggaaagtggaaaaagcctggagtttataatgttgaagaaatggatcccgacccatttatggaggatttaaataagtttggacttccctggaaggaagacaacgcacctattttggtagattagctaaatataatatattccgggacaaaattgttccggattttttatatataattttagggaaaacaattttattatagcgtaaataattgttacttttcagattaaagtaaataaaaattttataaaagtaaaaatgcggcaagtttgattttgcgaacgaaatagatgtatttcataatgtattggagtacagtggaacttttgcagattaattatatatttacaaaaatatagttatgaaacagatttgaaaaaatatatattacctgtctcatcattgtatttattttgtgattttgttcttctattaaaagcttaaaaaatattattaaacagtaatatttcaaataaaatagctgtatatgaaacttgaaatttatttagtcaaataaaaaagcaaaataactgtaaattatgccgtctttttataatgaaaatttataaaaagagtggtataatttgtatatatcttttcgattggagggttaattttatgaagaaaaagttattttgcgttatactgtcaatcatgatgttggcaggatgtattcctgcaatggcagttcaggatggtcctgaattgaattctgaattacagcagagttcagagcagccaaggcagatggagaaattgggcagaggtgcttttggagcaacggcaccgtcaggcggagtttatttgagctggaggctattaggaagcgagcccatggacactgtttttaacatttataaaaacgagcaaaaattggtagattccattaacaataccaattacactgatcttgaaggttcagagacggataagtatacaatagcgcctgtaattaacggacaggaaggcgagaaatgtgaacctataaccatattggcaggtcatgcagataagggacaggaatccgttccgtatacatattttgatataccgctgaatattccgtcaccggcaagtgattatgagatagtatatgacagcggaaagtcaaacagtcctataggaggggcgaacgatgtgtccgtcggcgatgttgacggtgacggcgagtatgaaataattcttaaatgggaccccaataattcaaaagataattctcagtcgggaaagaccggcagagtatatttggattgctatgaaatggatggaacccagctttggagaattgatatgggagctaatatcagagcaggagctcactatactcaattccaggtttatgattatgacggtgacggaaaagctgaattggcagtaaaaacagcgcccggaaccatagacggagcaggtaattatgtaacacaggcaggaactacagaggcaataaaaagcgctgataattcggcgtcttatgttaactcaagcggatttatcattgacggacctgaatatctgacaatctttaacggtcagaccggagcggcaatgcagacggttgattatgatccgggaagaggagataccactacttggggaaagaccagtgataaaacaaacagagtagacagatttttggcatgcacagcttatcttgacggagtacatccaagtcttgtaactgcccgcggatattatggaaaagctattgtagtggcatatgactgggacgggaagaacttaaataagcgctggagatgtgacagcacggtctcaggttacggcagtcttgcgggacagggtaaccataatgtttccgtagcggatttggacggcgacggctgtgatgagatagtatacggcagcgctgctatagataatgacggaacggtggctcattcaacaggatggggacatggagacgctattcacgtttcagactttaataatgacggaaaacaggaaattttcggagttttagaagaaaaacctaactggggaaccggatttagagatgcggcgggaaaagagatatggcattttaaagcgagcggtgacgacggaagaggagtaatggattattttagtcctaaatatggagtgctcgcttgggatgcagcttttggtgtacgtactattggcggcgaattaatcagcaaaacaactttgcatgatggatcatatcctaactttccgatttattgggacggggatttgtaccgtgagcattttaacggcgacagaataagtaagtggaatgacgataccctatcgtttggcagactctggactatttatactaataattctgtaaagtttattaacagcacaaaaaccaacccaaatctgcaggccgatttgttcggcgattggagagaggaaattatattaagacattccgataactcagcacttcgcgtgtttgcgtctctcagtccgactgactataaatttacaacatttatgcacgacagccagtaccgcagtgcaatagcttggcagaatactgcttacaatcagcctccgcatcaaagctattatataggttatgataaagatatttcagaatatgttcagcctaacttatactatgcgccgcttcctgagagtgtagtgaccgtgaaagatagcagcggaaatctgctttcaggcgccagtgttaaaatagacagtcagattatgacaactgatgaaaatggaatggtatctgcaagactgcttccgggaacccataattatgaggtagaactagataggtatatattgagtaaaggggcatttgaagtgcctgaaaacagcggagctgcgcttgaagtagttcttgaagctaagcagtatatatacgacagcagtaatgacgaaacaggttcaaaatttgtatatgacggaagcgaaggagcagctttaactttctcaagttcaaaagagtggcagtttacacaagacagctctgatggaggcagaagcttcaaagctgattttgaaacggcatacggcggtaatgctgaactggaatttgcatttggaacaggcggtactaaagacgccggaggagcatggaattggacaggaagagcttatacttatgagattaagctattggattcaacagaaaaaacagttttggcaataggtcaggaatattcggaatcaggggcaaatgaggcctattattattcaggaacaggagcaaaaacaaatatttcatcaggaacagtctttggctcgcccaatataaccaagagaagctcttcgaactggagaattaaaatttcccttgatttaacaaatggaacagctaaattgatattgagcgacgattccggtgagaatggatatactattgaaaatatatcaattgattctgcagactttagttctcttgagataggttcgattgcttccggcaatgtaacctggtcgccgaaggtaaaagatgtattgtattgggcggattctgtaactccgccgtcaccgccgccgacacttgacccaacaaaaccaacacctacagctaaaccaacagctgaacccactgctacaccattaccgacagacgctcctataattggacaaagctgggattttgacaatctaaagtcaggggatatttatggaaatagtgatgataataatactatctcaaataataacggaaaatcaataaatatagatttcggaacatcggctgctgacggcgctgtgccgcctgcaataacccaaagagctgaaggaaataactatattcagtttactgataaaggcgccggtcaggacggctggtcatatttgccggaaactgttttagacggagataagataatatttgaagaagatttcatgagcggagacacagctaaggatacaccgctgtttagaatatttgattcaaataacgccaacccggataatacatatactaccgctaaagacggcagagtgtttgaagtgatgacagtggaaggcggaacgctgaagttaaatgattatttctctatgggcgcttccgctacaaagcctaaggatactcagatttccggatttagtttcagtcctaataaatggtatagcttaaaacttgaatatacaaagagcgataataaagtaaaggtttatactaaagaagctgacagttctgactatacattgagaggaacggttacgcttggctccggtactaaaaaaattgatgaggttccgcagcttttgcctacaaaagttcaatgttctactcgtggttcttctgcaaacagcttaggtattgataatattaccgtgggtgtccaggggggttcggaggttcctgaagtaactcctacagttcagccggcttctgaatttatgtatactttgaattcgatagcggaagctgaaaatggcataaatataaatctaacaaaaaataaagaaggaatcggatcgaacgtaataattgcagcggcgtatgacagggagacaggggctttgaccgctgttgaaaccagtgatataacaatgaatgttggagattcatccaatatattcataccattagccgtatcggaaaccaatgaaatcaaggtgtttgtttggaactcaacagacggaatagaacctatttcaaacagtataagtaaatagttaattcctccgggaactgatatacctctctataagtgtctaacttttggcggataatatcaaatttttcccgggggagtgtttttaatgtatcaattaataaaaactttattttagtttataaatattttataattgctttatttgttttcaatttttgggatttatactcttaacatagattgagacatatgttaaatctaaactcaaaactcaaaacaaaaaatctatcaattatgaaagcgaggcaaatgtatgaaaaagacaagaaacagaatcatccgagctgcggcgtgcataggcgttggagttgcagtcctgggaatggcggtatttgctaattttgacaacgccaatggatatggcgtggttaaagaagctgcaaaaaatacctttttctcttctgacaatgttactgcggatataaacgtttcagctgatttggaaggctcaaatctttttggcggaaaagcgctgataaaaaaagatgccggcggggatgtaaaaatgcagacttcgtcacaatcgtatgatgaaaccggaacactggtggatactgacaatttaatgactattcaagacggttacagattatcatcatacacttataataccgatgaaggtccggagactcacaaaacaaagtacaaaatgagtgacagggatatttctgaagagttgtttacgaatacagaagttttggataaacagattggcttccttgaaactttggcggatactttaataggcgacataaaaaataatatagttctcactgattcaaatgacggaaacagaacttatacaattaacatgacaggggaacagcttcctaaatatatgacagcagcattttcattatttaacgcgtcattgagagcaaactatgaaaattctaatgaaatcttcgatgaagaaaacgttaatatccagacaatgtctgaaatgttcctgaacaaaaatgagccgtacgtgaatacaataagcggcagcgtatccattgataatgccggaagaatctccgcatttaacggtaaagttgttttgacaggttatgacaactcaggagctcagaagaatttaaatatgagtttagacgctgcatttaaagattatggaacaaccagcattgagagagtgaacgctgatgaatatgaggatatgtctgtaagcgtaacaactaagtatgcagtggaagaagacggttcaggtcatatgactataacagaaagtgatgaagatgttgaaggcgatataaacggttcagtcaatcttcaagcaaataatgaagacggtactttttcgacttatactgtaagcagcgatggaaaacttagagatgaaaacggaaatgttgttaccgtagtgaataatgaaagctcagaagcggttaatgacgcggcataagaaaaacggtgcgtgtataacaatttaagaatcagaaaggcagttaaatatggataataagaataatactgttctatcagttcatagcttaaaaaaattattcagaaacggccgcggagtaaacaatatcaccctcaatgttaatgagggtgatattgtaggtttgctgggtcctaacggttcgggaaaaacaacggctatgaaatcaataataggcatgaataggattgacgaaggtgaaatacagatttttggatatgatatagatgatgatttcgaatctgcaatggagagtgttggatgcttgatagaaactccggcactttatgacagaatgagcgcttatcagaatttaaaagctgcggctaggttttataaatatcctgataaaagaacagaaacagaggctataaataatgctttgtcattagtaggtcttgataaatactctaaggataaagccggaagcttctcgctgggaatgcgtcaaaggcttgggatagctttggctcttttgccgcgtcctagacttgtaatacttgatgaacctactaacgggctggatattgaaggagttgttcatatccgcagtgttattaaagaaatgtctgaaaaaaataaaacaacctttttaatatccggacatgttgcgtcagaacttgaaaaactatgcgacaaggtagcagttatatatgacggcagactgctggctatgaacagtatggaggaagttcttgaaaatttcccttcgttggaagattattttctttctatagtaggcgacgctaaggatactgaaaggaggcgtgtaatatgagtggattgctggctaattacaggaatgaatgcgctaagcttatgagcagtaaaaaatacatagtttttataataatagaaattttgatttgcgctgtagcggtattttcaaaactgatagtgacgtctatttcaaagggaacttggaccatgaataatataagttctcctatttcgctcatgacgttgttcgttcaggctatagttccatttattataatgcttgcttcgtgcgacctgtttgcgggagaatttcaggacaagactatacgcgcggtgtttatgcgccccacagcaagatataaggtttttgtaggaaaggttttggcagttattactatagctgctgtaaatatggcggtagttctgatatcttcaagcatatttgatattattgtttcaggaagcgtagtgaatttaggatatgcagtatgggcatatattttggatatggtgcctttggcagttttggcgcttatgacaattatgataaatcagcttgtaaaaaactcgacatttgcgatgtttttggctataatagtatatataggcctgaatgtgctgggaatttatttttcaaatctaagcggattagtatttaccggatatatgcagtggcataaactgtggttaggcgccggactgccaatatcagcattattcagcaaaattttgcttatgctgggttacggattaacctttactgctgtaggttattatttgtttaggtttaaggaatgctgataagataaaccgctggattacggaggcggatatatgtcaattaaaaagaaacttatgttatcatcgattgtaatgctggtattgccgattttcattatggtgctcatatcagcatttattttcgtacttgttttaagttatgtaccaagtatatctattcaaattaacggtattactcccagccttaataatcctatgatttttagattgctgctggtttggctttttatattgattgtagttgttcttgcttgttgtataggagtaacggcatatctgtcaaaaagtataatagcgccgcttaaaaaaatgtccggcgctatggaacatttgacggaaggcgacctcagctatgagtttacatgttcaggtgaccgtgaaattaaagaagtctatgattcgattgaaaacttaagagtcaggctgaaaaaatctgtagatgaagaaataaagcgagagacagaacacagaatgcttatagccaacatctcgcatgacttaaaaactcctattacctcaataaaaggatatgttgaggggataaaggatggagtagccgatacgccggaaatgttggagcgttatcttaacacgatacagactaaggctaatacccttgaggctatggtaaataatctttcggagtattctaagttggatttagacagtgcgccgtacgatatacaggtttgggatataagaggttttgtgcgttcagtgctggaggaattctcaattgatttatcaagagccggtatagagcttgatattggtgaaaatttaagcggctgtgaagaaatatatgtaaggtttgactgtgaaaaattaaacagggtgctttccaatataataagcaattctataaaatacagaaagcctgatattcccggaaaactaagtgttgagttaatagaaaatgacggttgggtaattttgagtttttcagacaatggaattgggataagtaagcaggaagaaaagaaagtgtttgagacgttttttagagctgacccggcaagaaatttaaacgtttcaggtaatggtctcggtctttctatagcatgcagaataataaaagaacacggcggaaagatatggatgcgttccggaggcgataagaatggagtaactgtttatataagactgaaaaagtatattttggaagattaagacaaaaggattggtttatatgaaaatattaataattgaggatgataaaagtatagctgaacttgagatggattatttgtcagccaacggatttgaatgtgagttggcaaatgatggagaatccgggttgaaaaaggctttggaaaatgattatgaccttgtgataattgacgttatgcttccccggcgcgacgggttttcagtgtgcggtgagcttagaaaggttaaagatgttccggtaatatttttatctgctagaagtgaagatatagacaaaatacgcggacttggactgggcgctgatgattatatagctaaacctttctctccttcagagatggtggctagagttaaaacccatatttcgagatacaagaccctcagaagcggctctgacgctgtgaagccggagataatagaaatcagagggcttaaagtagataaagggtcaagacgggtgttcagtgacggcaaagaagtaataatgaccgtaaaagaatatgatttgcttttatttcttcttgaaaatccaaatatagtttttaacaaagaggtgctttttgaccgcgtttggggtttggaagcattcggagacgcttcaacggttactgttcatatacaaagaataagagacaaaattgagaagaactctgaaaataagtacattgaaaccgtttggggcgcaggatataggttcagagcttagcatattattctgtggatttggaaaatcctttagggcataccctcatacatataccgcacacaactccgcggcctatgttttggtatgcttttttcatatgctggctgcacgccagagcgtcaatgattttttctctcggttccccgggattccacgtttcacctgtgatagccattgcagggcaggcttttacgcaaagcgtacagcttccgcattggcattctaaaatatttgtattaaaatcaaattctgcgcagtcagtcaaaattgttccgagccgaactctgggtccgttgatatttgaaataaacagaccgctcttgccgatatagcctaaacctgcttttacagccgcatatttatgtgaaaatattcctttaagtccattgacggactgagaggcagggacaggaacatacttatatccggctttttgaagtatcagaccggtttttaaagagttattgtcaatcaatgtgtttactgacctgtagtggtggaaatatgtatgcgtgggtttatcgtttatctgctccactactgcgtcagacagcggtattgtatatgatatggcatattttaaattaaaatcgtttgtgccaaaatcatcgttgtctaggcggcagaatcccacttgtccggcgccgttgtttattaaaaaatcaattattttttcttgcatattctctttcataacaatttcctatcttaaatttatagtcttgacttaaagtcctgatacccaaaagttttgataagttccgtatctccgttttgatgtctcagaactatgctgggcaggtttataccgttaaaagtgttatttttaacagtggtgtaaatagccatatcgcaaaaggtgattttatcaccgggttttaaaggttctttaaaggagtagtcaccgataatatcaccggccagacaggttggaccggccaaacggtaagtgtatggatattccccgggattcccggcgtcaataacgttggggcgataaggcatttctaaaacgtccggcatatggcatgctgccgaagtatccaatattgcgatatcaatttcattatttattatatccataacgcttgatgtcaaatatccggcattgagagcaactgcttctccgggttccaaatagacggcgacaccatatttgtcagaaaaataatttatagatttgcacagaagttctatatcataatcttcccttgtgatatgatgacctccgcccatgtttatccattccatattttttatatactttccgaatttttcatctactttttgaacggtcctccataaaacgtcagaattctgctcgcacatagtgtgaaagtgaagtccgcttattccgtcgaggttgctgtgttcaaagtttcttaaagtgactcccattctggagcctttaaagcatggattatatatgtcagtttcaatttcagaatattcaggatttattcttataccgcattcaattcctgttcctgacacaatatttttatatttattccactgggaaaatgagttgaaaactatgtggtcacagatttttattatttcagaaaaatcttcatcgctgtaagccggagcgtaaatatgagtttctgtgcccggcatttcttcgtggcccagtttagcttcaaacagagaacttgctgtggtaccggcaagatattttcctataagcggatacaatgaatacattgaaaacgctttttgtgcaagcagaatttttgctccggttttgtcggaaacactttttaaaatctctaaattttttataattaaattttcatcaattaaataatatggtgtttttatatcgctttgcttcatttgattacctcattaatttatttctaattaatatatcataaagagcagaatttatcaatatttctatgaaatttgccgatatgaattgttaacaataatattacagacgttgatatattgaattgaaaatggtatactatctaaagtgaattgttctgtaattcaagaggagatgaaaaaaatggcagaacctgtagttaaaaatagaaaagtttcgtattcatatactgaacaagtgcaaatggttacgtctcctgacttaaacggatacggaagattgttcggcggaagactgatggagtggatagatgtcgtggccggaattgttgccaggagacacagcggatgcaaggtaaccacggctatggttgacactctctgtttcagagcgccggcatatccgaacgataccttggtgcttgcgggaaaagtaacccatgtgggacggacttcaatggaagtgtgcgtccgcactatggtagaagatttgaacggcatgaagagaaccattaataaagcttatttggttttggtagcccttgacgatgatgacagaccgactgaagttcctgggcttatacttgaaactgacgaggataaaatggagtgggaactcgctaaaaaacgcggtgagctcaggagcgaaaggcgcagaataaacgctaactagttaaaataatatatctgtttaacaggtggtgaataagggatgggacggcaaattgcacggcggacagcgaaaccggaactttcgcatatgaatattttttgtgcgtttcttgttatatttattcattgtgcttcagtcataattggtgagactaccagtttggatactgcttttaatgctgtctttataccttggagattcagcacttttgttgtgcctgcatttatttttctgagcggtgtgaagctgttcttgacagataaaaaaattgattatgttaaattctacaagggccgtataacaagagtgattttaccttatcttttgtgggtgtttatattttatattttttttgtaaaccaccattattttgaattttcgtgggacgggctgtttcatgcgtggtggcgcggagatttagtgggtcacttttattttgttattataatagttcagttttatatattaatgcctttatgggtctatgcgttaaggcgtgtcactccggctgtcgggatagctttttcggttttaatctcggtagttttgggatataatttatcgaatatactatacataatcttgccgaatcatgtgttccagttctctgatgttatttttacaaaatatttgttatactgggtatgcggatgctatgttggtatgaattatcaaaagtttaaagagattatactgaaccgaaaaattttaattacagcactattcttattttcaggattcctggatatttatttggcgtatgctacatacaatatggctgtaccgtggatggaagaagtacatattctctattgtacatcggcaatactttttttctttatgttcttctgttggatatgtgacaaaagaaaacagcttacccggtttacaagagctttggattcccagtgttataacatttatctatcgcattgcctgataattttatggctgaatgattatcttttgacagaaataaaaatgagcaatgtagtgcaaagattttggactataactctatcagcctatcttggttcatttattttctggatgctttggtgggtaataaagacgggagctataactatattcaggtttatcaaaacaaggttagccggaataaaaagtgcggtgtaaaaacttgtcaattatgcggcgatgtgttataatgaacaatatcatcatgaaaggtgaatggtgcaaaatatgaaatttgggaaaaatataaaaaatatgattgtttttggtgcggtagttataatgctggcaagtgttttaagcagctgcggaaacggtgatacatcttcaaaaaagagtgttgattcatcaggaacttcgcaaaacagcagttcaggcagtttggtaggggacaagtatataaactatatcaattcatttactgacgaggtaggagcctttgtgaacggagatatggataaggttctaaacggtgtaggaagcttatcacaggataactacgcagagtggaaagctttatatgaaaagggtcttgatagcactgaacactggtacagtgaagtgggagcggcagctatgctttgcggtgaagatcagaaagaagctcatgatgaactgacaaaaactgtcggaacgatatataagatttttgaaggtcttaaatccagagtggaagcagcggataacggcgatttttcacagcttacgtctatggctgaagaatacaatgaagctgataaaatagctcatacaatttgggaacatgctgtggacgctgttaaatgattaatgtagtaaatactggaatagctgaaaagtttgtaaaatactcttgatttttattgaaaatagggtataatagagctacagattttgaaaggagttaatatatatggcaaatcaggttaccaaagatactattattatagatgttttaaagatggatccgggaacagcggatttctttattcaaatcggaatgcactgtttgggctgtccttcttcaagcggtgagagcattgagcaggcatgcatggttcacggtgtagattgtgacgagttggttggcaagattaacagttacttggcttcaaaatagcgtgaatttaaatattttttaagaaatttgtaaaaagatattgacaaacaggccgtgattagatataataatcgctgtctgtttgtgttttctttagggatttaggtgatataaatggatattaatatagctccgattaagaattatgaaggtaaagagatacctattaactgtgaagtaaatattgcgggaatgcccggtgatgattttaagatactggagcccgtaaaagttttgggagtaattcgtaattttggaggaacttttgaactcgaagcaaaaggcacggcaaagcttcagtttgtctgtgacagatgtgcggaagagttctcaagcgagatgaattttaatatatctgaaagattcaaagaaattgaaagattttccgactctgaggatgaagaaaatcaaaatccggatataaattacttatcaggagatataatttcgctggacgagtatgtatattcaaatatggttcttaacgttccgataaagcatttgtgccgagaggactgcaaaggattatgtttcaagtgcggaactaatcttaataacggcagctgttcatgcgatacaagggaagttgaccctaggtttgatatactcaacagtttggacatagattagttaataagtagaaaatgcagcgtttctttaagtaacactgtttcgaggatttcctcataaatatttgatgaattggaaagaggtgtggcataaatggcagttccaaagagaaagacgtcaaaggctagaagagataagagaagagcaaactggaagctttctgtaccaggtatggtagagtgtcctcagtgtggagcactcaagctgtctcatagggtttgtaaggcctgcgggacttataagggaaaagaagttatttcggttggcgaataattttggcttgattaacaccgtgtgctcggcgcacggtgttttttgttgaaaataaattcttgatgaatggaaattattgtggtatactacagtatagaattaggctttgaggaggcagaatatgaaacctgttgtagctgttgtaggacgtccgaatgtgggaaagtccactttttttaataaggtcgctggaagacgtatttcaataattgaggatacgcccggtgttaccagagatagaatatatgttgacgctgaatggtgcggcagggatttcacccttatagatacgggcggaattgaacccggaagcgatgacgtaatactggagcagatgaaggctcaggctgagctcgctatagatatggctgatgttattgtgtttatggtaaacgtcaaagacggcatgaccgctgctgataaagacgttgcggctatgcttcagaaatgcggcacgcctgttatattggtggctaataaggtggacaaccccggtgatccgccaatggaaatatacgagttttataaccttggtattggagacccctggccggtttcatccgttcatggtttgggcgtcggagatttgttagatgagatagttcagtattttccggaggataacgagaacagcgacgagtcggatgttatacatgttgctattgtcggtaaaccaaatgccggaaaatcctctttggtgaatcagatactcggtgagaacagagttatagtaagcgatatagccggaaccactagagacgcaatagacacgttttatgaacgggacggaaaaaaatatatgttgattgataccgccggtatgagaaaacgcggccgtataaatgagaatgttgaaagatacagtgtgagccgttcccttaatgcaatcgacagagcggatgtttgtcttataatgatagacgcagcggaagggataaccgaacaggacactaagattgccggatatgttcatgaagccggaaaggcaagtatagttgttgtcaataaatgggatttggttgagaaagaaacaaataccatgaaaaactttaagataaaagtaaaagaaggctttaattttatgatgtacgccccgtctgtgtttatttcggcagttacaggtcagagggtggacagcctttttgagatgatggataaagttgttgaacagaacacaaaacgtatatcaacaggtattttaaatgatgttttgggcgaggctgtctcagcggttcagccgccgagcgataagggaaagaggctgaaaatatactatacgacacaggcagatataaaaccgcccacgtttgtattatttgtcaatgacgcaaagcttgcccactattcttatgtcagatatatagaaaaccagttcagagcgaggttcggatttgagggcactccaatcaagtttataataagagaaaaaggcaagaagaaatagaaaactaaggagagagtaaaatggaaatattgtggctgatagcaattggggtaattgcttatcttataggaagcgtaagcagcgctataatagtcggacgtatttttggcggtgaagatataagaacaaaaggcagcggaaacgcaggggctactaatgcgctgagaacatatggcaaaaaggcggcggcaattgtgacggtctgcgactgtctaaaggcagttgccgcgattctgattgcaatgttaatttcaaatatgactgggattgacagtgtatatggaaacacaccggtttatgttgcaggcgtttgcgctgttttggggcataacttccctatatattttggatttcacggcggcaagggtattttggtttctatggttgcgatgctgtttgctaattggtggataggattaatagttttggttttcgctttaatagttatggcggtttccaaatatgtgtctctcggaagtattttaggttcagttctgttagttattttgtctttaattttcggaggcggagatattgcgtatatactattctgtgtgattttggctgtgcttgctgtttttatgcacagggcaaatataaagcgcttggtaaacggtactgaaaataagctgggaagcaagaaaggatgagattatggcaaatatcagtgtgataggaagcggcggctggggaagcgccgttgctataatgttggcgaaaaatggtcacagagttaccttgtggtcttacttaaaagaggaaagcgaagatttaaaaaagtatagagaaaataagccgtttttgccgggagttaaatttccggacggcgtaaggtttacttctgaattatcagagtgctgtcaagatgcggatgttattgtaacggcaactccgtcgcatgctataagaacaaccgcaaagaatatgtcgggatttataaaagacgggcagataattgttaatatttccaaaggtttggaagaggggacgcactcaacactttcaaaagtaataaaagaagaaattccaaactgtgaagttgttgttatgtcgggaccgagccacgctgaggaagtttcaagagatatacctactacaaatgttgtggcttgtgaaaattgcgaaaccgcaaaaattatacaggatatttttatgaatccaaactttagggtttataccaacacggatgtgctgggcgtagagcttggcggctctttgaagaatgtaatagctttatgtgccggtattgttgacggtatggggcttggagacaacacgaaagccgctttaatgaccaggggtttggttgaaatgtctcgtttgggtgtggctctcggagcaaagcacgagacttttaatggattatcaggtgtgggcgatttgatagtgacttgcacaagtatgcattccaggaaccgacgcgccggaattttgataggtcagggaaaaactcccgagcaggcgcgcgatgaggtaaaaatggtagttgagggaataaagacttgccatgcggccaaagagcttgctgattcagccggtgttgagatgccgatagttaacgaggcttataaggtactgtttgagggaatggctcccggcatggcgcttaaaaatcttatgggacgtgataagaagcatgagacagaaatggactttttaggtactgtaaaataaaagttttataataaagtataaaaaaccttttgcgttatggcagcagccagtgcaaaaggtttttttagtatctaataatttatccgttatatcccgggagattatatagtttcaatttttattgattaaaaagtacacgataacatataaggttttattatttgtattgaacagatataaatagttttaagtaatataatgagtttaattttgagttcaatatctggaataaagataaataatattactttaacatccgaaattaaaattgtaaataacaaaaaaggttttagcgcccgggtctggcgggcgcaaccgggctaggcaacaatcgaataaaatggatagatattaaatggggttaagttatcaagtaaatattttctgatttttatactacgttaaaataatattatcattaatataatttcacaacattccgatcttgttgttttatattgttactttgtatagcctagcccggttgcgcccgccagacccgggcgctaaaaccttttcgtttgttatttgcgatttaaattgtttatagagattgctgaatcaacagctgaaaagatatacataatagtctataaagagtgctgaattgataactttataaaaatgtatatagtagtttaaaaagagtgctgtatcgacaagtgcaaatttatacttaatagtttagaaaggttgctgaatccatatttataatagttatttttttaaaaagaggctgaaattgaaataaaaatatttatattgatttattgcggattctgaaggtttatataaaataaggtttttacttacttgttatttccgtacatataagattattttatattgattatttttatctgaagagcagcgcgttaaagtctttttatatacgtctgattatttttataatgttaatccataatatccatttatctagtaagttagtttaattggttaataatgtagttttaaaatgttattatttactctaattcactattacgttatatttttctattacttttataattattaaattttttattgaatgttaacgcgctaatctagttttttggcaagaaaatttatttagtaaatttcccgctaatttattattatgaattttaaagtcttaataaaagttaaaattttttatctcatggattagataaaagcatgctgtggttataacgtcaatattatctgtttgaaactataaattcaattattaaactattttatcacatgcttataaaatataattatttggaaataatatgataagtatttttggatatatggaaaagattaaaatgtaaagttataaaatgggaattgctaaatcttaaccatagagatgtatgtaaaatacaaaacagtgtgtcttaaaggctaataaaaattttttataccgagccatatttaaaacgcttgtggtaattatagctaaaaagaggaaaacagatttgttgacttttacctgttgacatatgtgtgttaaggtagtagaataacattgtaagaaacttgtatactagaatgaaaagtatacaactatactaaatttgtaaggggagaaagattatgaaaaagttaaaacgcttgacggctttaatgctaagttttgctttaattgcggcagcggctttcgtcgtatcgggctgctccggctccgcattttcaggcaagcggatagttcgaatttcacattcacagtcagagacgcatcctgatcatattgggcttctcgcatttgaagaatatgttgagtcaagacttggcgacaagtacgatattcaaatattccccaatgagattttgggagcgtcggttaaggctattgaactggttcagacaggagctattgattactgcgtggccagcacaggaaatcttgaaacctttgacgatatttaccaaatattcagtatcccatatctcttcaacagtgaagagcattatcacagcataatggaaaacgatgagatgatgaaaggaatttttacatctactgacgcgtcaggattcgaagcggtgacatggcttgacgcaggagtcagaaacttttacgccactacccctatcagaacgccggatgatttaaagggtaaaaagataagagttcagcaaagcccgacaaacgttaagatgatggaagcctttggcgcctcggcaactcctatgtcatttggggaagtatatacggcaatacagcagaacgttataaacggagcagaaaataatgagcttgcgcttactaataataagcacggtgaggtggcaaagtattacagctataacgaacatcagatggtgccggatatgcttatcgcaaacctaaagtttttgcaggatttgccgcctgaggaaagacaggtatttgatgaagcggctgaggtgtgcaacagagctgagcgtgagagctggagtgacgctgtggaagaagcaaaagatattgccaaaggaatgggcgttgaatttttagaagtagatgttactgctttcagagaaaaagttcttcctctgcataaagaaatattaaatgaaaatccaaagcttcgtcctatttatgatgctatacaaaaggaggcgggcagtaatgattaaacttaaaaatattctgactaagattcttgaggttatatgcgtcataatgtttgcgtttataacaattgtaggaacatatcaaatcgtaacaagatatgtatttaatgcacccagtaccgtttcagaagagcttttaacgtattcatttacttggctggcgctgctggccgccgctctcgtattcgcaaaaagagaacatatgagaatgggttttctagctgataagttttcgggaaacgccctaagatggatatatattttttcagagcttttagttatattgtttgcggcgcttatcatgatttacggcggaacaagcataacaaagcttacaatgactcaggttacagcctcgcttggaataccaatgtccatgatttatgttatagttccgatatgcggaatttttgtaatattgtttggagtaataaatatatatgaacttctccgcgctaaggaggttaaacctctgagtgcaaaaaaggagacagttatcagcaataaaagcgctgtcgtacaaaaagcaatagtaaagggggataagtaattatgtcaatagcagcaatttcaggtttaatagtgggcgtagttttaattgtcctgctgcttgcaggagtaccgatttcaatctctattggtatttcatctatacttgctatccttccgataatggatttcaacgcggcagttttgacaggcgcgcaaagattgttttcgggaatatcagtatttaccttgatagcgataccgttctttattctagcgggaaatataatgaataagggcggaattgcgacgagactgataaattttgcattactgcttaccggcagggttccgggagctctggcacatacaaacgcagtagctaatatgatgtttggagcgatttcgggttcgggcgtcgcttctgcttcggcaatgggttcaattataggtcctattgaggaagaggaaggctatgatgttgagtattcggcaacggcaaatattgcaacagcgccgaccggactgctaattcctccgagtaacgtattgattacttattccttggtaagcggaggaacttctgttgcggccttgtttatgggcggatatatcccgggcattttgtgggggcttgcttgtatggtggtggctttctttattgccagaaaaaagggatacagaagcaatcgccgcgttaaagctaaagacgctgtgaagatagttatggacgctataccaagtttgcttttgatagttatcgttataggcggaatcattgccggtatatttacggctaccgaaggttctgtagttgcggtggtgtatagtttgattctgtcgttttgttacagaacaataaagataaaagatttatataaaatatttaaagacagtgcagagacaaccggtatcattgtttttctgataggcgtttcaagtataatggcgtggattttagcgtttacaggtattcctgcggcgatttcaaacgctttgcttggaataagcaataataaaattgttattttgcttataatcaacgttatacttttagttgtcggaacatttatggatattacaccggcaatattgatatttacgccaatattcctaccggtagttaccagtgatttgataggaatgacggcaatacagttcggaattatgctggtatttaacttatgtataggaacaataacacctcctgtaggtaacattttgtttgttggagttagggtggcaaaaacatctattgagagggttataaaaccgctcctcccatattatggggttattatattggtacttctgcttgttacctttgttccggcaatctcaatgtttttaccgagacttatgggattttaaatttatataaatttaactttcgcattgtttgccccgtgcattgcgaataaaataaattgatggggcagataggagaataaaatatgaaaatgacactgagatggtttggcgagggcaatgacagcgttgaactctggaagataagacagattcccggagtaacaggggtaataacaactttatataatattcctgttggggaagcctggacgtatgaagatataatggaaatgaaaaataaagttgaagcttcggggttaaaagtagaaggaatagagagcgttaatattcatgactcaataaaaatcggtctgccggacagagacaaatatattgagaactatataacaacgcttgagaatttggcaaaggctgatataaagctggtgtgttataattttatgcctgtctttgactggacccgttcagagcttgcaaaaaagcgtgacgatggttcgactgtactttcatatgaccaggataaaatagatgaaataaacccggatgagatgtttaagcagatagattcgaacagtcagggatttgtaatgccgggctgggagcctgagagactggctcatgtaaaagagctgtttgaagcttataaggatgtaggagaaaaaaatctgtttgacaatcttgtatattttctaaaaaaaatacagccggtttgcgaaaaacatgatataatgatggcaatacatccagacgaccctgcatggccggtgtttaatcttccgaggataataaataataaggaaaatattttaaaacttttaaatgcggtagacagtaagtttaacggtttaactttatgtacagggtctctaggttctaaccctgataatgatatatgtgacattatcaaggcgacaaagggcagagtgcattttgctcatataagaaacctgcgtcatcattctccggggaaatttgaggaggcggcacatctttcgagagatggttctatggatatgtataaaataatgaagacgctatatgaaaccggttttgacggtcctatacgccctgaccatggaagaatgatttggggcgaggttgcgatgccgggatatggtctatacgacagagctttgggagcgacatacctgaacggacttctggaagctattgaaaaagagtagggggaaacactatgaaattgtcaagacgctcaattgttcagaataaaagtgagtgggaaaagctgggttatactttgcctgagtataatatagacgaaatgattaagaaaacttcagaaaatccaatatgggttcattttggagccggaaatattttcagagcatttccggcggcggtttgccagaaacttttaaacaagggcataatggacagaggtataattgtagctgaaggttatgattatgagattatagataagagttttaaagattttgataatctgactatttctgtaacgcttaacacagacggaactgtttcaaaagaagttatagccagcgtggcggaggctttaacttttgattttgataacgagactgatacggagcggcttaaagaaatcttttcttcaaagagtttggaaatggcgtcgttcactataacagaaaagggttataatttaaaagacactaagggcgaattttatgacggagtaaaagccgatttcgaaaaaggacctgaaaacgctaagacgtatatgggccgcctggccgcacttctttatcatagatataagaatggggcaagaccgataaccctggtgagtatggataactgttcccataatggaataaaacttaaagaatcagtttatgagtttgctaagagttgggttaacaatcttttagcagacggcgaatttttgccgtatatacaatatagtgtttcatatccatgcagcatgatagataaaataacgccaagaccgtctgatgaggttttaaagattttagaagctgacggaatagaaaatgccgcgcctgttgaaactaaaaagcatacttttgtcgctccgtttgtaaatgctgagaagtatcagtatttggttattgaagacagctttgcagggggaaagcctcctcttaatgaaggcggaataatttatacaagtgctgagacagttgataaagctgaaaaaatgaaagtttgcacatgtcttaatcctcttcatacttgtcttgcaatatacggctgtcttttaggttataataaaattagtgacgagatgaaagacgataatcttgttaaactgataaaaaagataggatatgatgaaggactgccggtagtagttgacccgggtataatttcacctaaagagtttattgacgagacaataaatgaaaggcttccgaacccctttattcctgacgcgccgcaaagaatagcttgcgatacttcacaaaaattgccgataagattcggggaaactataaaggcgtatgaaaagcttgataaaataaaagagcttaaatttatcccattggtattggccggatggtgcagatatttaatgggtatagacgacagcggcaatgtttttgagccaagcccggaccctatgcttgattatgccggaggaattgtgaaagacattgagtttggctgtactgacttagacagtattcataataaaatagaaaagcttttaaaagataaaaagattttcggagtagatttatatgaggtgggattaggtcagctggtagaaaagtatttttcggaattaaacgccgggcccggtgctgtaaaaaatactctgattaaatatttaggataagattaagccggaagtttttcttccggcttatatatatgtaattatcctattaaaaagttttcatttattgacataaaaatttttatatgttagaattgctatggaaatttattaataaataggcgttttgtctggaggtatcattaatgactgtcacgccaaagaaaaatgaaaaagaaacaaacagagaatacgcattgcgtgttctcgaggaaaatataatctctttggaacttgcaccgggggataaaatcagtgagacagaaatagccaaggaactgaatttaagccgtactccaatcagggaagcttttatagaattggaaggggttaatattttagaaataagacctcagatagggacgtttatttctcttattgaccttgatttggttgaggaggctcgatttctcagattaatactggaaaaagaaatttcgagaatattgtgtgaaatcgaagattcttttatgttgatgccaatggaggaacagctttttaaacagaggctttgtttggaacacaataaaagacgtgagttttatggtcttgataatgaatttcacaaaacgcttgcggctatagcaaataggagcagaagttatgagctgatacataatattcaaatacattttgacaggattagaaaactgaatttaaaacgtgagagatgtcaggaaatttatcagcagcataaaagtatcgcagatgcaataaaagagcacgacgctgaaaaggcggcaaatataataacaaatcatttgtcgaattatgaaaccgatcttgaaaaacttaaaaagattcatcctgagtatataaaagaagattagtaatataaatatttttaaattatttctttatttcttttttattctatcttatataataatttaaaaaagccaagcattttgcttggctttttttacgtactaaagagttcgaattaatcgaatatatagttttttctattttttggtaatattaacagttaataagtcgtcatcccatgttacattacacccagctgtctcggcgattgccctaacagggactaatgtcctgtcggcaataattgtaggcgccgtatcgctgatatatgtgccgttattgtgtttaatatttagaacaccaattgtaacaaatatctgttcacttccttttgaagcaattgcagtcatggtgctttcgttccagcttacagcatatcccagtgcttcgaaaaccgagcggagcggtaccataaccctgtcattttgcattaccggtttttggtcaaacagaatataatcattatcgagcacaactttaatatcttttgtaatatcagaataactgacaatagttgaaattgcattcattgttccatttttatagtcttcttttccgaaagcctctaagctgcacaataattcacaattatcaaaatacaaattatggatatcatattccggtgaatatgtagatattccgcattgccacatggtgtttgcaatcgcttcatcatatgaattgtaaactccataattatctgaaccttcatttccaaataaacagatacctttatcgtagtagtcttcttttgcacaatttttaacatcatatagtgccaccccggaagtatagcccggattgtatagattagtcaagacatttatatcttctccgtcgtaactgcatactttatacgtatagccggttccttcaaacggttgctccttatagacatatcctaaatagttgtcttttaagacaatttttatatcttcgtttctatatccatttaagcaggatgaattatcagacaatcttatgcgcgactgttcctcaatttctccgtcattgttttcaaccacaataaagtctaaagcatttttgttctgggagtaatcccttttcaataataatattaataactcatattgtccgtcattgtcaaaatcgattattttagaagcaacaacaccttcattcccgtttggttctgttccattaattttttgagtatacatgttgtgttccggtgcttggccatattgctcaatatatgtataaaatgagtcattatatgcaaatatatttagtggcaagcataggttaataatcacacttaatgctgataacaaactcagtcctttttttatcataaaattttctcctttataatagactaatcgacttttcggtaaactgtaacaccgatagagtatgccatttttaatttaaaattacatcagccatacccatccaaaaatcaccgtcccctactatttttaattgaagcccatgatttagcggtacggttgcagaagcgggaaggtcttcaccttggcaggtgatcgtttttacaggttttccgtccacaatgaaatttagagacgcactttctccttcaaaataaccgtttaccggaccatatgtgaaagtcagagagtcatattttccgtttaaattaaatgtaccccagcttttatagtaaggatttatattatacccattgctatacagttctcctgccatcttaaaggagtttccctcacttgctttgtagatatgaaaattaaaagaattatcatacggctctatggtgtctaccatatatgaatttccgggtgacagtttattccacagatatacactgtttgaaatgccgtcccattccacctgcatacctgacgcctgcgcaattcctcttactggaagatatgttgtgccatcgcttatgaatggttcaactgttttgccgtttgtgtccttcaaatcagccatcacattgtcgatataaacctttatattgtcatattcggctgatattgttttgtttccgctgtaagcatatactccgccgcttatcagcagcgatgctgaaactgcgccaattacaaatccttgaattttgtctttcattttgtttccctcctaaattatatgttttataaattttagttttacaaaaataattataattcttttacggaattatgtcaacggttttgagcaatataattctaaaaaagaattttaagaaaaagaggtgagattatgaaaactcgtaagcatcctttaggaaccagtaatatagtaggagctaacattactaaactgaggactgaaaggaagattaaacaaaaggattttattgcacagattcagtcaaatggcgtgaatataaattctaccagttattcgaaattagaagggcaattcagaattgctacagataaagaaatttatatcattgctaaattgttaaacgttgatataaataaattgtttcaataattataataccgtgataaaaatacacaactttgttttctgaaattaaatgctgaggtgaaatgcgttacaatagagactattaattttattttcctgttgagataggttttgatgtgtttgatctttatttttattattctaaaattaaaagcagaagaagaccggtataatccggtcttttctgttttattacgccaaatgtatatgctagttgcatttgttataaattggtttgtaaaaagttttaaagaaattttctattatatgaattgtatcaatatattataaagagaatatttgaaacaaattaaaacttattaagatttaatccttccaaattaataaatttatattaatttggaaggattaagtttctttctaaattatcggaaataagagattttgaaatagtgtaacttatttttattaataaatttacagaatcgtagagtaatttttaatagtattttaaataaaacttttgacaatctgattcataataaaaatattccaattaattataaattattattgcaaatgaattttatttgttatataatattcaggaagtatagatataaagtaaattaagtaaatactggaggtctttaaaatggcaaaagaaaaagtggttctggcgtattccggcggacttgacacttctatcatcattccgtggcttaaggagaattatgattatgatgttatagccgtatgcggtgatgttggtcaggggaaggaaactgacggtcttgaggaaagagcaaaaaaagcgggcgcttcaaagctctatatcgaggatttgcgcgatgagtacgtttcagattttatttttccgactttgaaagccggtgcaatatacgagggtaagtaccttttgggtacgtctcacgcacgtccgattattgccagaagactggttgaaatagctaaagaagaaggcgccgttgctatttgtcacggtgcaaccggcaagggcaatgaccaggttcgttttgagctgacaataaaagctttggctcctgagcttaaaattattgctccttggagaatatgggatattaagtctcgtgaagacgctgtggattatgctgaagcgcataatatagatgttcctgttacaaagaaagatttatattcaagagacagaaatatttggcacatcagccatgagggtatggatcttgaggatcccgcaaacgagcctcagcttgacagtcttttaaaactgggtgtatcgcctgaaaaggctcctgataagccaacctacgtgactataggatttgaacagggcgttcctgtttctgttgacggtaaaaagatggatccccgcccattggttgaaaaacttaatgaacttggcggaaaaaatggtataggtattgcggatattgttgaagacagacttgtcggaatgaaatccagaggagtatacgagactccgggcggaacaattctttatgccgctattcaggaattggaatttttgtgtctggacagggatactcaggcatttaaacgtcaggctgcaattaaatttgcagagctggtatatgacggaaaatggtatacacctttgagagaagctctctcagctatggttgattcaatggaagaaaccgttaccggtgaagttaaattgaaactatataagggctgtgttacgcctgccggaaccaaatctccatattcactgtataatgaggatattgcaagtttcggagacagtcatgagctttatagccataaggacagcgaaggatttataaacctctttggactgccgcttaaggtcagagctatgatgaataagaaatttaagaaataaggttaaaataatttgattactataaactgaagtacaggagaaagattatggcaaaattatggggcggacgtttttcaaaatctacagacacattggttgacgattttaattcatcaatacgttttgatgccagaatgtatgctcaggatattaaagggagtcaggctcatgcagaaatgctgggtcgccaaggcataattcccgaggctgacgccgagttgattgttaagacgcttggtgagataaaagcagatattgagaataataaggtagagtttgaaatagatgccgaagatatacacatgaatattgaaacgatcttgatttccagaataggcgatgtgggaaaacgtcttcataccggaagaagcagaaatgatcaggtcgcattggatatacgtatgtatttgcgtgatgaaattgatgaaatacttagtgatatagaagatttaaagtcagttatacttaatatttcagagaagcaccttgaaacagtaatgccgggttacacccatctgcaaaaggctcagcctataacatttgctcatcatcttatggcttattatgaaatgctgagaagagacagcgagcgtttaacagactgcagaaagaggttaaacgttatgcctttgggaagcggtgctttagccggaacaacatatgacctggacagggattttgtagcagagaagttgggatttgattcagttacacaaaacagcttagacggagtgtcggatagggattttgtgttagagttagcttttgatttgtcgaccgttatgatgcatctcagcagattgtctgaagagattattctatggagttcgcacgaatttaaatttattgaattggatgatgcttacagcacaggctccagtattatgcctcagaagaaaaatcctgatgtggctgaacttgtgaggggaaagaccggcagagtatatggcgatatgattggattatttactgtcatgaaaggcatacctcttgcgtataataaggacatgcaggaagataaagaacagatttttgatgcggttgatacagtgaagatgtgcttgccggtattttcaaagatgcttgcaactatgactgttaataaagatgctatgctgaccggtgcaaaaggcggattcacaaatgcgactgatgttgctgattatttggttaagcacggtctgccgtttagggatgcgcatgctgttgttggcagaatggtggcttattgcattgaaaaggataaagttatagactcgctgacaatagaggaatttaaaagtttttcagctttgtttgatgatgatatatatgaagaaatatccctaacagcctgtgtgaatcagagaaaactgacgggcgggcccgctgttgaaactgtgagagcggttatagaaaaatataaaaataattaaaatatagcagttaactgcaggaagaggagaaaacaatgaaaattttcgttgatacagccaatgttgattacataagagaagtaaatgatatgggcgtaatttgtggtgttactacaaatccgtctcttatagcaaaagaagggaaaaattttattgatgttgtaaaagagattacaaccatagttgacggtcctataagcgctgaggttataagccttgatacagaaggaatggtcaaagaagctgaagagctcgttaagacaattaacaataaaaatttagttataaaaattcctatgactccggcaggtttgggcgcggttaaacaacttactgcaaagggaataaagacaaatgtaactttaattttctcggctgcacaggctcttcttgcagcaagagcgggagccacatatgttagtccgttcctcggcagacttgatgatgtgggacagacaggaatgactttgattgaggaaattgttgaaatatttgatatccatgcaattgatacagagattattgccgcaagcatcagaacacctattcatgcaattgaagcggcaagatgcggagcgcacattgctacaataccgtatccggtaataatgcagatgactaaacatcctttgacagatataggaatagacagattcttaaaagactgggagacagttcctaaagattaataatatttaaaggtgtttatcaaaacggcgctttcatttaatggaagcgctgttttgtgttaaataggtgtaaaagtgaaatgacataaaacgtcatatataatcaaaatgggaataaatatgcaaaatatccaaagaagtgataaataataggttaagtatttgtaaaaagttaagggtaaaaaaggattgacaagaagggtaagaatatgataagataataaagctttcggctgaggcaagaaaagctgaaagatagaatactgtgagagtaaaaaaggaaagtaacggaagttagccaagaaatcctaaggtcgatgattgaggaaactcaatttcaaaagactttttcactatttgtttttcaaccatctgagaagataggttgagaagatgtttgaaaattgaataaagagaagagtaaggagtaatgattagaaataattatgaaagatactttgacgtagtatatgaagtaacggaagttagccaagaaatcctaaggtcgatgattgaggaaactcaatttcaaaagactttttcactatttgtttttcaaccatctgagaggataggttgagataagaaacttctaatctaagctgaggttttcaataagaaaataaagcaagtacggatggtttcaatgcgggctgatagctcagcaggttagagcacacgcctgataagcgtgaggtcggtggttcgagtccacttcagcccaccacttttattgctacaaagtggttttaaatttaatatcccatgggggtgtagctcagctgggagagcacctgccttgcaagcagggggtcaggagttcgattctcctcatctccaccaggaacttatagttccaaatttcaaccatctgagaggataggttgagaagatgtttgaaaattgaataaagagaagagtaaggagtaatgattagaaataattatgaaagatactttgacgtagtatatgattttcttatatgcggagttttttagtgaacatcggaaggacgcgcttgcgcgtctcgttaggtgagcagacatctcacgcgtagcgtgaacatatatgcgacaatttgtcataatccgttttatataaaacggtcccaagactgcgcgcctaacgcggcaaactgcgtttgccctccggtgcttgctaaaccgcattttatataactttaaaatatttaaatattttcttatatgcggagttttttagtgaacatcggaaggacgcgcttgcgcgtctcgttaggtgagcagacatctcacgcgtagcgtaaagcggtaataaagatacatttagatgtacttattacgacaattgcacaaggtaagaaactcgcaagagtggagactttgtcaattccaaaaaaagttttagcgaactttacaagcagagagatctgcaaacgttagtattcgataagagctaacaaacaatcgagtatattggcagacgagagtctggatatataacaatattaatcgagagtttgatcctggctcaggacgaacgctggcggcgtgcctaacacatgcaagtcgagcgagaaatttttaacggattccttcggggagaagataaggatggaaagcggcggacgggtgagtaacgcgtgagtaacctgcctttaggagggggacaacattccgaaagggatgtgcgccgccgtaatcccaatgctggacttgttgtgttttgggttaagcttcgtcaaagaggctatactcgttctattacaggtctttaccgcatattccgcaaacagggacaaatgcctgttaaaccacccaatcccaaatacataccaaagccttacgagcaaatgctctatcccggtcagagagtacagacgtttgcacatcacaactaagtttgattgttgacattgtaggtttattaatacaaagtgatttgtatcacacacactttaaaaaagtgtggtcatagccctccgaagcttgctaaatcacattttttataagaaatttttaggaattaatatcttcaaaacagtattttttggttaacatcggtagggtgtgcgtaagcacaccgcgttaggtgagcaaccatctcacacgaagcgtgaaattctactcgtttgatgattttgcaaagcaattaaaggtgcataaccgtaactacaataaattcccgatgcgtccgcttaattggaaagctcccattgactacatcaactcttttatcaatttcggtgaactcttttaatcttttttgtaacacatcattgacaaacctacatgggactgagacacggcccagactcctacgggaggcagcagtgggggatattgcgcaatgggggaaaccctgacgcagcaacgccgcgtgaaggacgaaggccttcgggttgtaaacttctttaagtgtggaagataatgacggtacacacagaataagccacggctaactacgtgccagcagccgcggtatcagtaatcaatttcaactcatcagcggtatgctgattgggatgatggtgaggtttatgtgatttatcggctaaggaggcgagcgtaccgtcgtaacgttttcgccagcgatagacatactgacgatttaccttatagcgaatggcagcctttgtcacgccgtgtttaaaagaatattcaattaatacttgggacttgttgtgttttgggttaagcttcgtcaaagaggctatactcgttctattacaggtctttaccgcatactccgcaaacagggacaaatgcctgttaaaccacccaatcccaaatactatgacgtaaacggaaacaggaaaaattatacacaaaaagcaggaacaaatacaatactgacagggtcatatacatatgacatattggacagactgacagaagtagattacggaacagtaagcgcgggatatatgtataatgcgaatggaagactgacaaaggagacaagggggaatataacaagcgagtatacatataacaaagccggattggtgacagagatgaaaaacagttcaggtcagagttatacatacagctataacttggcaggaaatcaaactgtaaaagaatcgggacaggagataacaaattatggatatgatggaataggacagctgataactgaaaatgtagtttcgcccaaagaagatgaatgggattataataatacatattatcagtatgaaaataattaactatttaaaataaaaatccattaaatacttcctttttaaatagttaagaaatacatataactccgtttcagttttttatgcgtaagtaagtatattaaaaacaattaagtgtagaagtaacaaagtcaaaaataaaaagttatatagaaaaacaatatggagaagcgtttgcaatgacaatagaagacgcttttagagctgaaaagtcttatgaaacaagaatactcgttctattacaggtctttaccgcatactccgcaaacagggacaaatgcctgttaaaccacccaatcccaaatacgtaccaaagccttacgagcaaatgctctatcccggtcagagagtacagatagacgttaagtttgttcctgaagcttgcattgtcggtgaagctaatcgttttcgccagcgatagacatactgacgatttaccttatagcgaatggcagcctttgtcacgccgtgtttaaaagaatattcaattaatacttgcctaaatctcatagtttgtgttatagtgttcatatacggaagactcttgcgagtttcttaccttgtgcaattgtcgtaataagtacatctaaatgtatctttattaccgctttttcactatttatttttcaaacatccgcttagctctcaaacaaatctctttgtcagaaaacttcatcgctgcaccgcagcaactttattagtataccatgtttgtttttacttgtcaagacgtcttgacaagtaaaaacaaacatggtatactaataaagttgctgcggtgcagcgatgaagttttctgacaaagagatttgtttgagagctaagcagatgtttgaaaaataaatagtgaaaaagcggtaataaagatacatttagatgtacttattacgacaattgcacaaggtaagaaactcgcataattggaaagctccaattgactacatcaactcttttatcaatttcggtgaactcttttaatcttttttgtaacacatcattgacaaacctacataaaatagaataaattaaagtaaaaattttattttgtttctatgatgtagaaaagatacatattctctagattaaaagatagttatataaagagtcgttataggggttaatagttttaatctatttaattacttatatattaaataaatagcaataaaaataaacgagacaataatgtttttaataagatataaaaatcataaaaaaagttatacccaaatttagtgttcaaaattaattcttcttttatttgtgggcattattttattagcctaatctcttagaaactttaataatttgttgataatgacccatatattctgtacatatattttataagcaaataatacataagcagacaaagttaaaggatgtaagataaaaggcaggattttatacggtcgtgcaaaagtattagataaaagttaactcaagctattttagatttttatttatataattaacaagagaaatactattaaataaattatgtcattctaaactataagttatcatctccttttattgcggagggatggcataatcacccgaattctatattgctttctattcagccttagcgatattatataagaaataacaagaagcggtgatatttacggtgaatttaaagagtaaattgtggtataagattataactaaatagcttatatgtttttatataaacgcatatataaaagagattaccataaaataaatttatgctgttttttattatttcttagatatatgtagttattatataataatcaccttttaaacagcgtattgattagatttacaattaatctttctgcattaaaataaaaatagccggagaacttctccggctatataatatttattcccaatataaaacagcatactgctttcttccgtccgaactgaacttagttccattgcttagcccaagcgccgcgcttcctccgccgtccagtgccaaacctcccacacatcctaaatcagataatacctgaccggcacgagccagcgtggtagatgagcttacgcacagcactatcttgcccatttccgggttgtagccaatataagttctattggtgtatctgtcaatatcaaatgctccgacaaaaccctcttctgaggacatgactttcggcagaacgccgcatccgctgaccgcaaacataacattgttctcagtcgttatgtcatagacctgctttacttcaacagaaccgtcatagtgtacaataagcgtggttaccggatagccgtgcgtcgcataattagagataatctgtccgtcgcttacaataatgccaaccgaatatgtgtttcctgttgcttcccagccgaagaatgaagaattgctgtagttagctttccctgagctttcggcggatttgttaacaatagcctcagctttgatattcagcgggtcaatgtacacaacatgaactccgccgacataactgtattgatagttttcgggagcatgactgattatattcacgcttccgttatatgacatatcagttgtataccacagtgaatccattaaggatttgaggggaacatacagcgtgccgtcatagtttatcagcggctcgtcccagtactctgtgtatgcattgttaattatagccaaattgcttccaagcgctattctgatagaatattcgcctttaataatataggcagtgtataacgccgggtcataatagactttacactccataaaattctgcattgatgtcaaggccagcatcagcgtgtcgttggcataaagcatcggcgagtctaaatatttctcatggccgtttatataaagctggtttccgtttaaagtaatatcagctgtcgttccgctcggagtgtcagaggatatggttccgagctctgcgtttgaaaatgcggaaacgtcaatctgaaaatcataatcatattccgactctatcgcaaaagccggaacacaccccataatcataacgccggctgttagaaccgccgccagtttgggcttgaatatatcttttgccatttttcttattctgtcaaaaatcattataattccttccaaagttagttttgattgttacagaaatgttacatatctgttacaaaaaggaattatagcacggattaggataaaaatcaagcaaaaatataatttttgtagaatttgtattaatgaatatgggataaggataaaagtgtgtttaagttaccgataagttcgtccgcagtgaggggcataccgccctggagccacttggtaacaacgtttagacaggcgccggaataaaagcttgccaaaaattccggtttaacaggaatctcttcgccgttttcaacggctctgttcacaatttttaatattttttcttcaaacaaatcctgaatcctgtcgggaatagaatagtcgttgttcttttttagtatggaagcatatatatccttattgcttgcaacgtaatttataatatcaccaacaactttttcgggatttactgctccatcggttccgtgagcggaaaattccagtttgtcaagcgggatatgttcgtctatgctgtaggtcaaaagttcgtatttgtcgctgaaatgtgaataaaaggttgcgcggtgaaccattgccgcgtcacaaatatcacagaccgacactttgtcaaatggttttttcttaatcaattcaaaaagtgcgttagaaagcagctttttggtcctcctaattctgaggtcctcctttttttgattctcctgcattattctcacctcaacaaaatatattcataaatgtactattacagcatacattatagaataaaaacagacacatgtcaagtaaataaataacatataattatagacatgattgtatattttatacaaaaattaagttatacgacaaaatatagtgtttgtctattgaataaagctcggaatggtattatacttactctgtgaaatagacgaagaagcgccggtatagcagtatgcaggcggcagaatataatattgttaagagtagatttgaatggagtgataccgtgaaaaattcagatgagaatataatggaaaaagtagcgctgtttatagtagacaaaagaaaagcattttatctgttgtttgctattgcttttgtgttctgcgcaatttgtattcctaaagttcaggttgaaaatgatatttcagcgtatttgcctgagtcgactgaaacaaagcaagggcttgatttgatggacagggaatttgttactcacgacactttttcactgatgatttcaaatattccatataaccaggcagaaaaaatgacagacaagattgaagaggtgggcggcgtaaaagaagttgagttcgacgacagcgaggaccattataaaaactcttcagctatatatacggtaactctggacagcggtcttgacaatgagcgtgagatagaaatagagaatgaggtaaaagataagtttgctgagtatgactgttatacatattctgcgtcgattgacaactcgtctgacagtttggcggcggacatgagacaaataataatgtatgtggctattattatagttttgatgctgctgtttacttctaaatcatttatggacgttgcagtatttttgatagtgtttatagttgctgctgttttaaatatgggaacaaactatctgctcggtaccatatcatttatatctaactcggtggcaatcgttcttcagcttgccctggcaatagattacgctattattttgtcacacaggtttgcggaagaaaagcagactaaaaattcacatgacgccatagtggcggcgctgtctaaagcgattatagaaatcagttccagcagtcttactactgtggcaggactggcggcgcttatgacgatgcagcttggtataggcaaagatttgggtcttgtgctctgtaagggaattatatgttctcttataacagtgttcctgcttatgcccggacttttgtatatgttttcaaacgctatagacaaaaccgttcataaaaattatgtgcctgatatatctttttggggaaagattgttatgaaaacaaggtctttcgttccaataatttttgcgttggtaatagtgtcttcaatatttctgtcgtctatgtgtcaatacgctttcgatcaggattctgtgtccagtccgaggctgagcgacagcaaaaaggcagagaacaaaataaaagaaaattttgacgtcggcggacagcttgcagtgatagtgccgaaagggagctatgataaggaaaagaaaatacttcaggatgttgaagaatacgacggcatttctactgcattgggactggcaaacgtagaggtagacgatgattattgcctgactgacaaggttactccgagacagtttgctgacctgatgagtttggatattgcaacttccagagttctgtttcaggcttacggcgcttcagtgtcgcagtataccccaatattccaggacgtggacagttataccgtgtctattatggatatactgatgtttgttcacgaacagatggactatggcgttatagatttgggtgaggaaaagaattcggacataaacgaggtttatgacaaggtgtcagacgccagagatcagcttgagggagaagagtattcaaggcttgtgtttacatataagggaaagaacgagagcgacgaagttatagctctgcacgataaagtgcgcgaggaagcaaagaggtattatgacgatcctattcttgtcagcaacgctatttcagctcttgatttaaaatcgtcattcagcggcgataatcagaaaatcaacctttttacaattatttcagtgctgctgattctgctggcgaccttcaagtcttcatcagttccagttctgctggtgcttacaatacagggcagtatatggataaacttctcgttcccataccttatgaatgagaagctgtatttcctggggtacctggtggtaagctcaattcagatgggagcgactatagattatgctatagtgttcaccaacaggtatcttgaactaaagccggagattggtaaaaaagccgccgcaatagaagctataaacggcgcgttcccaacgattttgacatcgggattgataatgatgattgccggcttcctgatagggtttatttcaaccaacccggttatttcggctttgggaaaatgtttggggcgcggaacacttatctctataatcttggtaatgacgctgcttccgcaaatcatggtgctatttgataagctggtcgaaaagggagcgtttacattaaaaaagaaagagaaaaaggaacgcaccggtatagtttatgttgacggaagagtaaaaggctatataaacggatacgtaaacggaacaattcacggaatggtaaagggcgatgttaaagcgatagttgagaatatgagcggtccggaagacgagcagaagcagtaaaatagtcaaaaagaggtgatttgtaatgaatagaatatcagaaaatcttcgcagggttcttgcgtttatggcggcgctggtcatccttgtttcctgtccggcagaatatatttgtttggcggagggagaaggaaccgccccggtaataaccatatcaacgccgggagattttgcggcgcttgctaaaaattgtgtgtatgacagctattcccgcggaatgcaggttactttgctgaatgatatagatatgtcaggaaccgagtttgagcctatgaaaatattctgcggcacattcgagggaggcggtcaccgtataaccaatatagatttaaactttgacggatctgcaaaaggactgtgttttgaactcggcgagggaggagaaatacgcaacctcaatatttcgggtaaagtaaaagcgaaaaaggttactgacggagccgcgtctatcagcgacgttataggaagcgtggtaaagaatgccggaataagcacagacataataaacgagaattctatctcagttttgggaggaatagtcggcaaaaaccagggcagagtgataaattgttcctttgacggcgagattgagggagacgctatagtcggcggaatagtcggacagaatgaggagaacggatatattgaagcgtgttacaatgtcagttctgttttgggaaacaaagacaccggcggagttgtcggaaagaattacggctgggtcaagtcatccaagaattcgggcaaagtaaattcatctccggtggaggagagccataacattggcggaatttgcgggataaacgacggcgtgcttgaaaattgcctgaatgacgctgaaatcggctataaaaatgtagggataaatatcggcggaattgttggaaaccagtcgggctgtgttatagagtgtcagaatataggtgatatattcgggtctaaaagcgtgggcggaattttcggcagatttgagccttacactgatataagcatagaagatttggacagagtaaaggacgatgtgaacgagattcgtgaaaacgtgaagagtgatattgacgacagctggaataataccattaacgatatagacagtctgcgggataggttaaacactgatataaacggagttcttgacagatttggattttttggcggcggcggacttctttcaaatcttttggggctgagcggaacaaagtcgtcattgtcaggagctttggacagtttgactagcagtcaaaccgggcttttggacgcgatacgtgacagaattagctcgtctgacagcggaagcctgacaggattgctggacagtctctcggattcggcaagagagataagtgatgacttgggagggctttctgagtcgggaagtttacttttggatcagcttaacgatgagactaaagggtcgttaggggaagcgctggattctattaataataccatagataccgccaaccgggcaggtgagagtttaaatgatgttctgcaggacgttgataatctgataaccgatgtaaatgacgcttacaacgacggagactggcagactttgagcgacaggcttgactctttagacggcaggctggattatattcaggatactatgctcgaccctatttcaagcagtataacttcatcgctgaatgctgttacaagaaccttaaactctataagaaatgactccaatgatattgcggacgccataagcggaccgttaaagcaggcggagacaatattaaagaatgcgaaggcacagattgacgccgccaatgagcagattaccaaaatcagaacagatattaaacaggctattgaaaaggttaatgatatattaagcggactttttccgactgctaaaccgaaaacggtaggaagcgttatatcggatactatattcatgacagcgtatgcggatgaaaaactggatttaaatgaggatgaaatcaaggatacattaaaaaatctgacgagcgtagatatcgacatatcaagaaatgtggcaggaatgaacaccgacgacgcccttgtaatgtactgcgtcaacagcggcgaagtgacaggtgaaaaagacttgggcggaataggcggaacgattggtatagagtcggcggttaagtacggaaataatgtaactcttcccagcggaaaaataattactccgacttctatagttaaagcagtggttaacggatgtataagcgagggagaagttttttcgagaaacggctacggaggcggagtggttggcgacgcgtcttttggaataataaaaaattctgtgactgaaaccaatataacttctgatgaggggggatatgttggaggtattgcgggatattcaaaaggcaagatatataattgtgcagccatttcagatttaaagggcagcgaccatgtcggcggcatagccggagagggggatactatagcaacctgttacgctctgcctagaatagacggtgttgttgaaaagagcggcgcaataacaggaaccgcaggcggcgtggtacagaacaactattttataaaagagggactgagcggtattgacggcaccgattatgaaggaaaagccgtggctctggattatactgaaatgaccggagcggataatatccctgaaaagatgacaggattcagcaacgatacatggtatatggggagcggagatatatttcttccccaaaatagggtattaagtgataattcagcttcaaatataggcgctttgattaaatcgaaatcagctgaatatgcggcttttcattttaaagtgaaatttgatattgatgaggagacagtcaaagagtttacggtagactacaatactgttttaaactctgaagaaatacccgatattgagcctcgcgacgggtattgcccgcagtgggataaggatacctcagaccccataagaagaaacactgtatttaaagctgagtatttggatgctgtaaagactttagggacggcggaagaaccgcctctgctgctcgttgagggaaattttaaagacggttcggaggttcacgcatgggaatcagacgcggacggggattattccggcgactataagactgttgcggcatacgaatttgaaataaccccggaatacagcggaaaaataaaagtccatatccgtgataaggatgaggacggaaactgtataggaatagttataaacggcaagaccaaaatattagacgccgaaagggacggcagttatttggtgtttgagactgacagggcaggacagtttaccgtgcttcacaggcgcagcaatatttggaagattttggggatattattgctcgcatttggtctcttgatattaataggagtcacagcttataaaagaagcggcatggcaaaaacgaagccaaaagataaatcacccaatctaacagataatgacgctgaaaaaaataaaattgaagccgatagggatgctgaaaagctggcaaaggcaaaagccgatattaaagaacccaaacagcgggaacgtgatgagattagtacggctaaagaaaaatataaaaaaactgttgacaaataatgtgaaatggtatataatctcaaatatagtaatcattactattttatatctattcttgttgatgtaatgtatttttcaataaagatagcgcaaactaataatgtttgttggaaatttcagtatggcagagtgaaaaataattaattaatatataattttggaggtaagagaaatgaaatacgtatgcgatatatgtggatatatctatgatgaagctgaaggcgagccggataacggcatagctccgggaacaaagtgggaagaccttcctgaagattacgtatgtccgctttgcggagttggcaaagaccaattcagcaaaatggattaataaaaacaaccgcttcactaaaatgtgaagcggttatttttatatataaagttgaataaatttatattttatatgtgtgataatataaagttataaagttatatcaaatagctaacgaaataattactgataagaataatacataaaaaataataagtatatataagcaaacagcttttagcgaacatcggcagggtgtgcgtaagcacacctcgttaggtgagctgccatctcacgcatagcgtgaacatacatatggtggattgtcataattctttttgattacaaatttctccgtgactgcgcgccttacgcggtaaactacgtttactctgccgaagcttgctataccacagttttatataattagttattttagaattattaccctgcatctcacgcttttagtgaacatcggtagggcagacaacgtctgcctcgttaggtgagctgtcatctcacgcgaagcgtgaatatacatatggtggattgtcataattctttttgattacaaatttctccgtgactgcgcgccttacgcggcagacaacgtctgcctcgttaggtgagctgccatctcacgcgtagcgtgaacatatttaaaatagtttgttatacctcttctaatctttcagaaatgtatacaaaaaaccgcagtttttttctacattaaaagtggttgaaattgccatgaattagtagtataatgtctctatagtacaaattaaacaaatcggaggcgcaaaaaatggaatatttagatgaatatgcaagatggataaatgaagctgaccctgaaacggtggcagaacttgagagcattaaagatgatgacgcggaaataaaagaccgcttttataagacgctggagtttggaacagccggacttagaggtgttttgggcgccggcataaacagaatgaacgaatatgttgtgggccaggccacccagggattggcgaatcagctaataaaaacaaatggaaaggacgcagatttaagcgttgtaatcgcttatgacagccgtcataagtcagatgtgtttgccaaagaggcggcgcagatattggccgcaaatgggataaaggtgtatttgtttgaggagcttaagcccgttcctgagctgtcgttttcaataagatacttaaagaccacagcaggtatagctgtaacggccagtcataatccggcgaaatataacggatacaaggcttatggctcagacggcgcacagctgaatccggagcttgcaacaatcgtgcttgatgagataggaaagacggatatttttaccggcgttaaaaagatggattttgagcaggcaatagaccaaggcatgattgttatgattggcgacgaggttgaggaggcatatttggacgaagttcaaaagcagtgtgtgaatcctgagctcgctaaagaaaagggcgacaccctgaaatttgtttatactcctttccatggagcaggcaacaagcctgtcagaaagatattaaagcgtataggctttaacaatgtcgttgtggtgaaggagcaggagcttcctgacggcgatttccctacagtagaatccccgaaccctgaaaataaggaagggtttaagctggccatcggatatgctaaggaatgcggtgcggatttaatagtgggaactgaccccgacagcgacagagttggtattttggttaagaatgacaagggcgaatacgttacctttacaggaaaccaggttggaaccctgctttcggaatatattctttcggctcttgcagaaaagaatgcggttccaaaggacggatacatagtaaaaacaatagttaccactaatataattcaggccatttgcgacgcttatggcattgaaatgaaagaggtgctgaccggttttaagtttatcggcgagaagataaaagagtcggaagagaacggaataggaacgtacatttttggatttgaggagagctatggttatcttaaaggaacctacgcccgtgataaggatgcggttgttgcgacaatgctgattgctgaaatggcgctttattaccaggagaacggaacttctatatttgagcagatggacaacatctacaagaagtatggatactataaagaagaagttgtgtctgtaacgcttgagggaatagaggggcttgcaaagataaagtcaacaatggataggctgagagagaatccgccggagatggttgcaggcaaaaaggttattgctgtgagggattatcttacaagtgagagagttgataagctgacaggagaaaagagcgggatacttctgccaaagtctaatgttatttatcttgagcttgaagaccagaacaactttataattcgtccgtcgggaacagagccgaaaattaagctgtactgtttgatgaaaggcgagactgaggaggaggccaatgagcttcttaaattggtgaaagaggatatagacaggataatagaataattaaattgcgcggcaatataaaacagcaggttaatatggttgcttggcaattaaattttaaagtgtgaaaatttaaataaataagacaacggggccgatttttaatcgtgccccgttgttagttatggtaattattattttacttattaaaaaactgagttttctttttaaattaatatataaaaaattgtggttttcagtgaacatcggtaggtgtgaccacactttttttaaaagtgtgtgtgatacatactaacttgttttgccattacctgcaatgtcaataatatgaatactcaaacacggctaatgccgcctcgttaggtgagccatcatctgaacacgcagtgttcaatatatcaaaaaaatatttattaaaattaactttgtatatgaccccatataaaaaattttattattacataataatggtgtttgaaccatttctatttctcgtaagaaaaagaaacgcttcaccaaagaaaaagtactgctcgcttaggtcgcctaacggctccaaggggcgctcgcaccccgctcatttcaccatgaagcatggcttcatgatgaaaaaagccttgtaactttcccgttgactttgtgaactgccgtgaataaagatatttcgagttcttatttatttactaattaaaaaactgagttttttatataaaaacttactaaatttctgattatcttttcataagttggtaaatgccgatatattccgtattttagggctttatcggtattttctttttggaagataccttgcataagctggcatttaccagcatgaaaatgcaaccaaaagtagtaaatgagtagtaaatataagctccgatattaacaagccagtctttccagttctgcttttgcagattgaaatgtaccgtgtgcataatagccaagtgtcatggttatgttagcgtgtcccatgagatattgcagagtgttagggttcattcctttgtttgccatattcgtacaataagtatgtcggaatgaatgtggtgtgatgttcggtaacttgtccgtgtgatacttgttatacttcttaatcagtcctcgcaccatgccctcatagtttcctgcaactttaggcaagccctcacggtttaagaatagaaaattgctgtaaccacctacaatcagcggttgtgcttttcctctgttctttagtattctttggattgcttgataagcccgttctgtcaatggaagttcccgttttccgtttttggtctttggcgtttcaatatagtagccgatttcgctatctttcaataactgatggtctatattgagtattctgttctgcatatcaatatgcgtcgtcagtccgcaaaattcagaaatacgaagtcccgtttccagcagaagcacaatctcatcataatacttgctgtaaatcttatccgtttccataaaggcaagcaggcgttcttcctgctctggtgtaaggataactttctgctccgtatcatcttccagaacatcacttagcttaaattcaaacgggttctttctgatacagtcgtcttgtatcgccatgtaaaatgacgctttcaaggaacgcttatagttatcaatcgttttgtaggcatatcctttttcactcattctgatagcccattctttagcgtccgactgcttgacggtatcaatcgctctcatacccaacgggtcatttttcagagcgttcataagatactgtcgtcctttttcagtagcccttttgatgttctttctttggctgttcttcttgtcgtagagctggcagactgtcattttaccgcctgctgtgtcgataccgtcgttaaggtctttttttatctgtgtttctttttccctcaacgatatatcatcacgttttccagcaggtgtcttgtctgtcggtacaagtttccaagaataaataaattgtggctttccgtatatatcggtatatttataaacgtatcttccgtcttttcgctggctctctccattacgcaaattgcgatttttactgtcttttcgttttacattagacatagtgtaaagctcctttccgtcatggaatgagccgtgatacgctataccttattataccatatctacggctcaatgacattagatttcgtccaatgtatctatgattttttcaaattgttttcgcttaatctgaatacggttgccgttcacgataacccagccagcgtcaagattttcttcggctaatttacgcaatttcttttcgccaatgcggaagtatttagacgcttcttcaatcgtcagcgtatatttttcccagataggcacatcagtattgttcataatctatgcaccccctttactgtgtgtcattttttacaagcaggcagacggctttggaaaactccgttagtatctcaactattcccattcttgtgggcagaaccgcaccatgcggacgtatcattattctgtgaggataggtcgtggcaaaacgacttttccaacagtcgctctcggatcactgcgtgggtcgctcgctttcttttaaaaggtcgtggcgtacagttcccgtggctcgctatctcacaaacgtatctgtctgctttattcagttgtcaaagagctgtagcgaaagcgtgttgctttcatgtagaagcaggggcagagcaggaaagagggggacattaaatcatgctccgctaaaaactgcttatttttctggttccaagtccatatcttcaatattaaaacctaaaatcattttgataagtgcttctctgatacgtccttttaattccatgtctacaacaatataaacattgccatattcgtcataaagtgaacgtaaacagcactttgatatgtacgggtcataaaatgccagcaatttctcaatcgctttttcgtttccgtccatagctgatgaaatcaagtaataggacggctttttaaataactgtttcattttctaatgttcctccttgagtatttttttcataatttccaaagcgtgatgtcgatttctaaatacaccgctttgcgtgattttctgcaagttggcaatttcactttctgtcatttccaaaaagtaatacatcaacagagtattgcgttttctttctggaagtttcttcaatgcttctgccaattcatcatcaaggacacgaatatcaatgccacatactgaaaagattgtataatctgtttcgtagtcgtcccaaacagtcattttatcaacaatgacatctggcaattcgctgaaagatatttctttatttttacgacggtttaattccttgtaataatctttcacgacactacgaacaactttctttaaacaactttcaaaacgacattgaactgttttctggaagtcagacggtttcatcaatctcaccccctttcctttatgatttgaaaagtgtttatccctctttccgcaccatataaggacagctaggtgtgatttaatgacctcttttgaaaaatttttaagtttttttcgggtatgaaaaaagcccgcacaaaacatatagtctgtacgagcttttaaagctaaataatatttattttttaatagtgtactgttaggtggaattaaattgtaaagaattgcacttaaaacattccataactcaagcccccttacagcaaaatactatgcaatgcctaatcgaacttattgaggaaattttaaagtttctaattttcttaaaatcaaggattttgtttgttctcttgaatatcccatttctgctaattcatgcagacatttgattatctgtaaatctgtttcttctttcatttttgttattatacagcagttatcttttgtaacaaaaaaatcatttcctttttttacgattaactctttctttctcagtattttataagataattgaattgtatgtttactaacatttaattctttacttaaatttgttattgaaagtagcttttgacctgcttttaatttctgttgaaaaatttctcgttctatataatttgatatttgttgtgcataagggtaaacatcattaagatataactccatgtgtatcacttcctttgttttatcatcaataagcaactattcaatgcttaatgtaaattatggactgttccttttgggaatgtaattgtcagtcttgtatattccgtttctttagaagtaatatctaatttcaaacctagtctatcagataattttttcgataaatacagtcccatgcccgttgcatttgctttgtttctatttgaaccagtaaaacccttttcaaatactcttgataagtctgacgcttttattccacagccattatcttctatcacaagcagtatatttgtttcattgtcttgactgtatatcgtcagtttattttcctgcttgtcaaaatacttaatcgtattttgcacgatttgagatagaatgaatgtcagccatttttcatcggtataaacaacattctctatatcatggatattgataaccgttttcctttccataagtgaatgacggaatttcaaaatgatattatgtatcacttcgtctaaatttaactgttttacaaagtagtctttttccgtattttcacttcttgcataatagagcatttgctctactaactgaaatatcttatcagtttctttttttaacgtataatttttcgtattatcaaacgtcaaagacaatgcccctatcggtattttaatttcatgggcgaaactttccacatattcttgatagtcctgcttttcttctgtgattttactgatttcatcattcatagatttgcaggctttttttagtgcgtagtaataggcttcattttgaaattcttttggctttggtaaaacgtctgcaatataataggtttcttccagtccgtctactaaatcaataatatgttgtgaagcgttacgtttcttccgatacaaacaccattgaaaaaaaccttgtatgctgatgaacagaattaccagcaatacaacaaatagcgtatctacaccgtagaaaatcaagagaaatactactaaggcaagaaagaaaagctgaaacaatatctctgttattttttcttctaagaatgtaaaaaagctcacagtttccaaccctttcctcgtatattttccaataaatgaacaataccgatttctttcattttcttttttagacgggtcatattaaccagtaatacattttcgtctaaataatatttgtcgttccacagcttttccaatagttcttctttgctaataactttatcttcattcataaagaagtagtataagatacgaaattcatttcttgtcagttcaatgcttttctcttgatacttcaaaatggataaatgtaaatcaagggtacaatcttttttgacaagctcacggaaattgttcgggtttgataactgcaatgcacgcttgatcttctcaagaagaataagcgtgtcatacggctttgtgataaagtcaattccacccacttgaatacttttcaattcgtcagcatttgtatctctgcttgttacaaagataataggtactggcatagcttgttttattttcctgcatacttcatagccattttcatacggcaggttaatatcaagcaaaaccagctctacgcaatattgctttaattcctctgtcagattttcaaagttagtcaacaagactgtttcatatccttgtgtgttcaatagtttagaaagctccagacgagtgatttcatcatcttcgataattgctattctcatttccacacccccttgatttaccattataataattccacagcaggagagctagaaaaatctaactctcctcattgatatttcgtttgaaaccgatatacgttgctatccaataaattccatagataaagaagaaaatcgccaaacctactacgaagtaaattaaataactatactcactttctaaataaattttataaacattattgactgataccagcataaagaaacttgcaagaattgaataaataactggaacaccaaataatattagtaattgctttctgattgttttaaataatgatttatcattcactcccaatctttttaatgtttgatagcggtatttgtactttgtagagtcacttagtgattgaatagcaagaactgttccaactgccgaaatcaaaataaaggcaatataaagacaaatgcttgcaatcatagcggtcatcgtattttgttcttcaatagcagaacctcttacagaaagtctataatattgtacgactgtttcaccatcatcatttactattactaatcgatgtttcaaatcttgtttgattttttctctaagttttgtatctgtttcttctatggtatctataatcagatgttgctcagatacttccaagccttgaacatattcatcaggcacaataacagcaaatcttccagtattatttatttgataccaatacgtttttgtatcaatgccctttagttttaattcttttccacttgtcaactgaattttttcaatatccttgttgttttcaactttatataacaaatctttgctagttacaagaaaatactcgtcattacttaattctatggtgtccatattctttaatttcagtatttcgttataatcacttaatttcattactgggtcataatcataaaattgcacgtcaaaataattctgcatttgatgtttcggttctttataaacatcaaattcgattgctttatttattgtataatcttcatcaacaacattcacatattctttaaaatctttaaatggttgtttttcttcaaacacatgaacatcaaacggagctgtcatttctatgcttgctttatacactcctttattgatacttgaaaaatttaaacataacaaagaaagtaatatcaacatggaaagtgtcccgaacgtaaaactcattgttcttgcttttgacgcaaaagttcttgttacaaaaaggttatctttttgatatttaagttttttatttttcaataaaaccgacaacaacatatctgcacaagtagctgatacaccataaatactgataatcaacatcatcatgctaatcatcaaatacgtaagagtttcttgtttaccgctgttttccattgtccaacgtgaagcccaaagcaaaatagcagtaattcctaatataacactaacaatgaaaataatatttctctttttattgctacggaacattttcttttcattctgcttatcaaaataaagaaaatcatgtaccgtcatttttctaattcttcgtaaaagattaagcagaaccaatacgtatattgccaaaaagtaaatagcaagcaatcctatggaaacaaaatttattgaaataaagattacttctggaatacctaataagtttacaattaccaatgatacaaattgactaaatatgaacccaagaggaatagccaaaaccaaagcacatatcgctaataacacattttcaattacaagcaatcgagcaatttctttttttctaattccaagaagcatatatgttccaagctctttgcttcgcttttcaaacataaattttgtggtgtagttaatcaaaaaacagataacaaatataataacaacattcacaaaagctagaatatacttaaacgtatccatgcctgtcgataattctattacttcttcagaacttgccactaagttaaaagcaaatataagagaaaatgcgatagtaacagttatcaaataaatcaaataatctttaatgcttctttttgtatatttacctaacatttcccacttcacctccgagcaaggttaatatatccagtatttcattgaagaaatcttttctgcttttttcccctctgaaaatttcattgaatattttaccgtctttcaagaacaaaatacgtttacaaaaagacgcactaaacgggtcatgtgttaccattaaaatagtagcctgcattttcttgttgatgtcagacattgtttccagtaacaatctggaagattttgagtccaaagctcccgtcggttcatcagctaatatcagtttcggttcattgattaaggctcttgcacaagcacaacgctgtttttgtccgccagaaacttcataaggaaatttcgataaaatatcacgaatacccaatttatcagcgatagcatgaactcgtttgtcaatatcagcagggttctgtttgttgattaccaatgacaaagaaatgttttcttcaatcgttaaggtatctaaaaggttgaaatcttgaaaaatgaaccctagattttcacgtctgaaatcagcaaaatctttatctttgattttggtaatatcttgattgttgactgtaatgtgtccgctggttacggtatcaatcgtagagatacagtttaatagggtagtctttccagaaccactagctcccattattgcgacaaattcgcccttgtctacatacatagaaataccgtctactgcctttgtgatatttccagagttacccccgtagtatttttttacttgttctaaatttaaaatgtgttccattaaaatcgctcctttcttcctgccacatttatttgttttggaatacgattaaattatagtaagggcagtattcaattacacttacagttttgaaagtaaacagagagtaaaagagccgtgataatgcagatcacaattctgtgaagcattttcacgacccgttactttcattgtctaaaaaattacaattacaaaccttttataaatagtcgtaagaaaccaattcttccataggaatacgtgtagcaaaatgacgttctgggtctgctggtgtttctttcccataaccaatgactaatatattgactggttctaaattatctggtaattgaaattctcgtttgattacatttggtttaaaaaagcatacccaaactgtacctaatcccaactctgttgcctgcaacatcatgtggtctgtcaaaatagtagcgtcaatatctgttgtctgtttgttatcaaaaggtcgtgtccatgcttttgaatggtctgcacaaacaataattgccaatggggcattatatatgtttccagcttttgcaatacttttcaatcgttctttgtcctgcaccaccaataatttaactggctgtaagttcgccgctgttggtgcaacatgagcagaagcaagtattttctccaacttttccttttctactggtttatcttcgtatgttctaacggaatacctcttttttgcaatatctaatacattcatgtttcaatctcctttgttcttgtgaattaggtcaacctatactataattatattcgtaatagtctattagacaagaacgcactattttgtaatatactacccaaaagaaaagcgagagaacattatggaaaataattgctgtggttttagttgtccagttgaagcaaccattcaactaatcggtggaaaatataaggctgtcattttgtggcatttaatgaataaaacattacggtataacgaaattcataagctcattcccaaagcaacagataaaatgttagcacaacaactccgtgagctagaaaaagacggattgattaaccgcaaagtttacccagttgtaccgccaaaaacagaatattctttaactgaatttggaaaaaccttaacccctattcttgatgaactatgcaactggggagaaaactatttgctccaaaaataatttaacgccgtgataatcagatctcacgctgtgagttgtttcccacggcgtttttatttacacttttacttttgtctttttcgtaatgatataaatatattcttctggtgtagggcgtttattcccaaaatactttttgaaatttgcctgcacctctgggtcggtgctattcatagcttcatcaatcgttgcttcaatattttcccgaacatcagctaatgacatagcgccagcctttgcacctgcttttaacgcttttttaatatctcgtttttttattcttagcattaaatcactcctaaatatctctgtttattatctgttggcaaagaaagcaccaagaaataacaaaaagtattatcgctgtaaaaatgctaatagtaagtgccaaaacatgattttcaattaacttaatcatgccaaagaaaaatacacccgatattccgtatgctaaaattccaatagctccgcttaattcttctttgataaaatagtaacaaggaataagaacagcccctgacataaatatcatagtagttgtcatacaagtaaataataaaagcaaatgtgtatctagttcattacggattgaagtaataataatacttaaaactagaccaacaacaacccctaacaaacataatagagcatacataatatatttactgctaacatgtgatttttttgatgttggaaatgttattgatgatttcaaccaaccacattttctgtctgaataaattgtagttgttacaaattgccctagtataatagaagctatcagcattaaaacatagggtggagcataaaaagaaactccgaacccaaagacaacaaagccaatgagtaatattatcatcgaagatttaatagcaaaataatcttttaataataagcctttcataatcaacattcccctttcacataaagtaacatgatatcgtctattgaagcaggtacaactaaagtatgtggatattccttttttgctttttgtctatttgcaacaagcacttgccattcataatcttgtttcttataacggataatatcatttttattcaattcatcaaattgtttagcattgcatttgatgataccgtattgctcagtcaattcatctttaggtcttgaaaataatactttcccctcatgtataaatacgatataatcagcgattttttctaaatcacttgtgatgtgtgatgaaaccaaaatggaatgttcttcatcttgaataaaatctaaaaacatttctaaaatatcatctcgtataacagggtcaagcccacttgttgcttcatcaagaataagcaattttgaattatgagatagagcaaccactaaggaatacttcatgttcattccttttgaaaattcttttaattttttattgataggaagttcaaacttatttaatagctcaaaatatttttcattattccattcagcataaatattttgaaaaacttttcctaactttttgggtgttaaattatcgggataattacttccatcaaatacaacaccgatatgttctttcgtttcagcgttgacatctttcccattaaatacagaaattttcccttgctcagtaacaatcaaacctaaaatagctttaattgttgtgcttttccctgctccgttttctccaatcaatccaacgatactaccttgcggaacagtaaaggaaatattgtcaagtttgaagtcactatattgtttagttactccattaagttccaaagcatatttttccataatctcattcctcctcatataatagtgcaagtaaagattgtaatttatccagctttattccgcttacctttgcaatttcaatcgcttctataaaataattttctattttcttttgttgttcttctaagtagaaatcttgattttgaacggatacaaagcaaccttttccagcagttgtttcaataaaaccgtccttttgaagtacatcataagatttttgcaccgttaaaacactaatatgcaacgactttgccagtcctcttatagagggaagtgcttctccagctttcaaatctccgttgataatcattgcctttatttgtgaagaaatttgctcataaatcggtatgctggcatgattattgataaaaatatccactataccaccgccttgtcttatactgtattacctttacaagtacagtatagtattatatgatacgattgtcaataagtttaggcttgtaatcatgcaaaaatgctaactacaagcctcttgatttatcctataatcttccagttgctatccttatgtagtacaagttcatactgcgatacttgtgttgcctttgtctgattatcaaggaattttacagcaaccttaactttcacattgtccccgtcctttgtaaagatagggtttaccagttcagaataaagatagtccctgccgataggttcaagcacatttcccgttacataataggcaagttctttttctgtggctgttgggtacagcttaaagaatgtttccagaaaagaggtagcgtcattgacagtatcagcgtctacgcttgcatctgcttctggtgtcttaggctcatagtccgatttttcgattgctggtgcaagggtagggttctgaacgattaccatatccccgtcagcgtccacatggacttttacggtataggttgctttcacattgcttgtctgttctccctcttttatctgctgatctacttcgtaggtagcagaaaaagtgtccgttcccgactgttcgatactccatacaatcacatctgtaaccgtgaagctggttggtatatcggttctaatggtatccacattcaagtcctgcaattcctttgtcagataaccgttgattgcctgtgtccttgcttcaatcgcttctttactgttattccatgtgtagtaggacttcgcaaaattctttacgaaattttctatcccgttggtatcctgcaagcgaagctcaatgatttctttttcatgggtggtgtgctggtcgatagcggtaaaattcttatacaccccaaaactcacgcttgcgataagcaccacccacaacgcaatcacggttttcttatgtgtgcctaccttgacagtacgcacctttttttcttttggttctttgagagtttctgtctgtttcttattcttcttaaacatatttttcaagtcctttctattgttttactcgtcctgcaccgattaggtgctgttgccagtaactactgcttaggtctgcatatcctatcgggtcgcctgcatggtacatctgattatttcctacataaatgccgacgtgcgttacatacgaaccagcgttataggtagaatggaaaaacaccaagtccccagcctttgcctgcgagagtggaagatgtagggtagcgtcatactgtgcttgtgctgttctcggtaaggagataccagcttttccatagcaccattgcacaagtccgctacaatcaaaggaagtgttcgggttactgccaccatacacatacttccagccttgatatttcaacgcttcattcataatcgcttgtgccgtcgcattatcaaaatgtgccacagtcagatattgattgactaattccacatagaacatatttccatagccataccgccagcccccattcttcgcaacagctatcgggttggtgtaggttactttctttccacccgacttctcacgagcgaagctctctgcaagattaaaagtgtgtttctttccttttcctgccacataacccacatagccaccgccatagttataggactgtatcgctacattcaaatcgtcgataccttgatttttgcaggaagaaagcagggacgcaaaatacttacacccctgcttgattgaactttccgtatctaaggaattaggcggtaaaccaagactttccgaactctgcataacatcttctgccgtaccgccactttctacttgaatgatagccaatagcacattgacatactcggaaatgccgtattctctggcgtatttttctaccataggctgatgtttcaagacttctgcggataggttcatacccgtaatgccagaagaaaaattgctgttctcgtcgtcgctgtccgcactaatcaacactccaaagaaaagcaccagagaaaagaggataggaaacagactgccaatgatagcgatatgtttcagtttcattttttcttctgtcctttcttcgttacaaggttacgggttttctctgttgtctgctggttcttctggacgctctgcgtctgctgaacctttgtcctgcggtctttggggtaattctggcgtgtttcctgcgataccactttttctacattctgcctatgtactggctgtgcagactgggtcgctttcctatcagaagcaccagaagataacggacgctctttgataacatttgtcttgactggctcacttgcttttgaagtggtcgctgtggcaggacgtttgacttcctgcattttttccgcactcggctttgaagctgtggctggtcgctcatggggacgggtagctcctgttgtcgctgatccgtcagcctttcgctgtgcctgccttgcttcttgtgccttttgaagctccatacgcttgtcagcgatatttttcttgtgctgttcctgcttttccaatcgtcccgtctgtctggactgctgttcctgcaccatgccacgcttgaagtcggacacgctggactttgccttttcctttgcggaatacaccgcataagcggtctgtgtcggcatatccttgatgttttctttgacagcgtttgctttgtctttcactttatttttcgtatctaagacagcacccacctttgagcctgcacgctgtcccatgctggaagtggtattgccccgattttctttagaagctgtattttttctttcagctcgtttattagcaacggcacttccagccaccgcaccagccacaccgcccgaaataccgccagcacttaccgcccttgcaatacggtgttccatacgcctagccctatgtcgcataaacagatacggtctgcggaaaattcttcgtcccatgctttgactgtcattagcgttcaaagagaacatactcattaaatcgcccagcttcatgtagataccagcgaaacatactatctgcaagaacgctaccataaagaacgggtaatctttggagatgttataaaacatactggaaatgctgaacgccaccgttacaatgagcgttatgcctgcccgtgtcattatggtattaaacacccttacgattgcctgctttgccatgctttcatagctcggtatcatggaaagtaaaaagctgataggtaaaaacattgcaaagataataaaaagtatctggctaaacaacatcatgcccgtaagcaagaatacaaatatcgtgatacctaagttaaagaacaagaggaaaaacaccatacctaaacggtttaccacctgcggtatcgtcagattgttgttgtcgttgtcctcgatttctgttttcacgacttcctctctggttttcccgtcctcgtcctctggacttgccgatacaagagcgaccacacggtctgccccgatttcttctgcgttgctgttcccgaattgtaagagtagccacggctgttccacttgaatagaaaataagctgtcccgtatcaagtctacgctgtccttgccctcgctgtcagagttggggagcatgatttttgttcccaaatcaagtgaagcggtactgatgtctgatgaaaattcatttatcttcttgatgtaatcgggagcataggcgataaacgaagcggacagtacgaacaccactacaaagttgataacggcgtgaagtgccttgctggtttcccgtttgataagtcccgtataggcaacataaagtcccaccactaagataatgagaagcaggaaaccaacataaaagccagagctggaaaaaccgttctgtgttacgcctgcaagggtctgtatgctttttccgatactgtctgccatatcgttgatgaagtccagcttataggcttcctgcactacatagcccgtggcattgcttaaataaaggcttatcgtccagacaaaattagtgatacagtaaagcccgtactgcaccgattttccgataccgtccagccagttccacggaagccacgaccagctattatctacataaaaatcaagctgataattcgacagcggatattttgagtaaagattttcttcgtttatggtatcgtctacaagtcccgtcgcatgagccaccgtccccaaaagtgaaagcaggataagggagagtgccaccacgaacagagccattttgagaaagtgaagtatcttcctttttgtgaacgcaccttttatcctttctttcatcactccacctcatttctctgtacgggcggtctggtatcaaaggcgtgtagcagttcttcaaagacggggtgtatctgtactacaccaacacgcccgtataagtcctgcaacaagcattgtccgttatccaaatcacgcaagcgtttctggttgttttcgtcgtccttgtcaatgccgaaaaattctagggtctgctttatctcgcccaagtcggtactacgaaatgcaaatttcaagccgatattgtttttcagactttcctttgccacgtccccagaagattgtgtaacgaaataaacgcctgcctgcatagctcgtccagcacgaaccagcttatttgatagggtttcgccttgtgccacatttaagaacgcccacgcttcgtcaaggtctacaatcttaaaaatacttctgtccgaatggataaaatcaagggcaaaggtactaatcacaatcagcatagataccgacaataattcaatggtcgtgtattcctcaaaggttgtgtccttatctggcagtacaaggtcagctacttgaatgatattgagctggttatccagactgatagcattttctaccgtaccgtctgaaaacagcaggtgtgcaaaatcatagtccgtgaagctgtcgatatggtctgcgatattccttgatactggcgtatcttcacggcgtagctcgtctattacatggagcaagccccgactgtcgctctgggtaacggaacgaaccgcttttcgcaacacggggaatttttcgccgtccctagaggaaataccagtaaggaatgtcaagatgtcgattgccagactttcagcgtcttttacattcttcataatcacaaacgggtcaagaagccctgcattgtccttgtcgctggtaaggtttacgatattgatttcatgggcgatttctgggagcgtttctttccagttgccacgctctgatttagggtctaagataactgcttgtcccccaaagagaaccgaataatacaccagaagattgttacagaatgactttccaccgccaagcgaaccgacaaaagcagaagctaaagcgttggtaactgtaccttttataccttgactggcaagggacggttgcaggtacacatttcttcccgtatcaacggaatagcccatatagatacccgtagtttcccctaactgctgtgtcgcaccaaagccaagcccagccaagaagtctgattttacatactgcacataatcgttgatatatcgcttgctggcaggaagaaattcagaatgaagccccagcatatccccagcaggacgcaccagctttacattgaggtcgtcgtaaaagtctttgacttcatcacaacggcgtttcagctcgtcaagatcgggtgcagacacccgtatcacgtagcttaacttatacatactttctttgctctggtctaagtctgtttccagctcgtccacgctgtctaatgcgtccaccacatttgagctggtttcacttcctgcttgataagcgtgattgtcaaggtctttcaattcctttttcttatttcttactgtggtaagagcctttctgttctccacaatttctacattcatgcttgtatcaacggggaatgtaaactgctgttgctggaaatagaagatttcagacgacggaaaatcaagctccccgacaatcgcattgacggtaaaataggatacatagctttccttgtcctcatgttccaatcttaaatacctctggctttcctcaatcacacaccttgtcggacggataaggtcgtagtattttatcagcgtttctttgttcaattttttctttggtagctggtactcataatcttcataagcgataccgtccctgccgtaaagatgttccatgagatacccaaaatcgttgatttccaagcgacgcaccttaaagcgacgggagattttattttccagtaacttttccattttcatgtaacggttgatttcatcattcggcatggaaacaaaatcattcatcagcgtatggttcacttcatggagaaattccgtgaacgtcagccacgccgattttttgatgttcttcagattgagctgttcttccgtaaccatgagcttaaaaccaagaaaaaagcggtagtccacttgattgtccccaatcatagataccaacgcttcggtctgttcgtctattttctgataggcaacttcctttaattttcccgttaccagcttctttgactgctcctgcatacttcgtatggagctttccgtggcaatctgcaaggcatgaatttttccctcacgggactgtgcgattagctgtcggaaactgtcatgcacgataaatttctgctctgcggataagaaagaatagttgtacggtatcagctcataataggcgaacacctcattgtccttgttccagacaaggttattgtcaatatattttatcgggaacatagttcacactccttactgccgtgattgtttcattcaatatctgcttatgcagttttacggcttttcctgcataagtgattttaggtcgcaacgcataagttatctgtgatttcaaaaagctgtacggtttctttccgtcaaaggttttctgcgacataaaccaagtgagagcaacaggaataccaaagtatttgagaaatgctccctcaatcatggaaagtgggggaatatccccaaacagaatgatgataaattctgtaatcacaaaccatgtaatctgtgtaaaggtaacgggaaagggcaagttaaagtcattgattgcatacaagactttttccacgttccagatacccgtataagatttaatctttttcaaattctttcagctcctttcaaaatagaaaaggacagccatgtttcagactgtcccttaaaagagaaatacgctgtcagtagcaacaatgcttgtcgctgatcttccagcgttagtatggtatctcgcacatacctcggcttgtttcaataaagcaaccacccatatccaaatctcgcccataggcttcatagtcaatgtagttctgtaagctgggtggaatatcccctagtgcctgcaattcgtctatgtagtaataggcaacgtctgtcatggtttcacagtcgggataataataaatatcgtccttgtgttccacgacttcttccagcgtcccgtagtggctgataaattcgtccagacactctacgatatagtcgggaagttcctctatcatttcatacatttcattgagttcttcaatggaaacatactctccaatcgcaatagggaagttgtcggtatcatggatagcatattcctcatattgttcatttaagccgattttttctttcacatcttcctcgtcaataggaaacgtgaaccaagcaccgactaaatagccctcattgtatttgccaagattagcaatgtaaaccgccatatcatcaatcataagcaccacctcatttcctactctggcagttcaaagatagcgtgttccgttactaaaaatttcccgtgttcctgcaagtgagaagcataggcttcaaagtcaaaataatattcttgacagtcctcggacagatgtttgaacgtcgggtcgttcatcagcttttgccttgcaacatctatcatgattttgcagtcgtgataaaccgtaatcacatttctgcaaatataaagtgcttctaaattttcatacaccgtaagaagtgctgtatattcttcctgcatatcgctcgaaagctggcggtacataaaatctaattcgttgagctggtacacgctggtatgttcgtggacttcatcagcataaggcaacaccttttcgataatgcggtaatccccactttctgcaccgacacccagcttttcttcaaactcggcaacatctatcggcaggtcgaaccagtatgatattgtttcttcgccagttgttcctctcgtttccaccagcacccttgtttcctgcattgttcctcacgtcctttctgttgttttatcacatcttttatggtctggtacgacataccaaacacatactttgaaaaatcttctaactgtctttcttcatagtcggcagggttcagtcgtttcatttcatgccacaccttacgcttgtaagagggcaggtcggaaatgtattcacagccgacttttacctgcatatccttaaaaatatcgttcatttcatcactccaatctgaaatttaggtaagaaaaaagcagtcaatcctaagactaactgctttgtgtgtatagatataatttgattaagttttaaaaccagcttattttttcatctctaaattgagggttatcgctgtgctgatatggattgtagttattcaaattgcaaccatattcttttaatgatttgattttgttatcttctgtccattcaattaaggaaataccgtcaaattcttcaacacttcccgtattcatttcatttttaaaataccattctacgacagtttgattttctttatgaaagaactgtttaatatcccaaataatgactttaccacgagtattccattcattaaaccaatgttttactgttttaagattttcatatttaggacaccagctttccgtataaacaacatcttctgtaaaaattttatccattcctaaatcttgctgtttaagccacatatcgaaccataagcgaatgattttttctctctcattcataataaaacacctcaatcctaagaccaattactttgtaaataatgaagttgaaaatttattttatagaatttttgccatataaaactcatcaacaaaggaaccagcaacaaacattgatttttttcttattccttcaattttaaaaccatttttttcatacaaattttttgcagtattattacaacattcaactgtcagttccaaacggacaatattatttgttttagcccataaatctaaattattaaaaaaagtagttccaataccttttcctctatatttttttaagatacctataacaatatatgccgtatgaaaatttctttcaaattttcctctttctgctctaatataaccaactattttgtcattttctgttgccacttgcaaaaaatcaaaaccttgaattacattgtcttgaatatctaattttaattcttgaatagtagttttcgcttttctttcatttggttcgtacatcatgtaatctgtttcagtatctaaacgatttaataactcccaaaaatcttttattctattgatttccaatttgctataaataatcatattttcaacctcaaatagtattcactttatttcatattctaaattataccattctcatatcagcaccacaataaaattttatgcaccgataatcttattgaatagttctaacaatacatctttcacaccgccagcgttgaacaccaagccgacagcaatcaaggcaactaccaagaagccgataagttttgaaaactcacgcttgaaccctaagtagataccaataaccacaatcgccataagcactaagctctgtgcgtttgataaaaaccattgatataaattctgtccgaaattcatttaattgtcctcgctttcttctaattgtttcatttcatagtcagcttctttgccgacattcaaaatacacatcaagactacgccgatacccattcccatagataccagcaggaagtcttttaataatacccacatttttcatcactcctaactttccaccaaatcttttgtaggggtcgtctgctgtttgattatcatttcatgcttttctgtgagctttgcctgctgttcgattgtttccatgtagtctgtaccatttcctttatcaatctttttcagcattttcaaggtcggtgctacctgcctttgtacccaccgcaatgtgcggtctaaggtgtaaggctctggctttgtcgttagctttaagctctgtctgttatcgccgataaaccaagcccagcggtcattaagtttccagtcatttttccgcttgtctggttcttcatcaacaaaccgcacatactggttgataatcgaaaaggcggtctgctctgcgtcataataggtcagcaaatctcgtactgcataataggcacgttcatttctaagccgtatctcaaaacgattgataatgtcggcttcttccagcggtgtccccagcttgacgtactgctcatagtccttttcatagatacagaaatacacatctgatttcagcgaaccaagataaagagtacgtcccatatattctctgtcgtcctctctgtgcttgataagctcgcccgactggtaaaacttatagcttctggactttccgatatattcccgtttcctgcatttctccgcaagctctggaatatccaaaatgcccgtatggtcgttgatagcaaggtcgatacgcttcatcacgccaccgtctactaatgcgtccatgagaaagtcataccagcttctttgctgtgccagcaggtaactttcaaactgcctgcaaccacgcccctttaattctaaaaggacacctttttcttcgtcagccgacgtatagataaagatgtcccctaaagaataatgctccgtataactgtaatgtccgtaatcttcatggagcatataattgacattcagttttaatatatctttgattatgtgctgtatatccagcgtgggaaaacgaatttttacataatcaaacagcatggtaagcggtgcttctggattgaaccttgccaattccttatgcaaagtttccagaagttcctttgacggcttcatttttccgctttctatcttgttgagatattctcttgtgataccagaagccaccgccagcctgccttgtgagataccgtaagcaatccgtttctcccgtaattcttttatccattgttcttcattcagaaccatacccccaatctgtcaagtgtgaagttttttaaggcgacttcacagtcgatttttgttaggaaaccatgccagaagccttatgtttcctatgttttttgtctattgtctatttgcaaacgtacccctctgttagatgccgaggggttttacctgctggcgtggcttacgccacaccagcaacggctagtccgtgccgtcgcctttcgcttcgcacgtcgccgtcccgtcctgccttgcattattcgattaccagcgtgaacgcttctggatcatcaacaatgttgtatgaaccgagcgtgtccgctgtctgcgtatatcggaagtgaaacaaaggcttttgtcctttcatggaaaaacgggaacggtacaccgtaccatataaagcgtttggctttgccacatcatagctgaacagagtagaagcaaaatcattctccctgcattttttgatgatttcctctgcacacttttctttgtctgttatgataagacggttgagcgtaaaggtaacgtgttcttcatggaagttttctgatgaagtgcctatacttcctgctacatcaatctcacgtccccattgcagataggaaaccgccactcccagtacaaaaagtaccgtgattgttattatttttctctttttgcacatactgttactgtcctttcttgtagggtgtattataatacagtctacggtaatacatcttatttatcaatacagttgtatcttataattcaaagaaaagacgaggtacagcgtatgcaggtatatattgatttagaaaatcttttgaaagagaagaatatcagcaaaaacaaagtctgtgaagcgtgtaaattacagcggacacagcttaataactattgcaagaacaaggtttccagaattgacctcacaatccttgcaaagctctgtgattttctggaatgttccccaaacgacatattgaaattgaagtaggactgtcagctttcgttgcttgcagtccttttttcttccagtctgccgatttcttgtagaaagtcatgtccttttgggactaacggcgtgtaaaattcgctgataacgcttgttcccacatcacaataaccacgccccttgatacgcttctgaaaaaactgctttttcacatctgaaccaaacagcataccgtaacctaattcgctgatacgccccaatcccacacggaaattgaagttatctctgataccgtctgaaaaatactttgcgtctggacgctggcaggcaacgataaggaaatatcctgcttgtcgccctaacataacgattttctttaactggctaagcaggctcacactttcctttgcccccagcatttcaaaaaacgccacatattcatcaaagataagaaagcagggtggcagtcccagataggcgtagttttcgcccgtcttatagttcgggtgtcgcttcatttcctcgcttcgctgtaccatgccctcataaaaggcattgacgcaatcaatcatttcttctttggtgtgatacacatttcccataactgtccctaagtccgcaaggtcagcgttctttgggtctaagatataaaggatagcgttggtatgcagtaaggcttcaatgagcgtcagcagaaaataggttttaccaccaccagtcccacctgcaatcagagcgtgagggagtgcgtcatattcccagacaagatttttcatcagcctaagacagccgttttctgcccttacttcatcaatggtaatgcggtttgctatcatatcataaagcagggtatattcgatataaccgtcatgcagggtcttgtcggtcagctcacaatacaatccactttctaacttatcctctaaccgcaaaagctggtcttgatattttcctaatgtgatttcacagcggatatgaagcaagcctttttccatttgataataaatctttggaaaccagacgattttttcccttgatctgctttgcaggtcagtaaaaaaaccgctgtcttgtacggtatcagcttcataccacttattttccagtaccattcttgccagcttttgacggtgcaggagcttcttgaaactgtcgtaacagaagcggtaatacagaaaagcgaccaatgcacaaacaccagtcgctatccctatggttatgaagttgtaaggggaaagcgtcaagccattttctaacaagctgaaatgttcccaatcggtacgcatgaactgttttgtattcagtagcaggagaaccgccacgaataccaacagaagcgtccctatggaaaaatgataaacaaggtgcttgtcgctggctctgatacggtgtcctttattccaaatcttacgcataaatcaatcactcctttctgggtacgaaaaaagcagtcaatcctaagactaactgctttttcattaccattcattaaaaatcttctgagtccaacactttatatccagcctcaattaacgcttgtgcaaacagaccttgaccttttatcaattttcccgtaaaactaccatcataaatattcttgactgcacaagttgggcttcttgattgcagaataactaaatctatttccatacttcttatttcatttagagccaactgtaccgcatgacgatattcctcatcaacaatatttccatttatatccatgacaataccatttactatttccgcactaggacgtggtgtaggcatattcgctaataattctggacaaatttcgataacctctttgtcttttagaaactctacaactttcggattgagattattcccaccgttatatttgcagttttttcccatgatacatgaactaactaatactttcatagataagcacctcacaatttatcctaattatatcattcaacgaattacctcacaataaaaatctaatctctaattttgttttttcggctgtccctgcgtgttattattctgtggattgcctgcgttctggttgcctttattcttcaacacaatatcctctgcctttacataccagtccacatctgcaccaccaaacgtctttcttgataccgtatctgctacgggattgacaagctccacaactgcattgtacggaaattctcttaacggtacttctggcggtacggacacggggataattccaccatgcagactgcacttcaaatcatagatacgctttttaagctgggtacttggtgtcccgtcctcattctgcaagaacacatcacgcaccgctgtaaattttaattctccaaatgttttctctttgtcaatgacaaacccgtttgataatctcataaattcttcactcctttacttttcttcaactgctacaatatcatcagcaagcaacacataatcggtatgtcccatatccccgattgcgtaacctcttccgtataacttcggattgacaagttttactttctgttcatacttgaaatgcttttcgccagcctgcacgggaatttccaccacaacattttcgcctttctgtacgtcggaataaaggttatagcttcgtctggttaagaccctgcggttatttttatctttttcaaagactggctcgctttcgcctgcaaattcaagagttccaaaagactgtgccatatctggcacgacatatttcatttccatagtgttttacctcgtttctttctatttttgataagttaattgattgtgatttcttattctggcggttcgggaaataccagcaatcccacagatagtaaagggtaaaatgtatgcttcgcacccttgactatccgtgttcttgcaggttgtaggcagacaagccagaataagcggaagtctgccgtttgacagcttcggcggagagcgtgatttttctttcatcataccgttaccgccttataatttcttcattttacggcgtttgtagaagaaaatacctgccagcccagcaccagaagtcataagaagtgcaagcagtccgtaaaggttggtgttatcgcccgttttgggactgtcgctcggtctgctaggcttttctggtgtctgtggtgtttcggggttctctggtttttctgggacttctggcttttccttaaaggtaatcgtctgtccctcgtcctcaatgtccttatgctcggcaactttcttcggctcgtctggattgcttaaatcgtataattcctcaaatgttacaagctgtttgccgtcaagagaagtagcgtcaaacgtaaaagcaacttccactttcatagtttcactgtcagcagtaaaggtataatcactttccacacgctttccattgataagaagctctgcattttcttctttcaacatctgccagccctttaactgatattttgtgccgacttctaagccctctaaggttacggtatcaatgattgtaacgtcttttcctgcttcaagttctttattgccgtctttatcggtagcagtcgtatgaattttgatgatacgctctgtgataagtacggtctgcccgtcgtcctcaatgtctttatgttccgcaactttcacgggttcgtctggattgctgaaatcatacaattcttcaaaggtaacaaggttcttgccacctaaagcagacgcattgaatgtataggaaatttccactttcatttcttcatcatcagcgacaaaggtataatcgttttctacacgtttcccgtcaataagaagttctgcgttttcttcctttaacatctgccagcctttgagctgatactttgtgccttttgtaagtccgtccaatttgacagtatcaacaatcgtaatctcttttcctgcaaggattgtcttttctccgtccttgctggtcgctgtggtatggatagagatttctttttcgtattcatcagtcaaagtccctaaatcaatcacaaggttatttcttgataccacgatttcaaacggtgggataagctcaaagcctttgttgctatcacattttaattcttcaatgatgtaggtatcataaggtaacgcacccttgctgtcgtctggttcagaagttccaaaccacacaccgtcctcactggtctttcctgcgttggtattgtgcttatgtgaagcccagtcagcagaagtggagaactgcccgttatcatcagttaccacaacatgattttcgcccgtcgtcttgcttgtgatcctaaaaggaacatcagcaagacgcttgtgtgtacctgctccgatttttacgccttcaatatctccacgcttaatctgattgtagatagaatgagcttcgtcagataagtccacgatttttccattttctgtgattgtaaaatcaatcggttttgcaccgtcagttaagtaaccgttgggggcttcactttcaacgatgcggaattttccataaggtaaaaggtcaaaagaagtagaagcgacaccctcaatatctgtatgaattgtttttactacttcatttttcttgtatagctttccctcaaccaaaacagaattatcatttaaggaaatgatgtcaaaggcagtatcttttaaagtggcacttccttgtggctttgtatcgcccgtttctaaatctcgtttctgaattttgacaccgccacggataaccttgtctgatacggaaaactggttacttccagatagtacggcaaggtctccgtcctcggtaatctgtgttacatataagcccttaatctgttcggacttatcgccagcctgcatatatgcaccctctaacaagtagccgtttggagcttttgtttcttctacggttagtgttcctaaaggaagaaccgctttgccgtcctgcatatagaagctgtcgccagacaccttgtatgcgtccgttaattttgtgatgtagtgggttgtcccgtcgctgtctgtttcagcgattgtctttgtaacccatgtacgagtagcttcggcagggagatttcctttattgtagaagccagcataatacttccatgtaaattccgcacctgctaaagaagcgttcccctgcggattgtctttctgtgtttccatatcaatcttgaaaagctcaatcaaagtgtccgttactttcggtgtatctgatactttcaaggttgctgtctttccagcttcaacctttaaggaatatacagttttatccactttatatcctgctggtgcggataattccttgatatagactgtgcctgcttttacctctacaatatctgtatttccgttttcatcagtcgtaagggtggcaagctgtttcgtgcagtccttatcagaaaagacaccataggtcgcacctgcaatagagtaattcccgttaccgtctgtaatgctggtattactggaaaccttttgcagtttcgtatttccgacattcagtttcgcccagaattgtcccaattcctgcccctcgccagagtagatataaccgccacattcatagcgtcctttattctctttaacaaaggcttttgcaccagcgaaaacttcgtcctgcgtagattttggaatttcatcataagaagctcgcacgttatcacattgccagccaagatgtacgcttaatctctgccagacaacgcattgttccaacagataaacttgtttgtagttcagttccttgtgagcttcgccatactgtttgacatactctaaggataacgccacatctgaaatctggtcggcactcatgcgtgagcttgcgtcagctctggtcttgtagccgttcttaaaatctgtattgatgtcaatacaataggcagtttcgccctcgactttcatcatgccctcattgaatgtagaaccgatagaaccgtcattcatcactttttcaatgataccgacacgctctgcactttccgtccagtattgcttgctttcagcatgaacggttgtagttggtaaagcagtaacgacagttgcaagagctaagaagcccgtacacaatcgttttaacatctttttcataaatctaatgctcctttcattttgagtaataaaatagccgtccaataagaacggctagaaatagaaaaggaacgtcatgttatgcgttccatagtctatgaaatattcaattttttcttgtttcaatactgatgtgctgtactatatctttgcatatctaggaaaacttgcgtatcaaggctcattcaatggtagtaaataagtagtaaattgatgtatttgtttccttgaaaatgctgatagatactgtgttttagtggataatcagatttttattgtgtttttagtccaaattaatacaaaaaaagcagggttttcagtgaacatcggtaggcttgcggtagcaagcgcgttaggtgagcaaacatctgaacacgcagtgttcaatatacaatttatattttaggatatggaatcaatacattagtacggcctaatatatagtcagtaggtacgttataaaggtcggctaatttcaccaaatgtcttacaggaatatcctttttgccaagctcataacttgaatatacagtttgacttgttccaagaacttctgcaacatcaacttgtcttaaatcattatttttatttatatattttgtttaaaatctaacataagtgtttttttgtatatgaccccatataaaaattttattattacattataatggtgtttgaaccatttctttttctggcaagaaaaagaaacgcttcaccaaagaaaaagtgcttgctcgcttaggtcgcctaacggctccaaggggcgctcgcaccccgctcatttcaccatgaagcatggcttcatgatgaaaaaagccctgtaactttcccgttgactttgtgaactgccgtgaataaagatattccgatatattatttattttctctaataaaactgttgttttggcaaacatcggcagggcgcatttatgcgcctcgttaggtgcgcagtcgcggatttgttaatatcttttattattatctttataactttctataagattaattatcagacataattttgattatgttgtatctatttaaataattgaataactatgtgactaatttcaatattattataacataattgtttatttgattacaagttaataatataaaattttacatattttttaaaatagacaacataaataagcagaatgaatatatatttttattccgcttgtttgttatgcaaaaatttattaaattgtatctaaattattatttataaaaaataataataatttttgttataaaaaataatactttatggcaagttattacaacataatcaaaattatgtgtatgtgatattatggtgatataactataacacaatttatgagttttccgtattctttttttctctttgtaacacatctattgtaatcctacaaataattgcagcaaaattttaaatcattattgatttattgtcttccgtatgttatattaaatagaagtttataggaaatataaccaaatttatataaggagtgttatcaatgagatatgtaatcggtgtagacatcggcacaagcggaactaaaaccgttttatttgatgaaaaaggaaacgctgtatccagctttttggtggagtatcctctttatcagcccaaaatcggctgggcggaacaagaccccgaggactggtggaacgctacatatacaagtataaacagtgttataaaacaatcgggcgttaaccctgcagatataaaaggaataggtctttccggacagatgcacggacttgttatgcttgacaaagacggaaacgttctgagaaaatcaattatttggtgcgaccaaagaaccacagcagaagcagacgagctaacagagaaagtcggaaaggaacgtctcgtagaaatcaccggcaatccagcactgacaggattcactgctgctaagatactttgggtgcaaaagaatgagcctgaactctatgccaaaactgcaaaaattttacttcctaaggactatatacgctataagctcaccggcgaatacgctactgaagtatcagacgccagcggtatgcagcttatggatatcaaaaaccgctgttggtccgacgaggttttggaaaaactcaatatagacaaaaatctgcttggaaaaatgtatgaatcatgcgaggtaacaggcaaagttcatcaggaagcggcaaaactcaccggacttaacgagggaactatcgttgtcggcggcgccggagaccaggctgccggagctgtaggaaacggaattgttaaaacaggtattgtttcctccactatcggaacatccggagttgtttttgcacatatggacaatattcaaattgataaagaaggcagagtacacactctatgccatgcagtgcccggaaagtggcacgttatgggagtaacccagggcgccggtttatcgctaaaatggtacagggataatttctgccatgctgaaatggacgcagcggacggcatgggggttgacccatactatctgatggataagcaggcagaaaaaatcgcgccgggctgtgaaggacttatataccttccgtatttgatgggtgaaagaagccctcacaatgacccaaatgcaaaaggcgtattttttgggctttcagcaaagcacacaaaatatgatatgctcagagctgtcatggaaggcgtatcgtacagcctgaatgactgcatgtctgtaataaaagaaatgggcatagacgcgtctgaagtacgtgcctcaggcggcggcggaaaaagcaaattatggagacaaatgcaggctgacatgttcggctgtgatatcaacacaataaatgtgtcagaaggtccggctttgggagttgctcttttagcggcagtaggagccggaatttacgacagcgttccggaagcatgcgaagccgcaatcagcgttaaagatacaatgaaaccgattcaggaaaatgttgagacctacaaaaactacttccctgtctaccaaaacatttataagtcattaaaaccgcagttttcatctgcagcagacttaaacaaataattctgaaataaaaaatggctgccaaactggcagccgttttttatggtacaaactacattgaaaagtttacccaggactgcgcgcctaacgcggtctttgtgtgacctacctaagtaatcttgaattgccggttacgtttgcgcagttctattatttcctgctcttctgcagaatggttatctttttcgtgaaaagagccgctaactgctgactgtttcagccatttatccagcaatgaggtggctatatcatattcacggcaaatatcacattttcgttttccattatggtatagctgaactaactattgtttgaattcatccgtataggatcggagctttcttcttttatactttctattttacatgaccttaacttttttgtttcctatccattatattcaaatatgtcatttaatatctgtaacgatttactcctaatcagaaacaaatttctattaaacaaatctacactctgtctttcttaattcacattttttaataataatatttcctgattatcaatttaatctattgaacagaacttacatcatattgcatatattgctctccgtccaatgtcttccagcgaaacactccgtcctccaaaatcatataagaagtcttactgttttctttcggaatcgacacggaaccgggattcatataaaaatatccgcctttatccacacattttggaacatgtgtatgaccgcagagcaaaaactcgccctttttcaaagacggcggattatcctctccaaaatggtgaccatgggtggcataaattgttgtcccatccacagaaagcaaagcatactccgccattattgggaaatttaaaaccatttggtcaacttcggtgtcacaatttccccgaacgcacagcaaattttctgacacgccgttaagcatagcgataacgagttttgggtcataacctttaggaaggtcatttctggggccatggtatagaatatctcccaggagcaaaagcctatcggcttcctctctgtcaaaggctttcaggagcttactgcaataatattcagaaccatgaatatcgctggctatcattagtttcatatatatcaaacctttctgtttttatattttaaaataatctttaaaacattttagcacaaagggtttaaaaatacaagaattaaagtgctaacggttaatttttagtcaacagttttaatcatcagataaaaatacaatgttttaacgaacatcggcagggcggcagagccgccgcgttaggtgagttatcatcgcacgcttgcgtgcatatactattttacttttttatatatttttttattttcaatatataccgcgactgcgcgccttacgcagcgtacttcgtacgctctaccgatgcttgcctcatcattggctatttattttttaacttgttaataaaacctataatcaacaatatactgctctcatcaagtccttttaattcttttattgctttttgcattaaaattggatattccgcttcctcatcaaaaaactccttcggtgttaatccaaaatattcgcaaatatatacaaattcttttattcattaaaacaagtttatttcatacttaaaacacaacgtttcaacgaacttcggtagggcggcacagccgccgcgttaggtgagttatcatcgcacgcttgcgtgcatatactattttactattttactatcttactgttttatattaacttttattttcaatatataccgcgactgcgcgccttacgcagcagatttcatctgcattgagtatacatattaatatttgcgtattcatattattgacattgaaggctaacaaaaacaagtcactttgtatcacacccaccatactggtggggtcacagacattgtaggtatatcaatacaagtcaatttgtattacacacactttaaaaaagtgtggtcacagctctaccgatgcttgcaataaaccccaaatatttatatctaatttttgttcataggtatattaggattgtattcaaataagtcgcttggtttacactttaatatttgacacattgcatctatgttgctatattttatggattttgtctcgttatttaccatcttactaaagttttgataactcatgcctaattgcttatacaaccaatattttgtatgtccgcaatttgtaaattttaaactatttaggttcaaagaaataaatcaactttcctatgcaataaaaatggttgttttaacgaacttcggtaggcttgctgtgaccgcacctatagggtgcgtgtgagccaaattaatttgtatttattaacctacgaggtcaataaatcacttagttgtgatgtatgttagcaagctcgttaggtgagttatcatcgcacgctatacgtgcatacactaatttactatttcatataattttttatttttaatatatactgcgactgcgcgccttacgtggcagatttcatctgccctaccgatgcttgctgaatcattggctatttattttttaacttgttaataaaacctataattaacaatacactgctctcatcaagtccttttaattcttttattgctttctgcattaaaattggataatcaatttcttcatcaaaaaactcttttggtgttaatccaaaatattcgcaaatatatacaaattcttttatagacggtaaggtataaccggaagttattttatttatatatccctcacaatgccctaattcaaaacttaattgccgctcagataaatttttctctattcgcaacttggttattctatctcttaaaaatttttcataatccttattttcctcatacatgacaatacctcaaaactaatttatatttttgtcttagataatcataacacaaaaaaacaatcaatatgtagactattacattagataacctataagtctatacattcggaattatcatctgtaaaccaaataaaactgtacaattttaaggagtataaaaaaatattaaacttctctaacaaaaaatttatttattataaaaaatcaaaacataaaaaatgacccgatatatcgggtcatttttattataactaactatttcgtatagtgaacaggtgtccattcacctacataatcctcaacggttggaatcgtttgtgccgctccgttcggattatcacttcctgctgtcaaatcaattgtctctccaacgttatgaacgttgtttacgaaaactctagataaacttaactctccgcccatcgctgtccagccgcccggcttttcaactccgtcaagagttatgttgttgaagaacattgctgaatttgctccgccccagtttcttccaaaaccgcctttatcaaacttcataccttgtatgttgctgtttttaatagtacagttattaaagaagtatcccggatctgttactgatgaagtcttgcatgctgcaatgtaaccgccgctctttacgtctgaatatccataccaaacaaggtcacagttatcaaacgccacactgtttccgccgaatatataatctgtgtttccatagatttcacattctttgaaatatcctgtggaacctgtatacaatgtatcctggcttgataccatcttacaacggtagaattccgagttcatgccctcaaaagctactgccgcagctctttcggttgaattcttggtggtaacgtcaacgccggcttttctctcaaacatcttttcattcatttcaacaccgtcagccaattcttcttctgttacatactggttgaacgtattctcaaaatcaatgttctcagccaggaatcctgaacctttatctgttacataaagggtaggtccccactttgaagcaactgctttcgttgtcttggctgccgcatagtcagcattatagaatccgccgtttaatgaataataaacatatcctataccgtaataacttgtgataaccggtctgtttgattcatcagcgctcttcaaagtaatattgctctggtcgataataacctgacccttatatgttcccgggtcaattactattgtaactggtttgtcgcctttatcagccatcatgcgaactgcagaaaccgcttcattaacggttttatattccttatctgcacctacgtataatgtatctgtatacggaacatccacgtcgttctttataagaagaacatttttaaacggattttcatctccgcccggaagactatatgttgatgacagatttgataatgtatatcctgacggaccttccactactgttacatcatacacttcgtttgttaataattttgcggcaaatgtaccatcgctgtttacagttacttcgtcataaggcgctgcttcaccctgttttgtgaacgcaatcttaacagcgtcagaacctgtgtatacttcattctgatttctcatatcatcagaaaatgttgtataaagtgtacctgtaacctcaacgtcttctatcttaacaaatttaatatcgtgagactgttcatatctgtttttgttcacggtaactgtgtttgttaacgttgttggacaaacgctgtctactccctgaacagatatactataggtttcgccctttgttaatgttgcctcatatgcttccgcataatcaactgtcacaacatcagtgttgtcattaacatttgtgaaaactattttagcagcgctcaggtcaagacctgtgctgtttgttacattaccggtaattgttttatcaggcgtctcgtcgtaatattctataaagacagcatatacgtttttatttgagccgccgccgtaagtgtaaaccggtgacaaatcgtctttgctaacatcagctgtaacggttgaaactcccttatcacatactgccgagcctataacattaccgctctgcgaaatatactgtgttcttccttcaccgccgtttccgtcaaatacgactgttaccgtacaagatgtttcaggagtaattttaacatatctgtttgtttggtttcccgagccggcttttaaagatttagtaaagttatattccactccgttagtgtgtgtatacttaacattcttgtttctttcaaacacctgattaggaccaacctctgctactcctgcagcaacggcttccgcaccgttatttgcagaataagcttctaacgcctgacttacttcagggtcgtcaactctccaaataatatcattaggaaggttaggattaggtgtagcagttgaaactgaagggcttgcagatggctccgcaggggtcgctgtcggctctgacggagttgaatatacaacgcttactgttacatcctgatcaggcataacaaacgatgcgttagaaactgtgatattgcttccgtcttttcctgtaactgttatattagccacatcgcctgcattatttggttttgtgttaacaattactgttgcaccggttaaaaattcatactcgttcggctgtaatgtcggagctgctgtaggatctgctgttggagcctctgttggcgcagctgttgcgcttggctctgctgtcggtgcttctgttggtgcagctgtcgcgctcggttctgctgtcggaacagttcctgctgtagctgtcggctctgccggaatgtcaccatcaggtgttaccgcaactctaacatagttgaacggaataggcgaataaatatatacgtctgtacctgccgcaatagctcctgccgttgtgcctgatattgtattttttccatcctcttctgtgctggttaatacttcttcatcttcaccgtctgctccggcttttacatatacgcctccgtttccgtcagctctcattgtaaacgcttcaactgtaacttttcctgtaacaggcattacaattctgattgctctgtacgatgcgtcgccgtcagcaaatccgcttccgcgcattactatatcattgtttaaaccaatctttattgtattcgatgaatctgcaaataccgttaaaccttcgttgctgaatatttcgcctactgttatttcacttcctgtattattttcaaatgtccattcatgaacaccatctataacattctttattatattagcagaatattcagaatcttctgccagcacagcttcactgtctgctgtaacagcttttgaagtttctaatgttcctgttccgccttctacattcaaaactgctttatggcttacaggttcaggttttggcgttgctgtagcagcagcttcaccgaattgtgcatttactattgtgtctgacgcaggcatttcaaaggtgtaataacccggatttcctgatacttctgtaactgtcgtctcaggagatgtaaacacctttatactttctgctgcagattctgcaaccgctttaacagttactttatctcctgcctttaatccatcaagactgtcaaccaattcttctgtttctgcagctgaaacttctgctgccgctgctgatgctgacggttcatatgaatatccatacagtgtgcctgttgttcctcttgcccacagcaaatattcactgcctgcacttaaatcaaaggtctgcgttccaaatgcgtaggtcttttcatcatttatttcaggcatttccataacgccgcttacctggctatatgaaccgttatcgttctgtgaaagcttgatatccttgccatcacctgcgctcataacgtcaggatcgccgtttgttacctgtcttctataatagattgtaaactttccgtcttttttaggcgctattatcagcgcagtgcttccgctttgctcctgtaaaggctctgaaggatttgccgccaaacggacttgcatattatgagtaaacggctttccgcctatcattttagtagcaggctcgttattttcagtatattcaactattgttgttccaaaagttccggtaacgctgatattatcatcattggtatataccgaacctgccgcagacggcgtatcacctttaactgcaaaatctgttgctcctgtcacaggggtttcaggcgttgctgtagccggcgcgtctgttggctctgttggttccactgtaggtttagaaggttctgctgttggttttgaaggctctgcctgtttaactatcttcaaagtaccgcctgtaataccctcagctacttttactgaatatgtaacatccggattctgagttggcgttgctgtaggtacagcttcgcttgttgccgtcggtacaggtgcagttgtagctgttggtacaggcaaagctgtagctgtcggtacaggtgcagccgttgccgatggtacaggtgcagctgttgccgttggttttgacggatcggctgtcggagccggcgaacctgttgctgccggagttgaagtcggcttagtcgactcaatatatccggcatagaagctcattgcttttgttatctttgtagtgtcaaaattaaacggagaaatagtatccgccttatctgcctgttcctttgacaaataccagcctacgaattctttgccgtccattgtcgggtcagccggtctcttggctgacgacagatatgtattttttgttactgaaactgacttatataatgaagatccgttatagaactttacagttactgtgcttgtcggcgagccgttactgccgcttccgcttccgccgttgccgcctataattgtgttattcggctttgtttcatcgttaggattaacaacattatcagtatttgatttaacatttgcatttgcggataaattaactacatttcccgaaatctgtgaacctgtaattgtaacgtctccgcttgcctgaccggacactacaacacctttagcaacaataccgctcaaagtgactccgccggtctttataattatcaatccgcctacatactcagggccatatgttcctgcctctgttatatacagctttatcatattgtctattatctttacaaactcggctcttgatatatagtctttaggacggattgtaccgtcttcataaccgcctatataacctgatgatgtcataacgccaacataaccggttgcaaaatcagaaatattttgatagtctgcatattgagttattccggcatttgagttctgcacctgaagtccaaacgcacgagccagcatagtcatagcttcttcacgcgtcatataattattcggagacattgttccgtcaccgtttcctgtcagaacgcctgcctcaaccaatctgagtattgcatctgaataccagtcgcttgccgcaacatccgtaaatgtgtttgttgccttatttacgtatcctattaaattctgggttacctgtgcaacttcaccacgggtaatcgcatcgtccggtctgaaatatccgccgtcgccttgtattacgccgttatctgaccacttattaatataactctccgcccagtgtccctgtgtatcctggtactcagcagccgatacgacagtggccattccaagcgtggtcataatcatagcaataactagtattgctgatattccgcttcttaactttctcatgttctctcatacctcccataaatattttttattttagaaaaataagatatacaacttgtagttattgtaacatcttttggtggcaaagtcaatattttatagcaaatcacttataaaacatctataaacatacataaattataaaattcaacaaaatttgttatttgattacttttaaacttagtttagctatataaaaatcaaaaacaaaaaactgcagcttatgaatcagccgaatatttctgttttacattaaatataaaagccagttatataatattttatttatataatagtgaaatttcatcttataatgactctcaactattgtgtaataagttttaatcacggagaaaatcatagttttcgcttatcacttatttttatttcagaagttttcaacacaaagctttataatatcggcgggaattagataaaatttatttagtttaatccgcttaatacagactaaaccgtcaataaagtccgtattaatgcttatccgacgtaatatactcatataaaccgaacagttaagagtcacagctttgcaatttatataaaaagcgccttgccgtttaataagcggcaaggcgtttaaagttaaattttgattttctctcaatacaacactataatttgacagaaaactcaaataaagcgattagcttcttattttatttccgaatgaagctgctgaagcgatttaacctctataacttttttattctttacttcttttataccgcttgaagccgcttttgccgctgccattgttgtcatatatgaaatctttcctttgattgcggcctttctgatataactgtcatcatggatacttgtctgacctgccggagtattaattatcatttgtattttaccgttagttatttcatccagcacgttcggtcttccttcatggagtttattaatgcgctcagcaggaatcccggcttcttttattagattataagttccgccggttgcgataatttcaaaccctgcgtcatggaaatcctgggcaacagaaactacctcttttttatccttatcgttaacgcttataaacactcttccttcaagcggcagtctcgtttgagttgcttcctgagacttatagaaagcttctccaaacgttccggcaagacctaaaacctctcctgtagacctcatttcaggacctaacaaaggatcacactcctggaacatattccacgggaacactgcttctttaacaccataatgcgaaaactttccatgtttaagctcgtccagcggatacggctttccggtaagttctgccgtcattatctgagtagctattttgaccatatttatattgcacacttttgataccagcggaacagttctggacgctctcgggttcgcctccagcacataaacttttccgtcctcaatagcgtactgcatattcatcagtccgactacgcccatttcctcggctatcttctttgtatattcatttatcgtcttcacgttttcttccggtatatttagagatggaagtatgcaggctgaatctcctgaatgcactcccgcaagctcaatatgttccataacagccggaacaaaggcgtgttttccgtcagaaattgcgtcagcttcacactccatagcgtgatttaagaatctgtcgataagtataggtctgtcaggcgtaactccaacagcggcattcatataaccaaccaaactgtcagaatcatgcacaacctccataccgcgtccgccaagcacataagacggtctcaccattaccgggtacccgattttttcagcgacctctaaagcttcatccacatttacagccatacctgcttccggcataggaatttccagcttgtccattatatttctgaacctgtccctgtcttccgctaaatcaataacttcaggtgatgttcctaatatttttacgccgtttttctcaagctctgccgccaagttaagcggggtctgtcctccaaactgcgcgataactcctattggcttctctttcttgtatatgctgagaacgtcttccaatgttaaaggctcaaaatatagcttatccgacgtatcatagtctgtagaaacagtttcaggattacagtttactattatagtctcaaagcccagctctttaagggcgagcgccgcatgtacacagcagtaatcgaattctataccctgacctattctgttaggtcctccgccgagtatcattatttttttgttctcagttacttcattgttattttcactgttataagtcgaataataatatgcgctgtccggcgttccgctcacatgtattttatcccaagcctcttcaaccccgatttttattctttcatttcttatttcatcttccggtacttccaaaattttgcttaaatacttatctgaaaaaccgtcctttttagcctttgtcagcatttcggaggacggtaaatgtcccttttcctttaagagcgcttcttcttcatcaacaagctctttcatctgttcaataaagtaatgttttattttagttaaactccaaagttcttcaacagttgctccctttctaagcgcttcatacataataaactggcgctcgcttgttggatatgcgagcatttggagcagctcttctttggtcttatcatgaaaatcattggcaaatcctaagccgtaacggcctgtctcaagacttctgatagctttttggaaagcttccttatatgtctttccgatagacataacctcgcctacggctctcatttgagtcccgagcttatcctcaacatccttaaacttctcaaaagcccagcgtgcaaatttaattacaatataatcaccgtcaggaacatatttatcaagagttccatactttccgcacggtatatctttaagagtaagccctgtggcaagcatagcagacacaagcgctatcgggaaaccggtagcctttgacgccaatgctgaagaacgcgacgttctgggattaatctcaataacaacaattctatcgctcacagggtcatgagcaaactgcacgtttgttccgcctataacttcgatagtttctacaattttatacgcctgctcctgaagccgcttttgaacctcttcggatatagtaagcattggagccgaacagaacgaatcccctgtatgcacgcccagagggtcaatattttctatgaaacatacggttatcatattgttttcagaatcgcggactacctcaagttcaagctcttcccagccgagaatagactcctcaaccaaaacctgtcctaccaatgaggcctgaagacctcttgacacaacagtctttaactcgtcaacattataaacaagaccgcctccggctcctcccatagtataagccggacgtataacaacaggatatcctaactcctcagctatagctaacgcttcgtcaactgtataagcaacagcgcttttagccatttctatacccagcgagtccattgtctttttaaactctattctgtcttcaccgcgctctatcgcgtcaacctgaacgccgataacctcaacattatacttttcaagcactccggcttccgcaagttcagaacacaaattcagtcctgactgaccgccaaggttaggcagcaaagcatccggacgctccttttctattatctgtgtaatacgctccaaattaagaggttctatataagtgacatcggccgtggtcggatcggtcattattgtcgccgggtttgagtttaccaaaactatttcataacccaaatttttcaaagccttgcacgcctgagttcccgaatagtcaaattcgcaggcttgtccgataataataggcccggaacctattatcagtaccttatgaatatcgtctctttttttcatcttatttctctcctcttttattatattttccgaaaaaccggctgccgcaaaaactctgtacagcaaaaatacgctggaaacagttacttttactttagcaaatagaagatttttcagttcgttatggagcgcgataaatcaaagcgctttttgctctttatagatttgcttattagttaatttcaaaactatagagaacaaaaatttcttaacttatataatatacaaaattcatcaacaagtcaacaaaaaggacaaattttttcaaaaaaatatttatctgctaaaatctcctgtttatgtaaatgttataaatttttatcgccataaatttttaaatttctttttacttcctattatatttgagcggacaacttgaaaataacaaagattttaaattaatatcagtaaaactttctgcatatttcaaactcaaactgaccgaagcaattttttcatttcacaaataccttttttctgagatttaataattgcttcaagtatcggaacgagttctgaacaaatatcataaagcaacgcgttctgagacatgcggattgctccctcatggtgcggaatcatctcacgaataaagtcagcattgatattatttgttgagcaagcatttttcatctgagtaaacatagtacaggttatctgactaaagccttcttgatacaaacacaaatctaagggcgtattatcttgttctccgcattggcaaagtatgtttttcatgttatcaatactctttgtttgttcatctataatatttaacgctatattctgaagcggaacgcaggtggtatactgcaagagattttcagacatttctattgccgccatatgatgaggaatcatttgaacaataaaattatgagaaaggctatccgtcaactccgcctctgtcatattctcagtcatttgttctaatatctcgtaaaaacgacacaaatacgctttagcaacattgcttaattttcggtccgtcatatttaaacctccaaaaaattaaattttaactatttacattttatgagaagatattgattattgttccaagcataaaaatctatagacctatttataatatttacctgtttaatttacagtgcagttatacattacatctcaacaaacagaacatgtccagcattatatttaattgttcagtcgttctgacttatatcacaacatataatatagtttttagctgatttaatttttataatctgtcaatcgactctataagaatattgatttttatatatgtaaaaactatctttgaggtgaatgctatgtatgaaaatctaaatcagcttattaatttaagttccagcagcaggtcatattttttgtcgctccctgttgatatacaaatgaaactccataattgttcaaaacatattcatacggcatatgacttacacaaatatgcagatttctactcagataagttataaattatttgagtgcatttattaatctaaacccaacattcaatgagccttactgctgaatccaaagtaagcattctattaattgctggaataataaaaaaacgtgttttacctaacttttttacatttttcattaaatatattttatattacaggaaataaaaaaatattgagttaaacatttggatatttgagaaaagtctaagatgataatttaaaattttaaaaaatacagaattgtttttatccgctcaaatatttatatttaaaaaccgtataaagctatggtgcacaaaaatttgtgcaccatttttattcaaaattattataaaattaaaacaacctctaaagcctgctgaatattatttttaaaacttatactcttttaccttattaataaaaagttttaccgccggagaaaacgtctcatatttctttgttacaatatacaaatcaattgacatttcaggaataatcggacgaaatgtcagattcctgcttccttccgtgtttacaagatttgcgaggcaaagcgcatagcatatacctttttcaaccataaatgttgcgttataaataaaattatatgttgcaacaatattcattgatgaataatcagctccaaaccactcaagatcctggtgacccaaaaagtctgattggcaaaaataagcggaagattctttactgggcgctgatatttatgagattgaaccgtcagagccatattcatcggaagacctaaactacaacaatatttcttcaagagcaaatatagagcagagcgacagcaatgcaagaccatctatttcgggaaacattaaaaacttggataaatatgacgctatatttctcggttatccgatatggcatgtaaaagcgccaaaaataatatacacgtttctagaaagctacaatttttcagacaaaacaattaatccattctgcacatcgggcggaagcagcataagcgaaagtgaaagcgaattacacacgcttgctgaaaatacgtcgtggattgaaggcaggcgtttatccggcagtgattcagaagcaagcattaagaactggctggatacaatagattggccaaaaactgaaacagttcagacaccggcgccttcttcagctcctgcggcagttccggaagtaaccatagaaaatgatattgtaacggtaaaaaacactcctgacaattcaacattgattttagcattctataaagataacgtattgattaatgttgattttactgaaggcaacggcacaataacgaaaaatatttcagataaatcatctgacgcagatttaataaaagcgtttttatgggatatgaaagaaataaatctgctgtattcagctaagcagatagaaaataataaaattaagagatgcagattaaaatatcttcgggcgattatgaaattatttataaaatcaatgaaagtcaagccgcaaaagaactttatgcccagcttccgcttacaattgaggttgaagatttcagcatcaacgataaagtgttctatccgcctcagaaactaagtatcacagatacgccaatggcaatcggcggcaaaggcaagctggcatattttgaaccatggggcgatgtagtgatgttttatgacagcttcagcgaaaacagcagtttgtttgagctcggtgaatctgtttcaggacaggatgacattgaaaagttgtccgggataatcacgatttcagcatacgatatataaaaatctattataatatagttaagaggtatagaaatgaaaaagataacattaataattttaacatttataatttcaacactatgtatgacatcatgcagcgcggcagagcctcaaaatgtttccgcttccggttttactcttacaatgaaaattggtgaacctgtaatgacagtaaacgatgtaaaaaaagaaattgatcccggacgcagcactacgccggttataatcaacgaaagaatattggtaccgatacgtgcgttaatagaagaaatgggcagagctatagcctgggaataagatacgcagaatgttttaatcgctctcggcaaagatataataatacttacaatagacagcacaactgcatttgtaaatgaggaagcaaaaactcttgataccgcgcccgctacaataaatgaccgaacaatgctgccaatccggtttatatctgaaaacttgggttatgaagttggttggaattaagacgaataattaattaaaattactaaatagaaacaatgacaaaccgtatattattaacattttataaaatacatatttatctggtaaattctaaccacattcaagtattatttggaaacactcatacaacaaacaaatacaataaaaacaggttaatatattctgtaattcaaaattccatttaacccccattcttacatcaaaactacacgtccgttaaaataatggcactttaagacacttcttttgtttaacatattttaacatattattatcagttcaacagttattgtttgaattgaaaatataataaaaaatgttataatgaaagaaagtgaaaaagattgagtaataatcgctgtgactgctgcgggcgtccaatcaaagaccctaacgcaaaatatggctggcggtgtgcggaaattatagctgcaggaggaagtctgaccattgatttatctgcaattttctctatgcttgagaaatacactgatttttcttttgaatcacagaatgacttgtttgatacttctgagatattcgagaaaatgctgacactatcgtcagcgccatattctatgaaggcagaaaatgactatgttgaaaagggtatagctcttgcttacgcaatgttttccaactatgatgagttgggagacaaagcaagaaaatctgccgtatcgcattttattgaagaaatgcataagcggaagaaacactgccgcaagtaagttcaaggtacactttggcagaagaaatgaacaacaagctcattgattattatgaggcagaaaataacccggacacaaatgatacagcagaagattccattgacgaattatttgaaaatatacctctgtatcattacttaaatacggtgtttgcaaaaacagaagctgagtttgaggacagcctaatgaaaggattaaatgcgtcatacaacgcatttatgaatctgccatacacaagttcaatgatgggagacatagctgttgctgaaccacaaaatgcttttgctcatgaaccttacgtatcccaattcaacattcctggtaagaacataaaaatttcagattctcaatttggaaaaaaagttggagaacatgctgaagactttggtttaaatccaagtaatcctgaaagcagatatttaattagaaacagaataaatgaaatctttatacataaaactgaaattcgacaaggtttatggcgtggtcaaggtaaaacattgccaaatggggcaaatgcctcaggacaagtatatttttatatacaagataaagatgttgttgtaacagatttaaacggaaactttataaccataataaaataaggtataaatatcccaagaataatagatgcagaaaaaatatggccttaattaagaaaggagatacttaaattatgttaaataacgacccatttttagattttgttatgcaagaggctgaaaaaataggaaagctatttttaatagattcgggtgaaggtaatagttttatagattcggacactggttgggatgtagaagatttgagcggatggcttattaatccatacgaaagtgagaaattcatatcagcacgcaaaaaaggaacattagatattgactttgcaaactcttacgttttcgcaaagtggacaaagtctgataatggaaatattaaaattacatttaaaagatattaaaaactgggacagaactccaattaaatattggagttctgagttctgttaaaaatatgcataaattaattttacttactattattcataatttctttttataaaaaacctattaactataagatttgttcataatattttatcctttaaacaatcgcctcattttaaccaattaaaaaataggaggaaaaatatgtgtataaaataattaaaattcgcaattatgcagctactcgagatattgaactacaaaaccttaatacaaatacaataaatttatgttttgatgattctgctgttgtaagttataataatttcgattttattgaggaagggaaggtatatgattgtaaaatggaactattgggtaattttgagcacacaaaaagtgattctaatgtaatagttactattcttgaatcagatgttctaataagaaatacaaaatatcttaaggtttctattgattcagatatttactacattcttatgtcagacacaaaaaattttactctaaccaaatatatgtattatcatttcacaagaatagacttgattcaggttgacaatgttatacatggagattgcctttaattacagtgcggatattataaaaatagtattgcatacaaatgatacagcataaaattccattaacacattatgggtgacatatcttattatcattacttatatgcaataaaggcgggaatgccaacagagctagatatgcaggaaataatatttgattttacaggggtaagtatattataaaattatatgatataattcaggaaagctttggctttcctgactggtttgaaaggaattggatgcattgtgtgatcttttaagagattacgcagagtgcccaccgatagctgtaaagataacagggattgaaacaatgcctaaagatttgcagaactatatggataaagtgctggaagtgtttatcgatgttcatggtgaagtcccgcagatacattttgaagtaatatcataaagaaaataaaaacggcaagactcattaagtcttgccgtttttttggtgcgggtaaaaggacttgaaccttcacgtctgctgacactagaacctaaatctagcgcgtctgccaattccgccatacccgcatagcttatttattataacaaaataaataggctatgtcaagaaaaaattttctttttatttttgagcttgtaggattacaatagatgtgttacaaagagaaaaaaagaatacggaaaactcataaattgtgttatagttatatcaccataatatcacatacacaaataaaaaataaaaatcaatgaacaacggtaggtgagcgaagcgaacgcgtgaggtgaatccacatcgcacgcttgcgtgcacaacccaaaaacaaatttataaaacataaaaactcaaataaaaaataaaaatcaatgaacaacggtacaacataatcaaaattatgtagttatattatttaaaagtataaagggatggatattatgaattttgaagagaaaaaagatttagaggttaataaacttgaaataaaagaaaatttgtttgatatgcaaaaacttattctgcgacttaaaaatcttataaaaattatatctgaagaacaaaaaaatttttataaaatagaagtttcttcagagattaatgacttttatatagggaatgaaaaagaactggaacatgtgcttattaaattttttgtaggagctgtaaaatatttaaaagaagcggaatatcttgtttttagtattggtgtaaataagtttacaactaataaagatgaaatctattttataataaaaggtatagaaacaagtaataaaaataagaattacaataaaaattatgaatggttaaattttataaaagattctttaaaaaaattagatggtaatgttaatataaaacaaggaattaacagtggatatacttttatgctaagcataccattaaaaaataaataattttataattaaataaatttggtgcggttttttaaaactcaatcaatagtaatcagcaaattatttgcttaatctattaaagagactttagttcggaaggtctattccaaataattgtgccattttcattagaaattttttcaggaatattttttaatgttatttctatacagttattatatattttaacagagttatcgtttcctttatgcaatatcttaacttcgtgaacggcggcagcatactcaccaatgtaattatcatcttcaggctcagtatcagtctcaaatatacctgtaaaagatctgcatttgactttaagtccattactccattcgataatatgtttaaaataatgattaaatacaaataataattcaatatattgtttatttttcatatataatttttctttttattgaagatgatttaaatatacttttggattattccataaacattcatatttataatcatgtaaataaaaatgtaccccatttactataaaatttattgttttttgttttatcgaaagaaattaattttgatggtattttatcacatgtctctatttttggcaattcatattttcttaaaaatttagccccttcaaaaagccatgctttaaatacatttatttaggttttatatttttatagtcttttgagtcttgtttcataaataaatatctttatttttatataaataattataaatagaatctaataacagagaataaaaatattaagtttgttttatatataaaaaatcatatttatctaatatatttaaggacatggttcaataagccttcaagcagcataattatattatgggcaaaggaggtgttaaaattgattatgcgggctatagtaataggcgtacaaaacgaccgtttgtttgtattagacatagaaaaccgtcagagagttgttgtgataacgcgcagagcacgccggtttagacctggaaattttgttcgtattgaatttgacggtattatgacaaacagtatgccgccgcagatatatgctcagagaatatccttaatttcatggaataatatctggtgtgacttttgttaatataaattaatatattagatcataaggattattttataaaaataaaaaatatataattatgtgtggaatacaacaaattattgtttcaaataatacagtaattaaaaatatatttgttataatattaaaaacctatagaattaattctataggtttttaatatttttaatcttttacaatatcatcaaaagatagttttggaatgaaggtaccgtcatatttatgttctgattcattaattctacgatagtaaatactaataggtttacatacataagtattattatatttgtgtgcctttttgcaataatgttcacaaggtataattattttttcaaaattatcttgcaatatatataaattccataagtctttatcttcgagtatttctccacaaggcatagtcgtagatacattataaagcaaaattttagcttctcgaaaattattaattattttaatggtattgttcataaaacctagtaacttatgtatatcttcgataattatatttaaattctcaaaaggatgattaagtaaaaagtatttaagttctggtttaactgttccgttagactttgaatgaaaaatatatgtggatgtagagtcggtcgaatgtgcaaatgagtttcttaatgtttgtcgcactatttgatgattttctgtttctaaatatttcaatatattgtttggggtgcgtccctcaaattttttgtgttttaaaaatataaaaatgttatatatatcatctttcgaatatccacattgataaaattcatttaataactgtttatagatgtcccataaagcaatgtcacgatatacagcatcttctaaataataagaatatttcacacgattatctgtttcttctaaagaacatttcatctttttgacattggcaaggctttgagacaacgcatactttatgtttaaaattatggtattagctctaatgatccattcaatacaattacgcaataacagcacatcatcagttttttgaagttgctcttctttatataggcgacattcgttaagaggtgtaatattattcacctgatcatataaatattttactcttttctcatctgttttaaatctatcaaaattcataaattttatattccttttttattgattatataataacaacatttatattataaatacatgtgaagcttattttaattttatggaaaaagatatattcaaattaatttggtaaattataaaaaaacgcctacctttattggtaagcgtgttcttagtggttgcgggggccggatttgaaccaacgaccttcgggttatgagcccgacgagctaccagactgctccaccccgcgatatattgttactgtgtggtgccggagaccggaatcgaaccggtacgggaattacttcccacgggattttaagtcccgggcgtctgccagttccgccactccggcgtgactacttacacagcttttaaattatatcactgttaaatcatattgtcaagtgtttttttaatttatttatattttataagtgtaggattacaatagatgtgttacaaatagaaaaaaagaatacggaaaactcataaattgtgttatagttatatcaccataatatcacacctgtcaccttgctcgtcagaacgcttccatacgcattatacgtatttactgtttcatttccatttttgtccgtttgtttggtcggcagtcccatcaggttatattcacttattatatcttgttacgcataaaaaactgaaacagagttatatgtatttcttaactacttaaaaaggaagtatttaatggatttttattttaaatagttaattatttttatatattcaaaaactttccggtgttttttactccgtttcaattttttatgcgtactcttgtccaacttttttgttttaccggagggcgtaaatgatttacgccctcaaaatttacttttcgaaaggcagacagaatgagcaggcgggaacgtttgcaataagtgatgattttatcggaacagaggttcagtatatgttctgctcaaatggtacgacaattgataatgaatatgtaaaaggatataagaattttataggaaacccaaatgcttcaaatactttgggagacccatatgtgaacggaataaacctgtcagccggaacccatacggtatactttatcggagcgtataacagaggaataacaatgagcctgtcagacggttcgggagtggtggcaacagcagagagaacagaaagccctgtaacattgactccggcaggagcagagaaggagttgcagctgagcaagataacatttacgctgccgcaggacctgacaaacggtacattaacatttacaaatctatcaacatggctgccggatttgtatgcggttaagatagtataatataaaacatttggaacatatatagtataaaccccataaaacatatgtttttatggggtttgttttatttagttttttgtttaacgagctgattatgtcagtgtaaaatatatcagtgtaagttacaatattcttatagtaagtcagagataataataaattataaatattatttttataaattgctaatagtttttcaatatagcttccttgcacatagaagataggatacaatagactgaacaaaaaattaaggatgtctattgtgccgccggaaggtggggcacaccttccgaagtttgcagaatcatattattttataatattttagattaatatcatcaatacagtgttctttagtggtgtgcccccacctctggtgggtgtgatacaaaataacttgttttgattaacctgcaaggtcaattgtggctacacttttaaataaaagtgtatattatataaactaaataatgtgatataaactatagatgccaataattaacttagttgtcatataataaattactcagttgtgatgtatcgcgcgtttgcgtgtctcgttaggtgaattgtcaaatcacgcaaagtgtgaacatactaaaaaatttttgtaataatcatttttaataataaattttccacaactgcgcgccttacgcggcaaactgcgtttgccctccgatgcttgcaaagccatatctttataatattttagattaatgttcacaatacagtgtcttttagtgaacatcggtaggtatcatcatacctgtagggtggggcgatacaaagtgccttgttttgattaacctataatgtcaattgtggctatacttttaaataaaagtgtatattatataaactatagatgtcaacaattaccttagttgtgatatattgcgcgcttgcgtgtctcgttaggtgagttgtcaaatcacgcaaagtgtgaacatactaaaaaattttgtaataatcatttttaataataaattttccgcaactgcgcgccttacgcggcaaactgcgtttgccctccgatgcttgcaaaaccatatctttatattatttttagattaatattcacaatacagtgtcttttagtgaacattgataggtatcatcacacctgtagggtggtggcgatacaaagtgatttttattacacactaaaaaaagtgtgtttacggccctgccgaagcttgctaaccacattttttattatattttaatattttttttacgatatataaccttaacatttccgttcaatttattgtggcctatcaatataaaatttcttagtaatttatatgccgctgagagagaaagtcggcggcaaatagatactatgaattttatagaattctatagaatcttaaaaataatatattgaattataatacgatataaaaaagttaaagtataatctgacagcccggcgtcaaacgccttaagttttctccgagggtttgttttagtagttcatatgaagcgcttcccgtgcaatgacatgtataacgtatagtttcgctttctctgagacggttagccgctttttgtacaaagtcgggcggctcgctctgaccgcttcccggtatggacatatgaaagcctgatatagtgaaatccggagcggtacccatgatttcctgtgcttttttttcaatattaattattccgttatgtgcgcagcctccgacaagtatatacctattgcctgattttattatcagattctgttcgtgctcaaagttgtcgttgacaagcccgtgttctgtcattttccaaagtacattgtttgaattagggcatagttctttactttccacgcttgaaaataaagttagattgctgctgatttgggttattcccggtgctgttaatataagtctgtcatttgtttttagttttttgtcaagccctatatatcgcgctttcccctgtgaggtagaataataatctccgaaagcgttttccctaatatatacttttccatttttgttcttgtctaaaaatgttgaaagccctccgccgtggtcatagtgcccgtgggatataacagcagtgtccacagtatttaaacctattccaaggaattcagcattttcccaaaatagttcattcggtcccatatcaaacagaattttattttcaggcgtctcaatatataaactcaatccatgggctgaaggaaggttttcgtttttagtgtcttcaaccaagacggtaatttttatttgttcaatatttttgtctttaaactgcatagtcaacactccgttcagctagatatttaaaatcccagctgttcaaaattcttatcttcgtaggcgctcaaatatttaaaaatgctttttacatcggtcattatatcatgtttacggcaaacatttaaaaatatgtcggtaagtttttggttgttggggctagtgactatgtacgagtcaccaaagtctcttatatatcgctcttttaatcccggaaaatgtttgtccaatttctgataaaaatattctctgctgccgtcacgcagggtcataccaaaaccgtagcagattataccttttaccccggctcgtacacagtaattcaaaatgccgatcagattttcttcactgtcgtttatatatggaagaatagggcaaagccacacaatggcgggtatatttgcgtcgtgcattgcttctagtgtcttaaacctctcatatgttgatgatgtatttggttcgagtattttacacagtttctcatcaaaggttgtcagggtcatttgaacgacgcatttagagtttttatttatattcttcaaaatatctaaatctcttaaaattaaagaagattttgtaagtattgtgagtccgaaattcatttcatctataatttcaatacactttctggtatagcgcagctctttctctataggaatatatgggtctgtcatagacccggttccaatcatacatttttgccgcttttttattagagcgtttcttaaaagctcaggggcgttttccttaacttcaatatcttcaaaactgtggctcatgttatagcatgtactgcgggaatcgcagtatatacagccgtggctgcagcccctatagatattaatcccgtttttggaagacagaatggatttagctttaacaaagtgcatgattttcacctccaaagctgatgatattaaacagtattttaacacagccgcatgttttattcaatagcgaaaattttgctgtaaaaaatattatatgtgggtttgcgtaatttgtcataatttctgcactttacaaagttttacagcatattattaaatgcgcccgataatttaaaaagtaggtgattatattggcaattgttaataatcagagtgaactgcaggctgcaatagctgcacatgacagtttcatacaagtggatactgatataactctaacagcacggctggtaatcagatatgctgttgttataagcagtattgattcagccaatgttcgtactattttcaagggtgaatctttctttggaaatatgttcagtattacaaactgcggtgctttaactctccgaaatattatacttgatggaaatgcagggaaacatccaaacgataacagcacaaacaggtctgccgtattattagccggcggaacactgaccctggagacaggcgcggttattcaaaataataacgcttatactgagggcggagctgtatatatgtcaggaaacgcaaactacgccaacgctttggtgatgcgggataatgccaaggtgaccggatgttattccaaaaccactggcggcggaattatggcggcgctgagaaataacagcgacagcgtttttattacaggacggtcggtcataagcaataacggagcttcttcaggggcaggtttatatttccgctcatatttggagggggtaaatggaaaccttactttgggtgataacgttcagttcaccggaaatcaagcggaaggagatggcggaggggtttactgttctaattttataaatggaaatacagtgccattaactctgacaataaataacgaggtgaaattcactaataatacggccggcggatatggcggcggactttattatatgggcacctttaatggcgactcggtcagtttgtcaggcggagcaaaattcacgcaaaattcggctgttaaggccgggggaggagtatatatgatattccaggacgaaagctcggctgatgcggagattttagatattacgctaaaggacaacagtgccggaagcggcggcggtctttatttacagactcagaacggaggaaatataaatttaacagggacgcaaattgattttaatacttccaccaatatgtcaaacggacacggcggaggagtttatattataaataacagtaccgacaaaattctgactgaaacaataaacaatgtgaattttgaaaataattcctcctcttatcagggcggagctatatatattaatgacaaagcaaagtcggatttaactttcagtgaaaatacaataaatgagaatacagcaggttccgcaggcggaggaataagcattgccggagacggcgggaaaataagctttgacaataatactatcagcaataacagtgcggcaggcagcggaggcggagcaatctgcactaatagcggcacaacgcccatggttctaaactttattgaagatacggtgattgataataaatcaggcaatgaaggcggaggactgcgtttatccggtggttcaggagagctaaacgctgttattcaggacgcggatatatctggcaatattgctgataatgtcgggggcggcgtttgggctgcaggaaccaacagcagtttgacggtcaatggaacaacaagcatatatggcaacgagacaatcaatggcaatggaggaggaatatactttaatattccggcaggaacgataaatttgtgtgagagtgcaaaagtgaatcggaattctgctgttggcggaaatggattaataaataacggtggcggtggtgtgtatctcgcatatggtacaatgaatctatcagactctgttgaggtcagagataataaagcccgcagaaacggcggaggaataaatgctagggacggcgccgttataaatatgcaggaaggaaccatagacggtaatgtttcgggtcaattcggagggggagtatatttaaaaaactcttcggtatttaatttcaaaaacggcagtataaatggaaataaggcaaatgcaggaggaggtatatacaacgaaagcaattctgttgtatatttaagcgagagtgtctctttaggtgatgaaaatccaaattctgccgcaacagctccgggtatttacaattccgcagaactcaacattatgggaacaagaaatattgaaaacggagtgtatattggatctgatgtttcatcagtaccaattttgaacagcaggattctgcccgactccaagatacagttaaacaactcgccttatcttacgccaaacgatgaggggaattctatagcggcggcggtggcgtcagaagattcatacccggttttgtcacagcaagacgctgacgcgtttataaagccgcctgatagtttcgatgactggaaagttcggctgagcagtgataaaactcaaataattcttgatcaggctgttcacacgataacctatttaaacactttgggtgcatataacccaaatcctgcaacctttacggggacttctcctgatataattttgcagccgcttgacgggcctccgggataccaatttgtcggatggtttactgaggagttgggcggaactcaggtaaccgtaataccgtcaggaacttctgaggatataacgctgtatgctcattgggcaattattattccttggcgtgtgttaatattcgaaccaaacgacgcgagtggtccgcctgcagaaaatataccgtcaccgatacagattcctgacgccagtgaggtttggattcctgatgatatgcctgttcgaacaggatataccttcgtcggctggaatatttatgctgacggcagcggcgttatgtaccagcccggacagtatttaggtcctttgacaatggatgtggttctatatgcaatttggcagccgaattcatcatcaggctgctgttgctgcaagtgctgctgcaggaaggaaaaagtccgttaatatgtaagtgtttggaaactgccgctttagcggcagtttcaaataaagtttttaaaataaatttatattgacaaataattttctctctgatataatatacagaccgttagtctgtaagtggggtgaaaaaatgtcaagaaataaatatccggaggagaccgtaaaattaatattagatacagcggcaaagctttttgctgaaaagggatatgatgaaacatcgcttcaggatataatagatagaacaaatctgtccaagggcgctatataccatcatttttcctcaaaagaagaaatatttttgagagtgtgtgacagagtcggtcaggaaagtgagagagtgctgaggaaaatagtctccagagaagacctttcaggggtcgaaaagcttaaggagatttttagagtctctttgctttgtccaagtcagaagcggataatggatattgtgccatacttgcttgataatcccaaatttttatcaattgaaatacaaagtgtgtttaacgaggttgctccattatatataaaaccaatcttagagcagggaataaaagacggttcaattaagacagagcatccaaacgaactcgcagaggctcttttaatattggcaaacgtttggcttcatcctcttataaagcccacaactcctgaggaggttaaggcaagatgcgctgtatacaatgaaataacgtcaggatatggttttgagattcttgatgaagagttaattgacactttagttgaatatagtaaatcaataaataaaaaagaaaaagaataaaataagctgcccaatatagagcagttttatataaaatttatacagactgttggtctgtttgtaaaaggagagaaatatgaaaaaacagattttgtttcaaaaggattttacattggtggttatagggcaaattatatcactgtttgggaacgctatactgcgttttgcgctgccgctgtatttgctgagagaaaccggatcgccgtctttgtttggcgcggtcacggcgtgttcatttataccaatgataattttctcattgtttggaggagtgctggcggatcgggtcaacaagagaaatataatggtgattctagactttggaacggcggctatcattgcagtattctatttgatacacggtatactgccgattgtgcctattatgattgtatgccttatgctgctctacagtatatccggcgcatatcagcctgccgttcaggcaagtattccggcactgcttgaaaatgagcagattatgaggggaaatgctgttataaacatggtaaatactctggcaagtcttttgggtcctataatcggaggtatcttgttcggcgcctgggggcttgttccaatattgctggtaagtacagcgtgtttccttagttcggcagtaatggagatttttatacatattccgtttaaaaagagaaagtcagaaaaaagtatggcgtcaatagttttggatgacttaaaagaaagcggcagatatatcaaaaatgaaaaacctgagtttgtaccggttattgttattctggcgctttttaatttaattttctcttccgttatgattgtaggaatacctattatggttgtaaatatacttcaaatgagcgatataagtttgggtataactcagggggcgcttggtcttggaggtttggcaggagggctgctcggaggaattatcggaggaagactaaaacttaaaaatggttatctgttgcttgccgggtgttctgtttcggctcttgttatgggaatcggactgttttcatttgttccgccattggttggatactggcttatcaccggtatgagttttgcggcaatggcgctgtcgacaatgtttactattcaaatgtgctctatggttcagcagcagacgccgtcccatttgattggaaaaataatggcgcttattatggcggttgctaattgcgctgctcctgcaggtcaggcgatgtatggattattatttgacgtatgttctatggttccgtgggcgattatgctgggagcggctgttgtatcgataggaatatctctatattctaaaaaagtgttttttaaacttgagagcgcaaacggataatattaaacagagttgtaataaagtcaaatgaaatggaattaaatccaaaattgtataacaaaaatgacgctgtatacatatatgaaacagcgtcatttttgtttataaattaataaaatatgctatgcaagttatatcatttgcggcgtaactctgtaaacccgcatggaataaggttttctaaaattccaactatacccgccgggggctttggggttgagttttccaataagtgaatttactcaatttaaataatacaaattgagtaaagcgtatgagtatatacattcatatactgctgccgcaatagtattacttttatcttatctgcacattctatctaaaagtcactatataccaaatacttattttataaatagtttgatataatttttttggtgctttctgtatgatatgactgtaatgcaaataaaatacatcttcaccggttctgtcaaaatcagttacaagccgataaaactaaaacaagagaattttaatccgcgctgttaccgtttaatacatttatcagagtggactttaatttttctatatttactggtttagaaaggtgcccgttcatgcctgctctccgcgccgcccatatatcctcttcaaaggcatttgccgtcatggcgattatgggaatcccagaagcgtcagccctgtctagcagtcggatagcttttgttgcgctgtaaccatccatctttggcatttgtatatccattaaaattaaatcatagtatccaatttctgattcagatactattttaacagcttcttctccgtcttttgcctcatctgtttgtatacccatttcattaattattgtgcgtgcaatctcgcggttgatttcattatcctcaaccagcagcacatgtttgtcggacaaatttgtaatgtctaatatgttatttgactcttctgaagtgttatctccgcttagctcattcaacaagtaacataactttgagcgatagaacggtttggagatgaaagacgttacgcctgactttttcgcctcatgttctatttccgaccagtcatatgcggtgagaatgattacaggaatttcagaacctattttctgtcttaactgcctggtggtttcaataccgtccatatcaggcattttccagtcaacgattacaagtcggaatgggtctgatgtatccttttcgcggattacggtttccaccgcagtctttccctctgttgtatattctgctctcaaccctatttcctctaaaagttccgccgcgtctttgcatgactgtatatcatcgtcaattatcaaacagcgtattcccttccattcatgaggaatttcatcttttggggcgtcttgaagctgcagcggaaatgtaactgtgaagacggaaccttttccgagagtgctttcaacctgaatatctccgttcatcaaatcaattatatttttagttattgccataccaaggccggttccgtttattttgtcagcagatgaatcgtttgacctttcaaatggctgaaatagtttttcaataaaatcaggactcattcctattcctgtatcagagcaaacaaatatatagttctgatatcctttatgtatactcttcctttgttttacttcaatacttactgtgcctccgggtttggtatacttaaccgcgttgcttaaaatattaatatatacttggcgtattcttagaggatcgccgataacgttttcgtttttcattacatcaaaacgcacattgagtttgagttgattagcaatggcttgtgaacgtaccaattcaatagaatcggcaacaagttcagcaaagttaaaaggctcgtttctaagagaaagtttgccgctttcaattttagacatatcaagcacatcgttaataagactgagcaagtggttgctggaaagcccaatttttttcagacagtctaatacgcgttcccggtcgtctatatgcgtggtggcaatggcggtcattcctaaaatagcgttcataggcgtccttatatcatggctcatatttgataggaactggctttttgcctcgcttgctgatttagcgctgtctagcgcgctttgaagcgcttgccgtctctgttcttcttcataccgctgttcatctatacgccgtgaaataagtatagctagtttatctttggaatatggattgtctacatatattatttgtgtagaaatccaatggtattttttgtccgaaaggatttgtttgcattcgataaatatttcatttttttctttccctaaagcggctgtcagcgtttcgggtgcaaatctttctttaaattcttcaatactgtcagtgtgaatggttgaaacaatttgattatatagttcggtatatgtcttttgctttccgagcccaatcatgagtccctctttcatataaatgaaattgagtgtgtctttggaaaggtttatactgataataacagggtaggcgttggagatcgctttaacaagagtgattctttcctggagtttttccctctctgcggcttcctcggctaatttttcttttgttatatcgtgaaacgcggcgattaacaccggttctccattttcactgattgtcttctcgacaataactgaggcccagaaaaagcttccgtcagttctgacaattctgtgttcaaaagtgtttctctgactgtttagagatacatttgtaaaatctttgataattctgtcagcgtcttcatgataaatgaaatcttttaactctttcccctttggcgcatcattcagcgaaccatcgggataatgcagaagccgaagtccctcttgattgagctgtatcagcttaaacggctggtttacagttatgagtgcaaccccttccgggagggcgttatacaggtgaccaatataatttgtttggttggttatttttttatttgtcttattagcatgatggaaataaaataatgccaagagaattattcctaaaagtatacagcctataagaagcatggaacgaattaatatatcatttgtttgagcgtccacaacatttttaggtattatcgaaattaaaaaccagtcagactccagccgtaacggtgtgaaacagaatacagttttttcattttggtatgtaaatatagcccagccggtgtcgttgttttctaatgactgtgcaaactgtttaatattgtttgcgtcatttttgccggtaggaagcatgtcaaaaagatttttaactgttttgttgctgtttggatgcggaggacggattaaaacgtctcctttggtgttgatgacataagaaaagccggcgtcgttataaaaagagagactaaaactttcaactatattttctatctcatattctttgaccaaataggcttttgttccatcattcatagtggttcttataaatatattaaaaacgtttaccccggttatgctgctgatgtgcgggtcaataattccatttgtaatatcagagttcaaaaccgtctcctgcactgttttgtcaatttggtttccttttgggaaataactgccgtcttcggtatacatacttatattttcttctacatggccgtagttattaataattgtttctatttcatttgtttggcttagggaatatttttttatatctttagagagtacactcattgactcataatcgtttttgagctggatccgaagagtgttgcagccttgctgagtgttttccataatagctgtaatagattcttcccataattgattttgaactccccgtataaaaagaagtgtaagggtaactaaaacaatacctataagaattgcggcgaaagcaattttctttttaatattgcctgaaatgttacgtttcattaggagcacccctttccgaaccggcttgttcgtctatccattgcattgtggattcaaaagactcgcctgaaagcaattttttagttgcgtcggctgttaaatcccaaatcggcaaatcaagcatagagtctgttcctattactgttcttgatgattgataacaagaaacaagcggctgaatttctttaacagcagagggagaaccgtttttaagcggactgaacgatgattgctggtcagcgaatttttgtatgttctcatctcgtgtaaaatattcaacaaattttattgcctcgtcaagatttgccgtttctgagtttatactaagcctagtatcagcattaatgacttctaaggagccatcgtccaatgcgggatagggaacaacctgaaactcaaagtcgggagacatttcagcaacgcgtcctgctgcccaagctcctgtcagcataaacggcgtgtttccttttacaaattccgtcaaatcatctgaagtttttttagtgttaagggttttagcggcgtcaatatagcccttgtcaatgaattcattgacaagagagaacccggatcctaagtaatcacttagaactttatcaccggaacttaaactctcaaagatttcttgctggtttttgttttgataagctgagtagaacccttttcctatagctagggtctttaatgaaatatcattgttggctattatcggcgttgttccctgctctaaaaagtaatcgcatactgttctccattctcctaaattttcggggactttttgtttatgttttttcagcaagtcggtgttgcaatataatccaaaaacagaaacagtagtaggaacccagtatatactgccgttgtcgttcatctgactgagcatactgtcagtatagtttgggattgtgctgagaccggataagtcagccactttgccccgggatttaagctcaagaagaatgtcatgattcaccataaaaacatcgtcagcttttcctgttttaatacgcttttccaatgcttcatagtattcgtttcctttaagactttcataagaaactctgatttcaggattttctttcataaagtttgatattatttcttctataactctaacattctctgtctcgtatttattgccgaaaaaagttattgttgttgtatcgggattatttggataactcacaaccttacttttttctgtgcatcctgagagaagaaaaatagatgtcaaaattataatgagctgaaaaaacactatttttctaaacatatagaatatcctccaattatttttttagccgtccttgttgttttttaataatctatttaaagtgttcagcagtatgcttacgtcaacaggtttagatatatgggcgttcattccggagtctaatgcagactgtatgtcctcagcaaaggcgtttgcggtcattgcgataatcggtatagttttagactctgggcttccgatgttccttatggcgcgggttgcctcatatccattcatttttggcatctggatatccattattatggcgtcataagttccgggagccgcggaggaaaatgcagaaaccgccttttctccgttctcttcaacggtatattcagcgccgtataaatctagcaggccgcagagtatttctgcgtttatgtcattatcttcggcgattaagaaacgccgtcctaaaaataggtttttgtcttttggtatcgaatcttcagtattgtttttggagattgttttttctatgttattgtttattttatattcgagttcaactttgaaggtgctgccgatatcaggtttgctgtcaacggagatttttccgttcattagttcaacaagccctttagtaatactaagaccgagaccggtgccttcaatcttggcagctgaactgtcacgcgcaaacggatcaaaaatatgctttaaaaactcttcagacattccgacgccggtatcagagaccgtaaaacaaaaacgaacattatttgtctttaatgccgggatttcttcaactgtaaaatcaatttttcctccgaacgggttgaactttacggcgttgtttaaaatgttaataagtatttggttaatacgcagagaatcgccccaaaaataattatgtttgatttcttttagcttgtaattaaatttaagcccggcttccttcgcctgaggttcgataattacggctatttggtttattaaatcaggaagatataccggaactatgttcatggctatctttgaacgttcaattttactcatatctaagatatcatttaccaaacttaatagatgttttgaggaaacagatatttttttaagacagtctaatactttttcacggttgtcgagatgaacttcagctaaagtggtcattccgataattgcattcataggggtgcgtatatcatggctcattgtggatagaaagtcactttttgctttatttgcttcttcagcaagctcgagagctctttctaaggtttctttagtgtgcctttcggcggcgagcatatctgtcacatccgcccttaccatacagattgttcggtggttttcatcgccccaaagcacgttgatttgtttgtatctgagaccgtcttctgtcttctgcggatacacaaagtcataaccggacggtttttttgaaagatttttaatcatcgatgagatagtaaaccgcgtttttaattcggctttttctttttcagtatcctgttggtttgcaaaaatatttaattttttatcgtaatcatctataatgtacggagtcagattttcaagcacgatttgacgtgtatacagcgttaagcgtgaatcatcaatgttaaaaagacacgccaggtcaaaggtatatgctatcatattgagaaggccttgctgttccctgacagagtcagtaatatctgaacacaccaggctgacacggtcaagccttaaatctatagctgaaacagtcatgtttttactccggacgtctcctttttcgtctgaaatagcataggcaaatgtatatgaaccttctttttttaatcttcggcgtatctcatccggttcaagtaattttgaatactgagctttgtctttgggtactatagctgtgctgaccatatcaagaaccctttgtgaatgacggccatactttggcggcgcacaatgggcgttcttattgcatgaaaggacagtgaaagaatcgtttgaaagatttaaatcaatgacatagtcatagctggtgattgaaagctgatgaagaatgcggtcggatattgtctgttcagtaatgtcagtcactgtcagtattccggtaatatctccgctgtccggcgcctcaatcatatttactttaaattgtacgtaacgtcctttttcttctttcggcagcttaacaaagcattttaatatcttctcagtatcatggtttaaataagcctctaaagacggtttgtttaaataagtatcaagaaactgctgatgttcgttttcatctgttaccaaaccggctatgccggaaaagaattcattgcgtacatagccgaaagtctttaagagatctgaatccgtataatcaataatttcaagtattttatttttcgttatgttgcagtgtcccaaaatcagggtgtcaggcccgggtgcctgatagtgctgcagcagtatattttcgtactgctgtctgagctgttccttttcttccacggatttgcttatatcagtatgaaccgtatataatcttttgactccatccgaagaatgtattaatgaaatggtgctctttacccaaatataaccgccgtcttttagttttagccggcctgtcagttcacagtgactgtttccgctgtttattgaatccagaactttattttttatattgtctgaatcatcgggatgaaagcttgcaaatatatcgtttttatatatgttctccacttcctcgactgtcatatgacacatggaggcaaatccttcggatatatattcagggattaagctgttgtcagattcataccgtattacggttattccgcccggcagattttctacaacgctttgaaaatacatagacagccgttctttttcaaatttgattttagtttcttccgtaacgtcacgcacatattttacatatgcggatataccgttccagtcggtttcatgaaaccgagtgctgtaaaacttgtctgttccgtcaactaacatatcatgttccgagttgtcaggtttgtgacttttcagagtgcaaaattcacatggggcgcttttgccgaaaagcgccttataacatttttcccctatagtaatattatctttgaggaaaagatttttcgattcatttgtgtaaaataattcataggtatctttgctgataacatatataccgtcggcggtttcatttgcaatactttggaacagtctggtttcagaagacatgccggtaataaccgcataaaatcttgaagagtcggaaagcggtcccatacggcgcccgtttaggtgaatccataccagggaaccgtctttgtggtgtaccctatacgatatatctaaaacccttccgctttttaacgctgatacagcttcatccgaaacacgttttttatcggcttcatatattacttctaatgcgttgtttttagttatttcttctagttctttacgggtatgcccggataaagccactatgccgtcagaaaaaaatattggaataaattttccgtcttcaatacggtaactggcaattccgccggggatagagttaacgagatggtctagctcaagctgcgtttctttcagatttgatatattatgaaatacgcagtgtatcagcggacagccgtcctcttcgccaatttgtttcgcctgaacatgtacccaaactatatgtccgtcacggtgctgttttcgaaagtcgaattcggtaacggtgtgattttttatagcttcctgtatatttgataccaccatttcggtgtcttcataataagtcattttggcagcgtcttctttgatgagttcgtggtattcttcgactgtgtatcctgaaagttccggtacgccgtctgagaaatagatagtttcaaaaatatcggatactttataaattgccactccaccggggattgcattaataatatcctgcattttatcgttggctgcagtcaattcttgttcaaggagtacccgtttattaacatcagaataaacgccgtacaaaaatttagtattgtcggcttgtgtttcaactgacccatcaagacgtatccagcgatattcatttttattatcattccagacgcggtatatatattgtacgagtccgccctttaaaatagcatcttgaattttagattgtaatacaggaaggtcgtcggggtgaacgccgagaaagctggtatcattctcaatttcttttatatgttcctccgagtaacccatgattccatagaaagcgggattatgaaacaacggcgatattttgccgttttcaaatttatatacgcataatccgcatggaatacagctgaaagtagtctgtagttcttctttgacagccttagatttgttctcttccttttttctctcagtaatatctgttatgtattcgatatgggcttctctgccgtcccaatcaataattttaccgctaagctgatatatgctcgaatcaataggtagttggaattcacgaaccataaatttatcccggctcattttggacgtctgacagaatgggcagggctgagtgaaaccggcagcctcatagcaggttcgttcctgaccggttgagttgctcgcgagaatgtctctggccttttcgtttatgtacagcagttcataattatcaatggccgacacatatattgctgtcggagagttattaagtattgtaattatttgttctatagccggagaatttttatcggacacaatattcacctccttatatttaatgtcgtaaaaattgtaaaacagttttatatttcatattttaaaattattacagatccagtttatagtacgttgatattatttatcctgttcaaaaataaaatcataaagcgtttgatataatttgtcgggttcaattggtttcgctaaatgtgcattcataccggcagccttgcttttttcgatatcatcgtcaaaagcattggcggtcatggctattatcggaatagttttggcgtcgccgttgcttaagtggcgtatattgctggcggcggtgagaccgtccattattggcatgcgtatatccattaagattacgtcataatatccgttttgagatttattaaatatttctatagcgcgcagaccgttttcggcggtatcgacagaaaatcctttggatttaagcagcataacggcaacttcagtgtttatcatattatcttcaaccagtaaaatatgttttcctgaaaaatcgtattccaaggttttcgcctgctgtgatttctcttccttttcacccatcgctttagaaaaagcagaaataagagacgacttaaacataggcttgctcataagcatatttactccggctaactttgcttcatgctctattgaagcccagtcataggcggtcataataataattgtaacgtcagggccgacaatttctcttatctgccgtgcagtttcgataccgttcaattccggcattttccaatctatcagtatcatgtcgaaatattttttgttattgtaaagctctttcactcgttcaatagcctttatgccgctgtccacccattcggctttaactcccatttctttgagggtaacgacagcgctttcacacaccgtcacatcatcatctacaaccagcgtctttagatgcgaaaagttatatgttattttcttatgtttatgatgaagcaattcctcatcgctgataccaagctttacgtcaattgtaaattctgttcctatatcttttatagagcggacggttatgtttccgtccatcatatcaacaatatttttagaaattgccaatcccaaaccggttccgccgtaaagtgaggtggttccggtatattcctgtgaaaacggttcgaatatatgaggaataaacttatcgctcattcctataccggtgtcatttacaataaatctcagaactgcgtcgttttttaattttctgtgaactgaagcagaaaaagaaaccttaccgttctcgcttgtaaactttatagcgttgctgagaatatttattaatacctgttgaagtttcatagcgtcgccgatgtaatagtcgtcgagtattggatcaactatacactcgtattcaacatttttggccgctgcttgagagtagcatatcgaattgatgccgtttaagaattcttctataggtatcttctcagattttaaaagcattttaccgctttcgattctgctcatgtcaagaatatcgtttataagcgagagcagaaaacgtgacgagataccaattttagaaatacagtctgccacctgttcatcgtttccgatagcctgtgccgcaatagtgctcatacctattattgcattcatgggtgtacggatttcatgactcatcctggatagaaaatcagttttggcggcgttcgcctgttctgcagcaaccagagctgaggcgagttcctccttttgatgtttttctttctccacaatatctgttacatcggtgcgcgccatacaaacccggccaagttccttattgatataaaacacttccagccttttggtttggagcttgccataaatgtttttcatttctattataaatgaatatgttttatttgttttaagttgttcttttatataatcgaaatcaagttttgtaaggtattcattcgtagatttctcatccataaatttatctgctatatttctgatttcctcttgaaacttaccgctgggaggcaaagtgtttccatcttctttattgaatgaaaggagtttgtattggtttttatttatgtctatttctgttataatatcataatctatttctgctatcatcctgagcagttgttcctgaagcttttgctcagtaacgtccaaagtataaaaaaatgcaattatattatcattttcgggattaacgcagaagcggaagcttgtagttgaccaaaaaactgagttatcatttccttgactgagaaagtcaaaatgatagttgcttttacctaacgcgaaattttgaagaacagtttctctgtttaacgaagtaagaattttttctccgtactcggagtcaacagcggactttgacaaattctctataattttatcgtaggtatctccgactttggcatgaactaagttgagtgttgatgtatagctttccaagatattttgggtaacattcaaacgcccttgaattatacggtcagagggagattgttccgcaaagtgttttaactcgttctcatataattccttaacccgctcctgaagacgtttcttttcggttatatctacaaaaacgcaatagaaacaactatcttcattttcttctttaaataattgagccttaacagatatccattttactgttccgcccttacatataactcggttttctttgtctatggtgttcccgtttctaagttgtatactgagttcgtcaataatttttttcatgtcgtcagggtgcagaattgaagccatacaattgcccatttctaaaaattcttccctggtatatcctaaaaagtcatataatccgtcatttgcatctataatggagagttttgagtcaaaccggcagcggaagacggcgcccggaatattgttatatatgtgcagaatttcatcttgtgttttcttttgagcagttatgtctatacatactgatattatgccgggctttccgctctcggtaataatagtgcggcttaaatcgtgaacccatatatatgagccgtcttttttcttcatgcgatattcaacttcatattcattattttctttaagctgtttatcaatctctctttttatagatttcctgtcgtcaggatgcatgcagtttgttatcaatccgtttatatctgctataaaatctccttcattatcatatcccaaatagtccagcatttgacggtttacaaaataaaagggcagcccttcttctaaatatccgcccatcataccgcctgccagagagtcgttcaaaagtttattcctaatttgggctgtatttttcataaccagcgtttgaggataatgctcttgctctcgttggctgctgcttggctcggcgaaatgaagattgttaatcagccagcggccgttttccttaactaccaaaaaaaaggctctgagatgccattcgtatagagagttttttagtatcatttcggctgacgatttatatacgtcatcagaaatcttttgatcatggataaagacaagttcataatcaaaaggttcagatatttcctcgatatcacgctcaatataatttagcatgtcggtttttccattttcatattcactttgtcccgtgccgacaaaggtgatgtcatcagataaatattctgccgcgcttttcgcatcacgatttttaaaccaagtaacgcaaaaattgtttaaattttcgtgaattatatttttttgcaacattcgactcttcccttcaagacgattctcaaataattatttatattttacatttttatctttaaaatttttataaaaaatgtaaatctatcacataaactttacaagatttaatttatatattataacatattgggtcgaaaaaagcaataaattttatatgaccggagaactctataaaaactaagaatataaatttttaagcaatgtttttagaatttaaaacatggattgtcttatttatatcttattatgataaaaaaatttaaataaaagtttcggttagattctgtatattaaagagtggaaaataaataaaaaaaagactatacatctgtatagtctcttggagctacctagcggagtcgaaccgccgacctcttcctttttattataagctatagtctgagatgaaatagtatgtattagatatatgttttatattatttttgttttcatatgttttatataagttaatccaataatatttgcaggatatgtggagaagtagtaataaactatttagtataaatgatatgttcaaacatatgcagctatgaaattcattaaaagtaacttacaaaataaaatgcaataatccccttcgtgaattttttaagttttgaaaaatcttaaagaaaacatttttatgtttaataataagcttcggctataagaaatcaatactaatgtttattttatatttgactttaattatttatttttagttctaatactacattcatgtaatttattaagatttcaagatgataaactgttcgacatcaatttataaataattatactatcagcatattgaatatattctattataaatttaataaatgttttcaatattatttttccaacaaaataagttgtgataaaacaagtttagtgaatatatacataatttcaggctgcaatgtgtttattgtgtcaattagttgtggatattgatgaaaatttgtgtttggcttgtgctaattgtgtaacaatgatataatgtgtaaagagttttttgaaaaatattttacaaaatacagcttttatactatatataaattgcagtgattatagaaatataatattttatttagaattgaggtggaaaaattaatctagtaatatagagttatattatatattttttaggaggggtttactaatgcgtgtgaaaaagtttttagtgcttttattggttgttgtagtattatttattcaagcagttttgccagtaaacgcaaatgtttttagtgtatcattaaataatcaaatgataaaatacgatgccttatcatttgataatgaatttaatacggccgaggatgtagataataatataccaagtgatgaaaaagaacttatgcaggttgaacaagagattttatattcagaaaagcaaaataaggatagatatataattaaatataaagacgctaataaaaaagatatatcaaaacttaaaaatgtaagtgaaactgcatatcaaaaaggaatggaaaaaagagaaaaggaggagtctgaacggttaagaaggtttaaaaatattgataaagagaagcttgtaagacttaaaatgaaagagaacagaataaaaactgaatctaatgaaaatgttactgttagcaaacttacggacaatacagaagaattcgaagttatagagttaaatgaaagtgtaaattctgatacatttatagataatattataaatgaactaggagatgtggttgaatatttacaacctgattatgtgatggatatgtttggaaaaacaaacacagaattaataactgaatctgatagtcaaacagtaactgcagataatataattgaagatactagtattagtgacgattataattcattaaatattacagagacttctataacagatgaaacacttgagccagaatcaaatgagtacgatagactatataatatagataaagatttaaatatggctttggaaataagccgtggtgataatgtgacagtagcagtcatagatacaggaattgatgtaaatcacccatatttatccgaacatataacagagggatgggattttgttaatgatgtcaatgaagtatataatgtagatttgggattagaacaatcgcatggaacacatatagccggaataattgcaaagattgttcctaatgcaaagatagttccattaaaagtatttgaaaatggtaaagcacgcactagcgatataataaaagcaataaaatatgcaaaagagaatggggtaactatagtaaactgtagttttggaagtacggatgataataaggcattaaaagaatctattgagcaatcaggattattctttgtatgcgcttctggaaacaataaaataaatatagatgagacgccgatatacccggcagcttttaacttaccaaatacaattagtgtagcgtcgttgaatcaaggattgggaatgtcatatttttcaaactatggtgttaacagtgttgatatatcagctgttggtagtgacgtatatagttgtttgccaaatggcgaatatggtacaatggatggaaccagtatgtcggctgcacttgtaacgggggctgcagcattggctcagagtattggagttgatactttaaaggagactctaaagaatacatctgataaacttacgtgtttaaaggatagtgtgattgatggaaacaagctcagtctttacggtgcggttacaggagttccggcaataaaagaagaggtcaatataattccggatgatgattttgagattaatgactatcagaaaacatctacggaaagctgggagttgtttagcagtctggaaaataaacaagttgttgttgagggcgaaaatacatatttcttgaaaagcaatggttctgtctgggctgcaggcaataatagttatggtcagcttggtaacttgacttttacagaaagtaatatacccgtacaggtttatggtttatttgatgtaaagcaaatttcagcaggaaatggtttttgtattgcggtatgtgattgtggatacgtatggtattggggtgaaaatcaaaatatagtaaaaagaataaatgaattatatggtattgactctgtaagtgcgagttactataataagtatgccattaaaacagacggtagtgtgtttgcctggggggataatgcctatggtagtttaggtaacggaaacaaggaaatagtatattctcctgagcaactcagtattacaaacgtaaagcaagttgtgggtactcctaaatcgactatttttttaaaaaatgatggaactgtatgggcttgtggttcaaatgtacataagattcttggcgatggctcggaaaagacacagacattacctgttaaagttatgaatgtatctaatattataaaagtatcgtgtggtacaaatcatgctgtggctttaactaatcaaggagaggtatatgtttggggaacgaatagtagaggtcaattaggaatgccggaaataaccgaggacagcaatgcagtactaactgttttcacggatgtaattgatataggtgctgatggagattatacaattattattaaaaatgatgggacagcgtggtcatttggatataattactatggacaattaggtataggaaataggataaacaaaacgtcaccagaacaaattagtacattgtctaatataacaaaagttatcttgtcatatagtcatgcagctgccattgatagttatgggaatgtgtggatgtggggagacaattcatatggtcaatttggtaatggtacttgtaatggtactttttatcctactttaattgttgggtattggaataatttaagcaatgcaagaaccagaatgtctgcagggaaaaatcattgtttatatgttagctctggtggggaattatatgtatctggctctaatgaatatggtcagctcggaaacggaacaaatctagattctgattttagctgtgttcagttacttgaagatatagtagaggttgcagcgggagattattttagtgttgcactaagagcagatggaaccgtatggacatgggggttaaataataagggacaattaggagacggaacaaatcaaaacagtaatattcctcatcaaattttatctgatattgttagtatatcagctgggaaaaatcatgctttagctgtaactaataataatacattgatgatgtgggggtcaaatgaatacagtcaaattggtataaatggagaatttataaatgttccgaaagaaacaggaattgatattattaaagcattcgcaggaggggacaatagtttctatttaaaaggaaacggaactttatatggttgcggaaaaaatgataaatatcaagctggatttgattatgggtttgatattgtaggatttggtgaaattgaagaagttcgcgacaaggatatattagacatatctgttggtgaaaaccatacggttatgttggacataaagggaaatgtttattcatggggagacaattcatatgggcaattaggtatttcagaggatactccttatgttcataaagttcctataactggagttgaaaaaataattactaaatataattctacatttgcaatagataaggatggtaatacatattcatggggtgataatacttataaacaattaggatatgaaactgaaaacatatattcatatataccacaaacaattaacactgattttaatagcattgccgcaggagaactatccacatggattagcgatgaattaggttatatatataagtggggatatatgccaaacggaaatcctgataagtatgtaaatcaacagagttacaatccacttaaaataccatttggaagtaaatttgtccaagttgatgcaaaaagaaatagtgtggtagctttagatgaaaacggaaacgtatacacatggggagacggttcatattatgatttaggtcatggtcaggaaaataaaaatataaactttcctcaaaaagttgaagggttacctaaaatagtaaaagtagcaaaaggcaaaaatcatacactggcacttgacgaaaatggatatgtttggggttggggcaataattcaagtggtgaacttggaaatgatcttaaaggtaaggtatatataccaactaagatttcaagaatagatcatattaccgatatatcagccggaactggattcagtgcagcaataagagaatatgatggttcgtctaaaatatggacatggggaaattcaactgacggaaagcttggcgagcgaggagaatatttacctggaacaccagctgaagtaatggtaattgatgctgtagaaaaggtgtcgtgtggtgataaatttatggcggtgatatctaatggtagtgtagtctcgtggggagcaaacgactatgggcaactgggaaatgatgctgatattagagcttcggaaccgcatttggtggcgggcgattttaaacagatatcaacagattcagaacatattttagccttaggggttgataataaagtgtactcgtggggaaagaattctattggtcaactaggacttggtgataaaaataacagaaatattcctaccgccatacaaagtataaacaacgtagaatcggtcggtaccgcatatgcccacagcatggcagtacttaataatgggacagtgtatgcgtggggggaaggcagggacggacaacttggaaatggtaataatggaaccagtaaaacaccggttaaggtcggagaatttaataatgttatacaagctacaggtggtggggcattttcaattgtacttgataaagatggtcaattatggtcgtttggcaaaaatgattttggtcagcttggaattataagcgaagttcctgtaaatatgagtataactaatatgaataatgatattaatacttcgattaaagagaatactttatctataaatggatatacaaccggacagggtggtaaacaagtctttataagggttctaaatcctagtaatggaatagaagttttagagcaagtgacaagtaataaggttggatattattcattatctatacctttaaagggaaatatgaatgggacatatcaagtatttgctactattgagggggagcctgaaatacaaagttcgttttttaatataggtcatgagtctgacattaccccaatttgtccagaaccgccgaataatattgcggtacctacattgctttccgttcaagcgccaagtatactaaaaggtgattcgtcatatggtgtaaaagctacaattcaaaatgattcagaggagaaaactcagaatgtaatggtattaactgcattatatgacggtaatgataaacttgttgactattctagtgtgcatttggaaattgcttcaggggaaatagggagtctattaccacaattatatgtgcctgcaaatgtaaatgattataaagttaagatatttgtttgtgaaggaaatgatataagatatggcagtatgatgccacttagtctttcaaagacgattaaaaataatatgcaaccgttggtatctgacagtgaactacaggaatccaagcttccctcaatagagttaacagaaaacatggaggttttagatacaactagatttttatctgagactgaggcagagttatcatcaatttcgacaattgatgatatcgatgttgatgtaacattatcatgtaatggagtttattgtgaaaatgtattaaaacaaggcagtgatgtaaaagttgatgtcagtataactaataatagatcgtcgagtataccgttaaattactttttttatgttcttaaaaaagttccatctttgttgacgttttatgatagttgtgaattaactatagaaccgggagagacaagagagttttcaaatacctgtgcactgagtcaatttgatttaagccaatacaattccaaaatttcaatattaggtatgggcggaggtatagatatgcagcctgctatacctgtcattattctctcaaatgataaacaggattttttcggaaatgacaatgataaagcgacaaatgttggcattggaaggcaaatagttggtgatattaactttttaaatgatatagattgtataaaatttgtacctaatgaaactggttattatgttatacagtcatatggtaatacaaatataaagggagcattatataataataatatacttatagaagaaagctatgatatcaactcacaaaatataaattttataattgaaaaggagctgattaggggccaaacttactatttaaaattatctggggaaaatgatacaggtgaatatggcataagtattaataaagcaaacgatattatatcaatacctgaaaatggtacaataaatgtcaatatggaatatgcgggacaggtaatgtggtttaaactaacacctacacaatctggaatttataatataataagtaaatcaattatagctgaaaatgcagaactatattctggaacaaaggagttattattgagaaaaaccaatggttggtatgatatttatggtaatcatcagtatggttttatatttgataattatttttacgcaggtcaagaatattatttaaaaatttataattcaaacggggacacaggtgaattttcaattactactttcaaagatgattacgcaagtacaattgattcagttaaccaaagttttactatgcctttttctatggaggctataataaatcaggcagatgatgttgacatagtcagttttgagccaaaactaaccggaacttacgtggtcaccgctaagtcagttaaaaatgttaaaggtttagtttttgatgcaaataaacatttattgtattctgattgtagtagagatgatgttagttttaaaatatccgaggattttattggtggtagcaaatattatatcgccgttgtaccaaaaacaaaggcggatgtaggcaattatacattatatattgaaaacccgtttaaaatagtatcggttacgccaactatgattgactagggaggataaaaaatgaaaaattatttatacaaaatattaagtatattattatttttatttataataataaacagttataatttagtgagttttgcagcggaagatacagaagaacttcagcaaactgtttattcaaccggtttattgatgccatcagatgaagaatggaacgaggtggtcaatacaactccatctatagataagatagagccaaattcaagagcggtaaataggtatttagcagccataaaaagtgaaggtgacgtaaatttagcggaaacaattgtgccttgcagaatgggagaagagtttataataagtaaaaacgacccagaagaaacatataactcggaggtgtcgttagaatctgaaagtagcaattggcaatcgatacttgcttcggtaaaaaaggtggataattctaaaattgatggtacgacaacgccaaacccctattttcctcctgtaggtgaccaagcttcgttaggttcatgtttatcatgggcggttgcgtattatcaattgaccaataattttaataatgtaagaaatacaagtgctcaggacactaacgggaatataataattgataatgttatgtctccgagatggttatatagtatgacaaatggtggaatagacatgggctcatattttgaagaggttagagatactttaaattcacttggctgcgcttctttatccggcgatagattgattagtgataatttgtatgatgaaagcgataaatacgaaatatttggcagaatagaaagtgactttaatatttggccaacggaaaaagatacatatattgatgctatgagtaataaatgtaaagtagcttataataaaaactatgatataacaaaaataaaacagactcttataaatggttactgcgtttcatttttttcatattcaatatatgacaataatatgaaaacaaataataatgggtgtttttggatcaatatgtctccggagatatatataaataattcagaacgaaagtggtatattaacgacaggcatgcaatgacaattgttggttttgatgataacataaatactccattagggacaggagcgtttagagttgtaaattcgtggggagatttttggggagatgagggatttatatggcttccatacaaattattgaacgggactacaaaaacaataatacaaaataatgttaaatacacgataagctataaaccaattgaaggttattgtactgtgattcctactgcatattataagccgttggccattggaatagccgagcttgaaacaaatgacagacttgcaatcacagtgaagagaggggtaaccagtccattaaattataatgaatatgtcagcacaaacaagtgtgcattttataatgctagatcaagttctttaactcaagaatatggaggtcagcttccggcggttgattttaacggcaatacaaaatcaacatcctcggcacaggtggcgtttgatttaacgcctttaattcaaaaatgcaggtcatatctaaaaaatgataaaaaagaagtaactttagatctgaaggttacttcaaatagaggaaaaacagatttcaatagttttcaagttgaggagtgcacagggcaaattgtcaatgctgacattttgtataatcaacaaaaatctgcaacattaggtatagagtgcaatctaattgattcaaaaaacgtaaatgcattaagattggaatttaataataaggttgatgagactacagtaaatatagataatttgtacgtagagcaaaatggtaaaagagctgaccagttacaaatatatgataagccgactcagaaagcagtgagtgtaaaaccaatatctacaaatgggatagaaggtttttatcctaataattattataaattgattgttacagataaagttagatctactgcaggtaataaattaagtttgtttgataataatatgaaggcggagtataattactatacctggtaaataatttgaggtgattatatatgaagaagtgtttattgatattgcttgtgatatctgttttgacaatgagtgttccggtattttcaattggttatgaagagcagctaagtgataaaaactatgaatatgaagtgagagattttggcgctgttattctcttgtataattgggaaccttataccgatgataaaatattaaatatcccggaacaattgggcggttatgcagtcacaggtatagaaggtttagttgcgccggggtcaattccgagcacagtcgagattaatatacccgataccgttacatatataaatcctgaggtatttcatgattttcaacttcttgaaaaagtaaatgtttctgaaggcaatgtggaatatattagtcaggatggaattttgttttcggcgaataagtcgaaattaattttctgcggattgacacttgaacattattctatacctgaaggcgttactgaaattgtggattcagcatttttaaaatctaatattagcagtattgatattccgggcagtgtcgaaatgattggaatgtattcaatgagtccgtatctgactgaaataaaagtcaatgagaataataataatttcaggtctgttgatggaattttgtataacaaggatttaaacgaactaattatttgtcccgaaaacaagatcggggaggtcataattcctgaaggagtaaccggtttcagggaaaatgcgtttaatgtttgcagtcttgagggggtaactattcctaagagtatggaatttttgccggaaaattcttttggatattgctgtaatcttagatcaattatattttcggaagggttaaaggggttatctttaaatgcatttggtcaatgtgatgttttaaagagtctggagcttcccggcagtttgattgaaatatttcccggatgcttaacttcagaacttgaaaaagtaattgtaaatgcggataatcctgtattttactctgatgatggtttgttatatactaaaggagaaaaaagcgaattgattttgtgtccgcaagccaaaagaggtgaagtgcgaatagcggagggaaccagcagtattagtcaagacgctctatcattctgcaggcagataactaaactatatgttccaaagtccatcaaggatgataatcagggaattaggattaagggtgaaaattttgttgattatgaaatagctgaaggcaacgaaatttataaggatgtaaacggggtactttatgatagttcacaaactaaattgatttcgtatccttccggccgtatgggtcgctatgaaattcccagcggaacgatttctgtttgtaaaaatgcattctgtggaaatagacttattgaaattgtctttcctgatacagtcgatgttattgaagatgatgctattactatagatacatattcgaattataattggatatatggaaaaattctgtatggtataaaaggttcatgtgtagaactgtatgcacgaaaatatacaattccattcgttccaacagatacaattcctaagattgacattagaaatgacggagacacttattatattgattatcttacggatttaggtgaacaatgtgaaatcatagcggcgatatattttgacgatggaaaagattgtagtttatgcaatattgaacttgggaatagacaaatttctcttgaaagaaatggaggtaatttaataaaggtatttacatggaataatttgaattctatggaacctgtttatgaaacatacgaatatgatttaagatataattttaatggaagtataaattataaactggacaaaccagaacgtatatctaagaatatagatgaaaaatatgatttagatttttatccggcaatgctttctctaaaacctaatgtaggtgtaaaagtcatggattatgtgaaattaaattactttaatcctgacaaagaggtctcagaattatataatgataatattaatatgttcaatgctaaaattgttgacgctcaggaacaatgtgttttcagtatatatcagaacggtaaatatgtatttcacgcaataaccgagaatggtacggatatttttcagatggtaaaggttgaatgtatagccaggccaaagattgagtcttattatacagagtattgtgatggcgattatgaaatacctgaattcagaaatacgtgtagagttaatattgagtcagttttaaatccgtttgcctcagttaagtatgtcattaatgattcctgtgtatctgcgtatagatatatagaaccatacactgaggaggagccaataaaaggatattttcccgaaatagaatatgaggcggcaagcatttttgacaatatagatacggttgtccgtgaaaaacagataaaaaatgattatattcttttttcgaaaaatggcaaatataacattttacttatggatagatgggggaacgcttcgaaaaaaactattgagataaaaggcatattaaattaaagacgtgaaaacgccgaaattttccggcgtttttattttctcatttatagataaattgatatattatattcgtcaaaaaataggattagttgacgaatattttattatgcagtcgtgtaaatagtttcgtacaggttgtatgctgtaattttaaataaaatatatattgattaatagtgtaggttttatttaaaagtatgtcagtgattgaaaaaatgatttaaccaacagacagtaatttgatttaagaaattttaattaataaattaaaaagctcaggataatattacataataattgtttttatataaaaaatattcaatataatagcgtcatatatttaaaaatttaaattggctaaatctttataaaatacatgctatattcacagattaaaaacatatttacaaagtgatattttaataaaatataaattataataaaatatcaagttttatatttattataaaataaaaaagccctgaaactaatgtttctataggcttttagtctggagctacctagcggagtcgaaccgccgacctcttccttaccaaggaagtgctctgccaactgagctaaggcagcattggcgatccggatggggttcgaacccacgacctccagcgtgacaggctggcattctaaccaactgaactaccggaccacgtaaacagctatattataatagcataaccagctgtttattgtcaatagtttttttataaaaatattgtttaaattgtaggattacaatagatgtgttacaaatagaaaaaaagaatacggaaaactcataaattgtgttatagttatatcaccataatatcacatacatataaacactgtatatacggaaataattgaaaatgaaacaataaagtgcatagaaaagttgaggtatataataaaaataaatataaaaattttatgctagatggccctaacacttctgaccgctttattgtagtctttccatttttattgtgtgtccagtaaagactttgtatatattttaacttaattcttaatacatattttagttttggctatgcttataatcactgcaaatttattttttaatatatgaaccgtttatatgagttccaaagttatatatgaaaattataacgtatcagattatataaactcagcaaatttaatttatttttataatctaaagtctgccggcggcggaacatttttgcttggctcttctaacaaaaactttgccagagttggtatcttttctcttatctcttctgcaataaaacccgcataaacaaaagaaccaaatctgttttgatgcgtattgtcaatctctccgaattctcctgactgcattatttcattatagtcctgaggccaggctttaggcctgccgtatcttgattcgcctatggtgtttcctgaaccgtcttttaatgactgcaagtatttgaaattctcttccccaatactgttaatatagttttttgacctttcaaacaactccagcacagtgacgtcttccgtttcgccaacctgacgaattgctctgatataggcatattctccgaattcgtctgtccctccgtgattaccgggaactgaagcgatttttccatctttaaaaacacctcttggaggaggtgtgagcaaaacaggcgctgcaccgcgctttcttattttatcaatataaaattttaaatagcccttataagtcgctccgcactcaaaagaataaggcgtgtttccaattggcaaaactgtgggataaattccattagaatcaggcgttccgagcggcgtgtgtcttagttctcttttttcatgtctggcagaatcatcatcattatggcaaaattgaataaatacaaaatctccttctcttattagttcataacacgggcctaccccttgaggaaacatttctttagtaaagagtccattatctataaatctgccgtcatttaaaaaacttctggagcttttaccgccttccgcgcatgaaataaccgaaacaaatttatcatcaaaaaaacttcctaaatggtcgccccagccccctataaaattttcactgtctttaccatatgcggtaactatcgaatcacccaataaaaatactttaatcataataacacttatccgtttcccaataatatttagatacaaaaatccttctttttatgatttactatcatatcatattataatacattattttatattaaaattcaagcagacatttgactataaagcaattgacattataagacaaattttatataataattaggtattaatttttgtctgatgaagtaaagctttaaatccatgtttatttaacttattttatagtattcattcaaacgtatttcgacgctcagtaattgaatttttcatattttaacgcttatattaacggttctttgacgaactttcggcctatataaatttgatacaaagcgaattacaataaatctaaaattattaaacttttaaatatattataaaaaggcaggtatgactatgattacttttatagccggattaattattcttattgccggcggagctgtttacggaaaggtctgcgagaaaatatttaaacctgatgatagaacaactccggcagtaatgttgaatgacggagtagattttgttcctatgaaaaagtggaaaaacagcttgatacaactcttaaatattgccggaaccggtcctatattaggtccgattcaaggaattttatttggtcctattgcattcatcactatacctatcggttgtgtaatagggggagcgtttcatgactatatgagcggaatgatttccgtaaggaatgacggaaaacaaatgccgtcacttattcagcaatttttaggtaagcatatttatgttgtatataacatatttgtctgtatgctaatgcttttggtcggagctgtttttatctatactcctggcgacttatttgtaaccgaaattttgaaaggtaacagtggattttcaaatccagttatttggattgtttacggtgcaatatttgtttattacataattgcaaccctgtttcctatagacaaaataataggcagagtttaccctatctttggggctgtactgattttgtccgctttaggcgtatttgcgggactttttattaaaggctatccgctgaatgaaatctggtcaactggagttgtcggcatacatcccaaaggtctgcattttattccaatcttttttgtaaccgtagcctgcggcatagtatctggatttcattccacacaagccacccttatctcaaggacaataggcaatgaaaaagagggcagaatgactttttacaatatgatgattgctgaaggttttattgctatgacctgggctgcggctgcaatgggagttatgaatcttggacttgccaacgctgacaccccggcgactaacgttgttggtatagttgccaacagccttcttggcagaataggcggaatgattgcgataataggcgttattgtccttcctataacatcaggtgacaccgcgcttcgctctttaagactaatggtttcagacgccctgcatattgaccagtcaaaaaaaagaaacagattgatggtatcactggcaatttttgtgcttgtggcggcactgcttttattctcaaaactgaatgctgacggattcaatatactttggcggtattttgcttgggcaaatcaaacaatagcaatatttgcattcgctatgattgccatttattttatacagaacaaaaagccatatattctcgcaattattcccggaatgttctacgcgtttattatcacaagctttattcttaacgctcagattgggtttaacctttcctggacaataagctatataattgcaggaattttaacagcagcatatggatactttataatacataccggcaaaaaatctttaaaactgcaaacacaaataccaaattagaataataagataataacaggtatttactaaacaaatttgttagccaatctattaaatgtctcaaattaattatgatattaaataaaaataagacttcaaacaatatgaactgaccttaaattgttatatttttggtctacctttttgggggtaagttcattataatgaagtcttatttttttctattcatttattagaaaattaaaaacctttcattttttctgtcctaacaaagcggctgccattttattcaccctgatatttttgaaccggctaaataaaacggtttatttttcaaactctataataatatttccgctgtcagtttcggcgttaagtctcttatctccgctgttcacagcgctgcccaaattattattgccgtatttgctgttggatgttattatatactccgtctgagcaccatttatatttcctcttatatttccatttttagatttaaggtcaatataatctgaggtcaaattatcaaatttaacatcgccgttatcgcttgcgtctattaaagctctgcatgaaacgtcctccattataaagtttccgtacgcgcgtttgctttcaattgtatcagaaactttaatactgctaaaccttatatttccacttttagcgtcaacagaaagattttcaaagctatcttctgtaagcttcaaatttccataagtgtttttgatttgagtatttggaaagactgaattatcaatatatatgttcccatatccgcttgtaataacagcactgctcccgctctgaccggctgtagaatttaagatactgatatctccgctgtcaatttccagtttgaaatccgaaaaagcgcagtcctccatacttactctgccgcttttgccaatatactttaaacttccgtttaaactttccaaacttacatcgctgttaccggcgtcaatatcaaagttctgaatctgcccctgcggaacctctatatttacaacatatgttgcgatattaatactgaaaaggttatcataccactttgaaccatatttatagtcaactttcaaaactccgttttcaactgaaacactgcagcttcgctttaagtcttcactataagtaactctaaccttttcaccgctgtatcctgatatttctactctgtcaagggcggaatcaatatccatagcagttatatccgaagcgttaaactctacgctttgcgccttcaggtcaaccggttcaaaagccccgcccgcaatagacgcgccggcaataattattcccgaaacaaataaaatacacgctgtaatgattaacttcttcatattctctcagcctccttgcgtataaatttatacttgatttttctgactataaacattgtgaactgtattagttttttagcgcaccatacacaggcaaaaaatccaagtatcgctaaacctgcacaagcaattgccgtaccaagaaaaaacaaagcttttgctatactctcggcaaacacaaaaggcatagcaataacggctaaaacagctgaagcagcaaacgcaacgtctgcggcgaacaatgatacaacaacagaccaaacagatacatacagcgccagtaatgacgcggcaaccgctatcaagattgaaagccatatcggagacccgacaataatcaatataatcgcaggaacactaaaccgcttccccttaacctcccgggctacaagctttcgtattgacgtctcgtcagtaatccgtcctgctattgtatccgcgtcctcaagacctgcgataaatgttttctcgtcggcgccgtcctcaacagcgtcatcaatcagttccgaataataatccaaagtcttatttacctcttcataaggcaacccctttaaagcatgacgcaaatcatttaaaaactcatccttattcatcatttttaaccgcctcctttataaaatcatacgctctcgtcacatttggccattcatatataaatacattaatacgctcaatcccctctttagttatttggtaatactttctcagtcttccgttatgctcaaccgaataatgagtaagacatcccgaactttcaaggcgcttaagtattggatacaaagtagattcagaaatctccatatatggctgtatatcctttataattctgtatccatatgaatcttcacctttgacagacgctaacacacaaatctctaatattccgcgctttaattgtacatccacctgaaatacctcctttcacctgatactatatcacgcatagtataatttgtcaagaggtattttaaaattattaaataaaaaaactgagttgaaaaatataaaaataatattttaagaaaaaacgcctgaaatcggctgaataataccgaaattcaagcgtttgtattaataactaattttcttatatctttatctatataaatcgtcttgccgcagtttttttatgacagataaacagtttcatttttaaaggcaccaaataatgataacgcaatcaagcttgtatccactaaatcttttccatagctcagaacatctcgaagaggaacaactccatctttgtcctcacctatatcagttttgagaattaaactaaataccgaaccgccttcctttatgtttgataccaatattttaccgttcatactgctggcaagtttttgacacactattaagccataacctttataagatctgagcaatccgttattctttccgaaaatacttatattgtcacggtttaaaaatgatttgattttttctatatcaactccaataccgtaatccactacagaaacagcaacggtattttcatttgagaaattatttacgataatatccacccgaccgttttctgagtgactgtgaactattgaatttaccagcaaattaacaagtatatgtgtaagccgcgttatatcaacgcttactagcgcctcgctcctcatattatttctaagatgaatattcttgctcacagttacaggcagattattatgaacggtgtttataaactcattcatatattttaccaggcttaccttagtttttttataaagagcagcctcatttttactcatcagcagctcgcataggtttctcagcctgagataagtagttcccattgatgcattgaccttgtgtagaatatccaggctttcaggtttcagttcttcatattttataacagaatttatcatatccctaatcatatatgtattatcttctatcagtttaataatgtattcaatatcattttcaaacacactctttctcgaatcgcatgataaaatgtatttcttattatgaaaattttttagtaaaaataatcgtaaatcttttgcgcttaaactaccgttttgggataaagacagttcatttatttcattaatcataatacacctcatgtcttattttataacttaatatatataaaattttgccccaacaacatatttatttcatattaatactataaaattaaaatatctatgcaataatattattataacacacgaatagactggaagacaatgataaatatcacatttgaaaaaataaaataaaaaactataattaaactttaaaagtatttcggctgttttaaaatattatatgtttatatactgaccatataatataataaaacatatgtattaaaatcctgcacatatgtcacattgataaagaaaccggatatatttaaatatttaaattaatataaacaataacatacagctatattctttgatgttttaatccgctcggtattatactgcccgcaattatatataaaattgataattgcctgtgattaaacaaacaattatcaaatcgtaaattattataaattgacttttatataaacatccacgccgcaattaaaacagcgcatcctataaacagcagcttcttggagtgatttctccattccccggttttcagcccccaggcagtagaaattattaatgctaaagcgttaaacagaatccatccaacagagctgtatttttctcccaaaattattatagaaagcccatataataacaatgctgcataccatatcatactcacaataaacaattttgccgacctaacggcggagccttttagtttaacggtataccattcctttcttataaataattcacagatacaccaaatcatccccataatacatccgccgacaagcacaggcagccatttcaccgctgaaatagctaactgggaataatctaaagccattaactcatatcccaaaacctcagatccgttaaaccctatattcatcgctccggaacctaagccggaaagaatggaaagcaggtatcctaaggcagatccttttgcccctccgtcccgctttacacctgcaacagtaataataattactccgataacagtcaaaataaggccgatatacagtttaaccgcatcgcttccaacagggagtgcagaatttaatatcatcggcataacagacccaacgattgttgaaatccccatagatattccatataccatagacattccgattttatcaatagctttagaaaatccaacagctgaaattccccacagcataccgcaaaatacaggcagtattttataatattttataaactccggcaaagacggcacctgaatccatgcaactcctattactgtcaccatacacagcagacaatatatcccccaaaatgccgcccaagaaaacggtttgtaatttttataccccaaaccaaagcttccctgaaaaattccggcagcaaacaataaagcaaaaccaactaccatatttacccccatatgtaattatataaaattatacgcattgtctatattatgatataataattataaagtcaagacttatttccggtataataatttttaatggatataatgattaaaacaaatgccggtttaaataaaaaacgcccttgaaaccggtgaatcggtttcaaggcgcttttagtatttttacaaattagtggggctgtttctttttttcataaaaatgttcatactggtttctgtctcgccataatcaacattatatccgaacgtctcacagacaaaacgaaggggaactaatactctgttgttaagttcaacggccggaacatcaagttcaacttcatcaatatcaattaaggcatttttatctccgacaatcaattttattgttttgccattatactctaatatcacgctttgctcggtctcatcataaataattttattatctctaatccctatggcattcgctaaaaagcgcagaggcaccattgttctgttctcaataattattggttcaacatcaaaatttatcttgcttctttctatatatacatttatatttttactagatgtaatcctatatgtctcaccattaatttttacagcatcaccgcttacgcttgcataagtcggataaacacaaaacaatgaaactatcaaaacaaataaacacaaaataaaacgtttgaatttaaaaatcatttatatcctcctgtggcgagattttgaaatttgtaattaaattatttttttataattaacatctatagctgaatatccctatcattaaaacaaccggcataaatagaaaacttgaattaacggtttctggagaaaatcaaacttgtcagtaaaattgaactcctcaaaccagcatattaatgaaaacccatcaggcgtatcagattccagcacatattcgccattttacttactgcgagttcggagccagcacaacatcttcataatttaagttaaaagtgactttaaaatagttgtccttaatattgggagaacctctgccattaactttgtctcattaaattattggctaaaccccattatcaatttaaaatatttataattcggtatttacaacattttcatattatcactataaaaataaaaagttacatttataaatgtaatcttttatttctttttatgttaagatacttatagtaaatataataatttaaaaagtatttcaatgctaacaactatttacattatatatacgatatagttatgatatttttattaagtacaatatatatacgacatagttatgatatttttattaagtacaatatatatacgatatagttatgatatttttattaagtacaatatatatacgatatagttatgatatttataaaatttttatatttatttttattatatacctcaacttttctatgcactttattgtttcattttcaattatttccgtatatacagtgtttatagtgaacatcggtagggcagatgtatgtgatattatggtgatataactataacacaatttatgagttttccgtattctttttttctatttgtaacacatctattgtaatcctacatataatatataacaaattaagacaaaatatattgacttatagctggtaaaagtggtataatgtcttttatatgaattgaatatataactttatggatgtgataattttgagttttggaaagattacgcatactccggtaggacttgccgatgtattatgtgatgagtatgaacttaaactgcgtatagaaaatacagcttgtacagtttttaaagattatggttatcgaatggttcaaattccaacttttgaatatttcgatgtgtatagtgtttctaccccgactcaggcggaacatatgtttaagttttttgacaatgatggaagaatgcttgctcttcgccccgatttaactacctctgtagcgcgtatggcggcaactaagccggctgccggtaaattgccgcttcgtatttcttactgtggaagcgctttcagaaatgaggaaaatttcagtcaagcacgccagcgtgaattcacacaagtcggagttgaactaattggtgacaacagtgtaaatgctgatgctgaaataattcaaattgcaatagaaacatttttaaaatccggaattaaaaattttcaaattgatttgggtcaggttgaattttttaaaggtttggttgaacaagccggcttgagtgacagcgaaagcgatttaatacgcagtcatataaatgacaaagattttattgctgttcagtctgttcttgacaatttaaatattaacagcaatatgaaatcaatgtttcagaacctagcaacaatgtttggcggaattgaaattgttgataaggctctttgtgataatgacttaaaccaacgttccaaagacgcgttaaaaaacttgaaggatgtttattcaattctagttgaaaaagatttggacaaatatgtttcaattgatttgggaatggttcaaaatatagactattataccggaattattatacgtggatttacatatggcgtaggatttccaatttgcagcggaggaagatatgataatttgctggcgaaatttggaagagacattcctgctacgggtatagctataggcgtagagcgcgtcatggcttcaatatatgatgaaaataatgacagtgacaaggaaataagcagcagcgaatacgttaccgtggctcttgctaaaggcagattggcggaattatctgtagatatatttgaaaaaataggatttgatgtaaatcaaattaaagaaaaaacaagaaaattaatttttactgatgaagaaaataagttaaaatttatactggtaaaggcttccgacgtaccgacttatgttgaatacggtgccgcggatataggtattgtaggtaaggatacgcttttagaaaacaataaaaatctgtatgaagttttagacttaggttttggaaaatgcaaaatggcagtagccggtcctaaagaaatgaaagacaggattgataaacaaaacattatgcgtgttgcaagcaaatatcctagaattgccagagaatatttccataaagttaaagggcagaccgttgatattataaagttaaatggctcagttgagttaggtccgttagttggactttcagatgtcattgtagatatagtcgaaagcggtaaaactttaaaggaaaatgggcttgatgttttggaagaaatttgtgatttaagcgccagacttgtggtaaaccgagttagcatgaagttaaaacgcgataaaattgttgatattattcaaaagatgaagggagaaataaactgttgaagatttaccccgcaatagacataataggtggagaatgtgtcagactcgttaaaggcgattattctcaaaagacaacttattcacaaaatccggttgaggttgcaaaaaagtgggaagaagcaggcggtgaatttcttcatatcgttgatttggatggtgcaaaatcaggtgatatgccaaattttgaactcataagaactatagtatctgaacttaatataccggttgaagttggcggaggaatccgcagtatggaatgtgtggataagtatttaaacgctgggattgcgagagttatcttgggaacttcagctcttaaaaatcccgattttgtcaaattggctgttgaaaaatacgaggataaaattgctgtcggaatagatgctaaaaacggtatggtagcaatcagcggttgggaagatgtcagcaatacgcctgctgttgagtttgcaaagttaatggaaagtatcggagttagatatataatttatactgatatagcaactgatggtatgttaaatggtcctaatatagaggctatggcagaaatgcttgaaaatgttaatgtaaacataatagcttccggaggtgtaactactttaaatgatgtgaaaaaacttgctgctttaggcgtagaaggcgctataataggcaaagcgctatatgccggaaatattgatttaaaagaagctattttgaaaggaagatgttaataatggaatttataaaggatttgaagttcgatgaaaaaggtttgatacctgccgttgcacaagatgcggtaagcggtgagatattgatgcttgcatacatgaacgaagagagtattaaacagacaattgaaacaggacatgctgtgtattttagcagaagccgtcaagagctgtgggaaaaaggcgctactagcggcaatattcagaatgtggttgatatgtatgttgattgtgatcgagacgctatagtattaaaggttaatcaaaccggcaatgcttgtcatactaacaatcactcttgttttttccgtaaggttgcgaatggaaagcttatagaaattcctaccggactagcagcgagacctggaattttatatgatgtttataacgtaattgttgaccgtgtgaaaaatccaaaagaaggttcatatacaaattacctatttgaaaagggcatagacaaaatgctgaaaaaagtaggagaagaagctgcagaagttatcatagcttcaaaaaattatgtaaaatcagaggttcaatatgaaacagcagatttactttatcatctgtctgttgttttggttgagcagggtttaacttgggatgatatatttattgagctgcaaaaaagatataaataatattcaaaatttattcaggaggtaataaaaatggttggaattgagcacgtgggaatattttcaaatgacactgccgcacttaaggattggtatattgacatgttcggctggaaggttgtttatgacaatggcaaaggaacatttttcttaaaagcagatgacggtggcatgattgaattttgtaagactgacattgacggcggaaaacaggatatgaaagcaaccggtatcagacatattgcaatttctgtctccgattttgacggaatggtaaaaaaacttatggatgccggcgttaaggttctgacagaagctgctgttaatccgaaaggaattggaacaatgttttttgaggatcctgacggaaatgttcttcatttgattaacagaccttctccgctataaaccatacctaagttgtttggcacaaattaggtttacaagataaaagcttgtaaacctatttgtgttttgtttataatatgtaagattttacagccaaatgatataagttaatttcagataattttattaaattaatttatattatttggtttaaaatataagaagaggaagtaaccattttgtttagtgaaatttcaaataccggcgaattaaaaaaaatgaatattgaacagcttcaaaaattggcttcaagtataaggtcttttttgattgaaaaagtctcaaaaacaggaggacatttatcttcaaaccttggagttgtcgaacttactattgctcttcacaaagtgtttgaccttgaccaaaatgatgatattatatgggatgtaggtcatcaaagctatacccataagattttaacaggcagggcaaataagtttgatatgctaagaaaatatgacggtataagcggatttcctaaaacatctgaggataaaagggatacctttaatactggtcatagctctacttcaatatcagctgcaagcggaatagctaaagctaaagagttaaaagggatttcaggaaaaacaattgcagtaattggcgacggagccatgacaggcggaatggcatttgaagcattaaattattccggtcatacaaccaaaaacttaataattattttaaacgataatgatatgtctatatcaaaaaatgtaggtggaatttcaaaagcattaaagcgtttaagaaatgcaaatagataccttaaatttaagcaagatgttaaattagcactagataatatacctgttgtaggaacaccaactaaaaaggggttaacaaaatttaaaagcgacttaaaaaaaatagtaataaatggggacagcgtatttgaaagtatgggatttacatacatgggtcctgtagacggacataactttgaagagttatttactattctggaacattctaaaacagttgaagaaccagtgtttatacatgttcatacaaagaaaggaaagggatatttacctgctgaaaaccaaccagagctgttccatggcgttggttgttttgaaccatctaccggcagaattatatgcaacaatgacagaattacatggtcagaatgctttggaaataccatgtgtaaattagctgaaaaaaataaagatttggttgcaataacagccgcaatgccattcagcacaggattggttgaattttctcagaagtatcctcaaagattttttgatgttggaatagcagagcagcatgcggtcacattttccgccggttttacaagagcaggaatagttcctgtttttgctgtttattccacttttcttcaaagagcttatgaccaaattcttcatgatgtttcacttcagaatcttcatatgatttttgcaattgaccgttcaggtccggtaggcgctgacggtgaaacacaccaaggagtatatgatatatcatatctttcaccaatgccaaatatgactattttttctcctgctttagcagaagactttgaagctatactaaatatatctgtaaatgatttaaatggacctgttgctataagatatcccagaggttctatcttataccgttcagacttctctaatgtttcttttccaaaattggaatatagaaactgttttaaggctaaggtgttagagacctataatactgttgatgtattaatagtttctgttggtgtgatgttgaaaaacgctatagaaacaaaaaaactattaaatgatatgggattttcagtttctttggttgacgcattttgtatcaaaccgattgatatttcaactataagaagagaaagcaacaaagctaaaattgttgtaacaattgaaaataatgtaataatcggtgggtttggagaaattcttcagtctcagctcgaccgctcaattgttaaatttgcttacaaagacgagccaatccctcagggaagtgtaaaagaacttgaggaaaagtatggtttatcaccgcagtctatagcggataaaataaaaaaattactaaggtgatatattgttatgggaaaacagagacttgataattttttagtagaaaacggatacattgaaactcgcagcaaagcacagtctttaattatggccggaagtgtttatgtcaataaccaaaaagcatcaaaagccggtgaacaaataaaaggtgatgaaactatagaagttagagataatggtattaagtatgtaagccgcggaggtctcaaattagagaaagcattaaaggtttttccaattgatttatccggcaaaatatgtatggatattggcgcttctaccggtgggtttacagattgtatgctgaaaaatggagccgttcgcgtctattcgatagatgtcggatatggacaattggcgtggaaattgcgtactgacgacagagttattaacatggaaagaacaaactttagatatgtaactcatgatgaaattagtgacgatattgattttttttcagttgatgtttcttttatttcattgaagcttatatttcctccagcttttaaacttttaaaagaaagcggttatggcgtgtgtctgataaagccacagtttgaagcaggaagagacagagttgggaaaaaaggtgtcgttagagatatcaacgttcataaagaggtaatagaagaagtaattagtttcactaaagagattggatttaaagttttaggtttggattattcgcctataaaaggtcctgagggcaatattgaatacttaatgtttataggaaaaaccggtgataatgcggatataaatattaatgagatagttgaaaattcacacagcttaaataatctggaataaattttggtgatatatatgaaaaagatttctattgttccaaatacacttaaagatgagaattatttggaaacaaaaaacttaataaagtatctgtctttatatgaatgtaagattttttttgaagacattcataagtctgatctgtacgatttttgtaaaaatatcggtataaattattcttttgttccacgtaatattctgttttctgaggcaaattttttaattgcgcttggaggagatgggacaataatagaaattgctgttgacgctgcaaaatatgagattcctattgttgggataaatgtcggcactttgggttttttaacccaaacggataaaggtgattattctgccataaaagatgtaatagacaataattacgggttaactgagtgtatgatgctggatataagtatcatttctaaagataatcaggaaatctgtaattttctagcgcttaacgacttgatagttacaggagattcatataaaatgataaccacatctacttctgtagatggaaccaatatggggcgttactctgctgacggtcttatagtgtccaccgcaataggttcaaccgcatattctctctcagcaggaggtgctgttatgcatccggaagttgatgcaatgattattactcctatctgccctcatacattaaaggcaagaagcactgttatacctggaaacagcacagttgaaataacacagattccgccttttagaacagaagcagttgctcgcgctgacggaaaaataatatacaagtttaaagattcatccgaaaaaataagaattaaaaaatcaaagtatacgacattattggttaaacaagagcatacaaacttttttgatgtgcttagaaataaattatctgattaaaagatgattataaaaatatcgactgaggtgagtggatgttaaccgaacttcaaataaaaaacgttgcaattattgataatattacaattaatttcggagccggttttaatgttttaactggagaaaccggagcaggaaaatcaatattaattgattcaataaatatggccttaggcggaagaacagcaaaagatttggttagaaacggaacagaatacgcattttctcaagcagtttttgaagtaaatgaaacagttgaaaagaaacttacagaatatgatatagagcttgaagataatactttgattttatcaagaaaaattaccgcagacggcaaaagcagctgcaggattaatggcagaacagcgcctctttcaatagttcgtgagattggaaatatgcttttaaacatacacggccagctggataatcaggcgctgcttgtttcctcaaaacatcgtgagtttgtagataattttgccggaaataaagatatattggctgaatatttaaataaatatcttgaatattcaaaagttcttaaaaaatttgaagaactacagcagtccgaaactgataaagaacatagaatagaattgttaaaatttcaggttaacgaaataaaatctgcttctttaagaccaggagaagaagaggagctaataaaacggcgcgagtttttgatgaatgttgaaaatataatgtctaatgccattgaggcacataacgcattgtacggagatgaaatgacaaaatcagcatacgatatgctttatgatgcaaatcaaagtcttgaaaaagctgctgagtatgatgagaagttaagcagttattacgatacaatctcttcagttcttgctgatattgacgatgtaacaagagaattaaaatcttatatcgacggaatagattatgaacctgaagaaattgatattgttcagaatagacttgcattaatatcagacttaaaacgtaaatataactgcttggatattgactctgttttagagtactgcaataaatgtgaagaggaaatagccgaaattgaaaatttagaaaatacaattgaagcaataaaagatgacgtaaaaaaatctaaagacgctttaaccgcagcagcaaaaaaattaactgaaacaagaataaaagccggggaatttttagctgaatccataatgagagaacttgctgaacttgacatgaataaagtagtctttaaagtaaagataactgaatctgattttacaataagcggatgtgatgacatagagtttttgatttccacaaatcccggtgaaaatctcaaaccgcttagcaaaatagcttccggcggtgaaatgtcaagaataatgctggcaataaaatcaattttatctaaaggcgatattgtggacactctaatttttgatgagatagataccggcgtaagcggacgggccgcacagaaaatctcggaaaaaatatgtaaaatttcaagaacaaagcaggtgctttgtataactcatttggctcaaattgcttctatgggtgatttccactatctaattcataaagacagtgatgaaacaaaaacgagaacattcgttaatttattattaactgaagaaagaaaagatgaattatcgagaattattggaggggtatctgtaacggatactactttaaaagctgccgaagaaatgcttcagcaggcagaaaatcttaaagattcttttatataaaatatatttacaactgagtaattattatctatttgacaatatgattgaaatttattataatgatacaataaaattaaatatataatcattgggtaatgacaatattattataaacgaatttaaaccgaggatattatttatatggaacaaacaggatatgtagttgaaataaaaaatggcgttgcaaaaattagaattgaccgtgaatctgcctgcggaggaaaatgtgtcagctgtaaaggatgcccttcaaatgctattattgtagaagctaaaaatgaactcaatctcaataaaggcgacatagtaacgctatatgaagatacaagaaaagttatgaaatatgcttttattggctatggtcttttagcgattttgttagttgttggagccattgtcgggtatgttttaactaagcgtgacattatggcactagtgtctgctgcattatttgttgcagtcggttttttgattattaaattttcgtttaggaatatagacagtgaatttaccataaagtcagttgaaagacaaaatattgatgaataactgggagacagaatgaaaaatgatgctgtgttttataatttaaataaagatgatgtaaaacgcataaccgtgattaccgggcattttggaagcggtaaaacggaatttgcactcaattatgctttggcgcttaaagaattaggacttgatgttataattattgattttgacattgtaaacccatattttagaacaaaagatgcagaacaatttttattaaatcaaaaaatagatgtaatttctcctgaatttgcaaatttgaatatagaaaacccatatttacctcctgaaattttgcgcgcttttgatgataaatcaaagtatattgtttttgacgttggcggcgatgaagatggagccacccctttaggagtttataacgaacattttctaaaagaagaatatgatatgttttttgttttaaacgaaagacgtcttcttacgcagagtgtagatgatgctttacaaatatataatgaaattaaatatgtttctagactggattttaccggtatagtaaataatacccatttaatgcagtacactaataaagagattcttttagagggtcagaagttagcggagaaattttctgttaaaacaaatattccgattaagtttataaccgcaactcctaaaatacttgcagaaatatccgagtattctgatataaatacttataattgttttccgctaagactttttgttggtcctggattttaatataaactataaaattatggggtcattcccttaatatattgtatgataatctgtatagaaagaaggaagaaatatgccaaaagttagttttagacaagacaggtgcaaaggctgcggactttgtgtgtctgtctgtcctaaaaaaattattgctattgattctgctgttttgaatgataaaggatatcatccggcaggagttattgatatggataaatgtattggttgtgcgttttgtgcaacaatgtgtcctgattgcgtaatatcaattgaaaaataaggagatagataaaatggctaacaaggttttaatgaaaggtaacgaggcattggcggaagctgcaatgcgctgtggctgtagatttttctttggctacccaataactccccaaaccgaacttgccgcttatatggcaaaaaaaatggagaaaaacggcggaacatttttacaggcggagagtgaagttgcggctataaatatggtttatggtgcagcaggcgcaggcgcaagggttatgacgtcatcatcaagcccgggtatcagcttgaagcaggaaggaatttcatacatagccggagctgatctgccatgcttaatagtaaatatagttcgcggcggtcccggtctcggcggaatacagcctgctcaatctgattattttcaggcaaccaaaggcggaggtcatggagactatcatctattagtatacgcaccgtcttcagtccaagagcttgctgatttaacatcaaccgcttttgataaagctgataaatatagaatgccggcaatgataatgggagacggaatgctcggtcagatgatggaacctgtagagtttaaggagtatattgaccctgaaagtcttcctgaaaaaacgtgggcaactaccggaacaggtatgaaacgtaaaaagaatatagttaattctttatatcttacgccggaagagcttgaaaatctttgtatcgaaagagaaaaaagatataatacaataagagaaacagaatctttatatgaagagataaatacagaagatgcagatttaattattgttgcatatggaacgattgctagaattgcaatgtctgctgtcgaagaagctagaaacaatggtttaaaagttggtttaatccgacctattacattatggccgtttccggcaaaagtttttgaaaaacgtgcggaaacagctaaatcattcctttgcgttgaaatgagcatgggtcagatgatagaagatgttaagctttctgttaatggaaagaaacctgtttatttctatggaagaaccggcggaatggttcctcagcaggacgctattcttgaagaaataaaaaaatgtcttgatgcaaatgcataacataggagatgaaaataaaatggaaaaaatatttgatagaccacactcactcagtgatgtagtgctctcatattgccctggctgcacgcatggagttattaacaggctaattgcagaagtggttgatgaaatgggacttgaaggtaagaccattggcgtatgtccggttggctgcagcgtaacggcttataacttttttgaattcgatatgcaggaagcatcgcatggcagagcgcctgctgtagcaaccggtattaaaagagtacatcctgaaaatcttgtatttacatatcaaggggatggcgatttggcggctataggtactgccgaaactatacattctgctgccagagccgaaaatatcacaattatttttgtaaataatacaatttatgggatgacgggcggtcagatggcgccaacctctttagtgaatcaggttacgcaaactacgccgttcggcagaaaagtagaaaatcagggatatccgatacaagtcagtgaaatggtgtcaacattaagaggcgcctgttacgttgaaagagtatctgtagataatgttcccaatataaagaaaacaaagtccgctatcagaaaagcatttgaatgtcagatggcgggattaggattttcactggtagaagttctttcaacttgtcctacaaactggggtatgtcaccggttgaagcgcttgaaagaatacgcactgaaatgatgcctgaatttcctttgggtgtttataaagactgcactaagaccgggggtgttagataatgtatgaacaaattgttatagccggatttggtggtcagggtgttttgtttgttgggaaaactttggcttacttaggaatggatacaggaaagaatatctcttggctgccatcttatggacctgaaatgcgcggcggaacatgcaattgcagcgttataatttcagataatcaaattggctcgccaattatccagtcaccggatacacttattgctatgaataagccgtcacttgagaaatttgttgatactgtaaaacctggtggtataatagtattagacagctctttgatagacttaaaagttgagcgctctgatgttaaagttgtatacataccggctatggaaattgctgaaagtttcggaaatagccagcttggaaatatggttatgaccggagcttatataaaagctagagaaacaatgttttcagcagatgacttatatgacagcgtaaaaactcatattccccctcaaaagatgaatttggctgaaaaaaatattgaaatgataaaggcaggatacgaatacgataaatgttaatttcaatttcaaatcttagtaaaagttttggagaaaatcaaatattaaaagatattaatttgaccatagaggataattgccgctatggtcttattggcgtaaacggagccggaaaatcaactttgctcagtataattatgggagagctagattacgatgacggtgatatatataaatctccaaatttgacaatcggatatttgaagcagaatagcggtcttgacagaaactccacaataatatcggaaatgcgcaatgctttttctgacattattaaaatcgaggatgaactaaggcttatcgaggaaaaaatgctttcatattcagaacataattcatcggaatataaaagtttaatgtctgaatattcaaaaaaacagtcttattttgagagtatggacggttataatattgacgtcaagataaaaacggttttaaatggactgggattctcagatagaagcctagagacagaaataaatgttttatccggaggggaaaagacccgacttgcattagcggctctcttattggaagaacccaatttgttaatattggatgagcctacaaatcatttggattttaaaacccttgactggctggaaaattatttgattaactcctacaaaggttcgcttttgattgtgagccatgacagatattttcttgataacacagtagagaatatgttggagatagagcgtggtaagatgtattcttataacggaaactattcaaaatatttggttcttaaagaagaaagaaatgaggttttgagaaaagagtatgaggcgcagcagcttcaaatttctcaaatgcagacatatatagataagaatataaccagagcttctacgtcaggaagcgccaaatcaagagtaaaagcacttgagagaatggaattaattgaaaagccggatgatgatattaagcctattaaattaaagtttgaaactatcaaagaaccctataaagatgttttaacagttgaaaatctagacattgctgttggagatagagagtccgccggcggtattaaaaatatttgttcaggtttaaacctcagtattaaacgcggagataaggttgctctgattggagataacggaattggcaagtcatcgtttctaaaagtaattcaggatataattccccaccaaaacggttctgtcgtttggggaaaaaacacaagcgtaagttactatgagcaggaaaatttaaatttaaatcccgataatctagctattaatgaattgtgggacagatttccacgcattccggaggctcaaatccgaagagttttaggaaatgttcgacttacaaaagaagacgtttataaacctgtaaaagtaatcagcggcggagaacgagcaaagctagcgttctgtataattatgctggaaaaatcaaacgtcatattatttgatgagcctacaaatcatctggatttaccctcaaaagagatattagaacaggctatgaacgagtatgacggcactttattgtttgtatcgcacgacagatatttactcaataaagtgccaaacaaaataattgaaatgaccaaagacggttttacaatttatgacggaaattttgggtattataagcaaagaaaagaatggattaaacagaaacaatctatagaaacaaataataaagttgaaacaaataattcatcacaaaaaagcagcggaggatataggtctaaggaacagagaaaagcggaaactaaacgaaaacttcaaatcgctgagcttgaaaagatgatttctaagactgaggaagaaatttcagcgcttgaaaatgaaatgacaaaggaagaagtattttcaaattatattttgatgaatgaaaaaaacagcgagcttgagaaattaaattcaaatttagaagagtattatgacaattggaccaaactgtccgaagaacaagaataaaattatttgttcttcggaccttgactttcaatttctgataaaggattttgggcaacagcctctctaatttgattattgtttacatgagtatatatctcggttgtgctcaattgtttatgacctaatatttcctgtaatattctaatatcaacacctgattgatgcattaatgtagcagcagtatgccgcaatttgtgcgtagtatatttatgagaatccattccaagctttttaacatatttttcaactatatgctgaacggttctccggctgattcttttgtttctttcagataaaaataatgcgtttttatcttttgattcaggtgacattttttggcgtatttttaaatatgacttgattgctgatatacatgaattattaagatatacagtgcgctctttatttcctttacctgtaacaactaattcgtccccacgtatatctgtaatattaattccaaccaattctgcaagccgcataccgcagtttaagaacaatgtcaaaatacaatagtctcgttcataatttcgttcatcaacagcatttaataaattaatactatcctgaagcgaaaaatattttggaagcgagttttcaaatttaacagaatccaaatcagctgtcggattatcatgaagcaacttaactttgctgcacaaatatttataatacgatctcaatgacgaaatttttctggcacgtgttctagcttgatttcctaagtctcgatttaaaaaatcagcatattcatacagcagatttaaatcgactttttttaaataatcaatattgattttatcaatgtcaatttgattaaagtcattatttgaatttacaagattaaagtgtaaacataaaaatctataaaatgttctaatatcataaaaatactcattaactgtttttcttgatttgccctgaatactttcaagataaatcaagaaagaatgcaatggttcaggcgcatatttaatattgtccataataatcacacatttccttttattattttcatcttccatcttttgtcacaaaatttttattttgtgaaatgttctatttttattatatacctctactgattttatttccagtatttttagattaaaattatattacaatttatcttttaattttataacttgttgctattcaatatctgttaggatataattataaaatatacaattataataattttaaagcaggtacacatatatgataaaaattgaaggaattattgatacagtgattttttataactctgataatggttatgcagtctgtgatgtatcatgtattggcgagcttgtcacaatgactggaactatgccaaatataactgagggtgaaaaaataattgcttcaggtgaatggacaactcacgttgactatggtgatcagttcaaagttgagtatattgaacgcgtaatgccatcttctgaaagtgaaattgaaaaatatttagcttccggaatcttaccatatgtaggaaaaatgactgccaaaaaaattgtcgaaaaatttggcacagacgcacttgacgttatagaaaatgaccacgaaaaactgcttgaaataaaagggctgacaaaaagcaaaatcgaggatatttataaagcatttgttgagcaaataggtatcagacaaattgttatgttttttcaaaaatataatgtttccccctcttctgctgttaaagtttttaaaattttcggcactggaactatacctttggttcaaaataatccgtatattttagcagaccaaattgatggaattacatttgataaagctgatgaaattgctatgtctttaggatttgaaacgaaatcgtatgttagaatagcttccgggattaagtcaattattaaacgtatttcttttttgaacggtcatacatatcttccacggcctacaatcattgcccaagctgtttctatgcttgaagttgaacagggacctgtagaagacgcaatttctcaattattacttagcggcgaattaatatctgaaaaccagggtgattatgacgcaatatatttaaaacttttttatgacgctgaacgtgaggttgccgaaaaactaataagaatgtccggcgtaacatttgatatagatataagtcaaattgatggtttaatagacaaagtagaaagcgaagatagaattgaacttagtgaaaatcaaagagaagctgtaagacgtgcctttcagactgcagctttggttatcacaggaggccctggaacaggtaaaaccacaataataaatacaattatcaacgcaatgaaaattgaacataacaaggttatgttagctgcaccgacaggaagagccgcaaaaagaatgagcgaagtctgtggatttgaagccaaaaccattcaccgccttttagagattacaccgggagttgacgaggttggcagctgttttgcaagaaactcagaaaatccgctggattgcgatgttttaataatagatgaaatgtcaatggtagatattatattaatgaaacatttgactgacgctttatcctccagaacaagattgattatggttggagacagtgaccagctgccttctgttggagctggaaatgtcttgaaagatataattgacagcgacagcattgagtgtataaaattaacagagatattcagacaagcaaaagaaagtatgatagttgttaatgctcaccgtgttaataatggtgaagaacctcttttgaatgataatgacaacgattttttctttgttcacagagatgacccaatgcagcttccgaatactatagctgatttatgcgtcaggcggttaccacgatattatggattagatggtataacgcagatacaagttttaacgccgaccagaaaatctttgataggagtacaaaatttaaatacaattctgcaaagctgtttaaacccaccatctcctgacaaaaaagaatatataacaagacgttgtattttcagagttggcgataaagttatgcaaataaaaaataattatcagcttgaatggaaaagagatgccgagaaaggtttaggagtttttaacggtgatgtaggatttataatagatattgacagcagagcacaaaaaatgactattcagtttgatgataaaatagtcgtttatgattttttattactagatgaaattgagcttgcctacgccataaccgttcacaaaagtcaaggaagtgaatttgatgcggtagtaatgccaatgtttgaaacacacagacttttgatgacaagaaatctattttatacggctataacaagagctaaatcacttgttgtattggtcggtcaagaaggcgttatggctcagtatgtgaataatgataatgttcaaagaagattttcaggtttaaaagataaactaaaaatattttaattttcaaaaaaataggagatatatagatggaacaatacgcagcgccactaagagaattaatagaagaatttaataaactcccggggattggaaataaaacagctcagcgtctagctttctatgttatgaacctccctgaagaaaaatcagctaaactagctaacgcaattattaatgccaaaaagaacattagatactgttcagtttgtcaaaatctatctgaatctgaggtatgcaatatatgttcaaatactgcaagggaccacagtataatttgtgtaatggaaagcccacgagacattatgcaaatggaaagaacaaatgaatataaaggcgtttatcatgttctgcatggcgctatttcacccatggataatataacgcctgacgatattaaaataaaggaacttgttgcaagggttgcagagggcggtattaaagaagtaataatggcaaccaatccaaatttggagggtgaagctacttctatgtatatatctaaactattaaaaccttttggggttaaggtgacaaaaattgctcatggagttcccgtaggcggagaattagaatttgcggatgaagtaacgcttggaaaagcattaaactggcgtgttgaaatatagttgaggtgaaaagttttggagaataaatataatataaagctagctcaaacagataaagagattgaacaaattgcaaagtgcgctgaaattacttggcattacgcttatgataatttgctgcctgacggtcaagtagattatatgatagagaagttccaaagttttgatgtattaaaaaaggatatcaaaaataatgattatgtatattatattattcaagaagatgatgcagtaattgctttttgcggaataagaccggaaaatgataagttgtttataagcaaaatttatgttgatcccaaatatcagcgtaagggtcttgcgacgaaactgtttaacaaagttttaatagaatatagagataaatataaactattttatttaacagtaaataaaaacaatactaaagcgatatctgcatataaaaattttggttttattataactgacagtactaaaactgatattggaaataattatgtaatggacgattatattatgacttataataattaaattacttatattattttaaaatttatattaaaaaagcgaagataaatctctttaaaacagagaatcttcgcttttttatttattaacatccagcaattgatttatacttttttatccaacactgtttaaattaaaagataactttttttaaaatgccaaatgtagggttcttttttctaacacattaatatattattttattggcacagttggtgcatttgtgtttactgtctgtatttcttgagttagtgcagcttggttgccgtttggcagaagctgactttcatttcccattggttgagtaagcataaagcaaaataccagcgatttagctgctttagctcgggttacctctatctttggttcaataattttaccatttgaaacagagcctctagcaattccgctctcagttctgataagacctagattatacgcctttttgagtttttgataaaggtcagtattaatcgctgccttatcatctagtacgccccaaccggtaagcggtatatacggagtaccttcatacttgatatttggatcataattggggtcatcaggtgatggaacactgccattttgcgctatatacatatcaataattgatttgtccgctttttgatatgcatcatagagaattgctcccatcacttcacgggtaagagctgcgtcactagcaactatagtgtcttccaccagaggtggttccgctgtgaattcagctgttacatttgaatctttggttgcagtaaaggtggcctcttttgaaattccaataacctctccatctactaagattgatttattaatataatactcgtttggcaacgcaacaactttgattttgtcattagcctttgcaactagtgaagttgtgctatgcggatagtcatttgactcatattgaataccaaacaatcttcctgtgccgccatttgtataaacttgatatgtctttccagctttgacatcaaaagtcacagcgttatatttattatcttttgttgtgccggcaatagtagtattatttatatactttgtagatgttgtaccgtctgttttattttcacatgtaattattttatggtcaacaaacataagataaagtgtgagtacaccgtcttcctttgccacatactcaggctgttttgttccgttattacgaatttcaatagccgatgttgtaatatttttgtttaatgcaaacacaccaccattatctaccttcttaactatctccgacggagccttaaatgtatagtattcattatctcccagtacagagtttgctgttaccttacttgtaatatcagtagttgctgtgtgaaattcactctcattatagaccgttacagtaccgcccgccgccggttgtgttacattgattgtaacctcaccttcagcaagttctgtactattatctgatgaaaccgaaactgccgttgttgacacttctgcgttctttgtttgcagttcagcatatgttttattgtaattagtaagtgaattttcttctagaccaaatgctttttcggctccccttgcaaattcgccaaccgtaatcgtttgagttggtttaaaattgttattgctgtccttatggagcaaaccaacttcaagagctttttcaatatttggcctataataataattgtttttgctctgtttaaccgcaccgggaattatgccaactgtactcacatctgacgccatttcgggaaatacagcagaccaattgcctgattttgctgcttcctggacattttcaggcatgtaacttaccaatttttgcattatctctttgtctttataaatgtcatcagcggaattagcctggtcatatatgctttggagcataattctgcaccactgctttgctatagcttcacgataatgtgtaccgtctcctcttgttccattagctgcattgattgcaggagtttcgcctgcctcatatgtgttatagatatagaatatctcatttgcatctaaactatcaatatacgcttttgcaccactgtaaagctcaaccaaaccgatttctgaatccgaagcggccttttcacgcatattacctggagaatcaggatcaaatccattaggttttttagagctttccgaatatcttccgctgccggttctcggcattgctgtaacaagtacaggcgtcataccgcgttcttttatagctgtcatatacatatccagccacttattatagtttgcattattggctgcaagatcgccttcttttacagaagaaccacgttcgtatctatctgtgcttacagtctcgtcattgtgtgctgaatgtataaatacaaaatcgccgactttacctctgataagaatttcgtcaaatctgccttcatcatagttactcttcatagcacggccgcccattgagtaattaacaacattaaccttgtttaaatcaaaataatttttaagtgtttgtccccacgaacttatagtttcgttgaaactgtaagccttttgagtagagtcacctaagatatgaattgtcggcttatcacctgtcgcattattttcaagcggcgtcactttaatttttttaataccaacagtcttcggagatgattctgatggcagtttggaaggttctacatcgatttcaataaaattttcccctgtaccaaaatcataagaccatgtgtttccattccattgagcacttactgttctcggaacctgaccgcagttatcccaattacttgtacttgtcagacgtgaggcctgcatacctgtaggagcaacccaagtatccgctgatgtgcctgttacctcaacttctatatgatatgcacccggcttcccggtgtcaattctgtaaataagaccgccgtaattataatctttatcaccaccataatgcaaatatgagcctgttgtttctgtaactgtagctccattatctgatgaaatcttaatattatctgtcgctcccacctgtctcatataagattccggcattatggtatgtgatttatcaacaaacccctgaccattatctttattatacaccgggacttcacttaattttgtgaaatctattgttacttcactaacaggttcagaactatccactgtttttatattgctgagtggtataatattgttagttccatcccaaataaataatttagttttcccgctttcaggtttatagtaatccaatacttcttctcctacggttcctatatcaaattttgcacaatcagttataattttttcactgctatcctcataagttacaacgaacaatactgcattgcttaattcaccatttgaagtataactaatatatagtttaccggcatcattgaaataagcctcactaataacaaaaacatttgagttttcagtttgttctgctaatactgttacgcctgcaaaaactgtaaaaacaaaagtaatcattatgacaaaactcagccatctcttttttaacattttgcttcctccttttcccgtaagggttatatatttgttcaaattatagcacattcacatataaaatcaatagccaaacgtcttatagtttttaataccagtttacaattattccgtagaaagtacagtttatttgtacaaaagagatgtataaaaaatatttttttaaatagtttttaacaaaaaacagctttttactataaatgcaaaaagctgttctaaaatatattatttaatatgtgaagaaattattttataccaaatcttaattttacaaaatcacaaattatctttgcagtgtcatcaataccaagagcggaactgtcaaccgatatgtggtaatttgtaacatttccccactcttgatttgtataaaagttataataattactcctctttttatcggtctttttcattgtttcaagagcttctttttctttttgtttatagatgcgcataacgcgttctaatttaaactcttcattagcatgaataaaaatgtttacaacattatcttgatttctcaaaacatagtctgaacatcttcctactataacgcaggaattatccttaaccaaatcctgaataacctgagactgaattctaaaaatagcgtcagaattcaaaacatcgccatatctataaaatgaatttctatcggattgaagacccataactaaagaatataataaactattagttggcttttcatctataccttcaaaaagattttctgaaagcccgctttcttttgctgcaatagcaataagacccttatcataaaattctattccaagcatatctgctacttttttagcaacttttctgccgcctgaaccaaattgccggcctactgtaataacataatttttacctgcttctactttattcatatcatttcccatattatttcctcctaatacagatgattttaacatatttttttatttaatgcaaattataattgaaaatttattgtataaaataaaactaaaacttttgtacatatttaccaaataaagttttagaattcccaaattattatatctttaattcttcagatgttttcttgacattattcttaaagtatattataataacttagttgtataaatttataaatatacaattccttactcctatatttataggggtcaaagtccagaaggaggtgacaaatatggcagaacatatcaacaagtatgagactattatggttttagactcttctaaaacagaagaagaaatctctgcattgcttgaaaagttcaagtcattgattgaaaaacacggcgaaatcgaaagtgtcgatgagtggggaaagcgtaagcttgcttatccaatcaatttcatgaatgaaggttattatgtattggttaactttaaatcaaaccctgatttcccgaaagaacttgaacgtgtttatggtatcacagacggcgttttaagaaacatcgttgttagacgtgaggaggactaattatgattaataaagtaatcttaatgggaagactcactcgtgatcccgaagttagacacaccagtacgggaaaagctgtttgtagtttttctatagctattgataatggatatggtgaaaacagacagacagatttcatcaactgcgttgcgtggcaaaatcaagctgagtttctcggcagatatttcacaaaaggtatgatggtgattgttgcgggccgaatttcgactcgtacttgggaaggtcaagacggaaaaaagaattatgttactgaagttatagcaaatgaagtgaactttggtgaatctaaaaagtccagagaagaaaacagcggttattcaggaggatataataatgctccgcagcagcaagcatattcttcttatggtgcagagcagcagtcaaataattatactgctccagctcaacaaatgcccggcggacttgaagaagatgaatttactccgttatctgaaattgatgacgaccttccgttctaaaatttaaagttaaggagagtttaagatggctgaagaaagaagaaacgacagaccccgcggcagacgtcctaagagaaaagtttgctcattctgcgttgataaagttgattacatcgactataaagatgttgcaaagctcagaagatatgtaacagaacgtgccaagatacttccaagaagaatcagcggctgctgtgcaaaacatcaaagacagctgacagttgctattaaaagagcaagacagattgccttgatgccttatacatctgactaataaaatatttcggctcaggttctgcctgagccattttttataaaattatttaaaactattgtgtttttaataaaaataatgtaaaatattatttatataaataatattaatttttactaaggagaactgattatgaaagtacttgtaattggcggcggaggcagagaacatgcaattatttggaaacttgcccaaagcaaaaatgtatcaaaaatatactgcgctcccggaaatggcggaattgcggatttagcagagtgcgttcctatagatgtcatggattttgagaaattaactaaatttgctagagaaaataatattgatttaactgtcgtggctcctgacgatcctcttgcagcaggcgcagtcgatgcttttgaagcaaatggtttaagagcttttgggcctaataaagctgctgcactcattgagggaagcaaatcattttctaaagatttaatgaaaaaatataatattcccactgcagattatgaagtgtttgaaaacagtacagacgcaataaattatattaaagcaaataacaaattcccagtcgtagtaaaagctgacggtcttgctttgggaaaaggagttataatagctaaaacatttgaggaagccgaaaatgcagttcatgacatattagatgataaaatttttggtactgctggtgctaaagtggtaatagaagagtttttaaccggacctgaaatttctgttttagcatttaccgatggtaaaactatgaagccaatggtttctgctcaagatcataaacgtgcttatgacaatgatgagggacctaataccggcggtatgggtacgttttctccaagccgagtttataccgatgaagttgcagaagaatgtatggaaaaaatattcattccaaccatgaatgcaatgaatgcagaaaatagaacttttaaaggagttttatattttgggctcatgaaaactgcagatggcgttaaagtaatagaatataactgtcgtttcggtgaccctgaaacacaggtagttcttccacggttaaaatcagacttatgcgaaatatttaatgctgtaatagaccagaggcttgatgaaatagatattgaatggaacgatgatgcctgtgtatgtgttgttatggcttcaggcggctatcctaaaaactatgaaaaaggatataaaatcgatggtataaaacaagcggagagtttgggagcacttgtattccatgccggaacaaaacgctccgataatgatattttaacaaatggaggccgagttttaggagttacagctctaggagataatcttgaagacgcaattcaaaaagcatacaaatatgttgatttagtaaactttaagaatgcccactttagaaaagatattggaataaaaaaagaaatctagttaaaaaacttactatcatatttttctgcagtcagtttccataaacaggagactgacttttttatatttaataactaaatctgatatgtatcaacttacagcaaaatataatttgatttttttatacatcttcttctattactatttattctttctatgtttatatatttacataaaatttatgtcttgtgaaataataacaatagattataagaaagctaggtggtattatggatcaagaaaaacttcctgttaaaaatgaccgaggttactatgaaatacgactagagagcattggcggactgggagctaatctttgcggaaaaatgttgggagagctgggcgttacatgccttaagctgaacgctgccagtttttcaagttatggttcagaaaaaagaggttcaccggttaaagcccatattcgatggagcgagccggatgttgagattcagcttaacagcccgatagagtcaccgcatatattggggctttttcacgaggcgatgacaggtaaagttcccgtaacagccggattaactgaaaaatcaaaggtcgttataaatacttcacgctctccagaagatatacaaaaagctttaaatctttgcggcggagagatattttgtatagacgcacaaaagatagcaatggaaagtaaaactagaataaatatggttatgcttggggcaatatgtaaagcgtcaaactttgttcctttagacgctgctataaaaataactgaagaaactatcggtaaaaaatatccggatttaatcgaaaaaaatattgatggtgtacgacgcggatataatgagacgatttctaagttttttgagcgtaataataaaatagaaccactaaaatataaagaagcagaaaatcgctggggatatgaaaatgcaccaatcggaggtatcaataccaggataggcagcaccgtatcaaatgatctgtcagcctccagagaaggttatattcctttatttgttcaagaaaaatgtataaactgcggcttatgtgacactacatgcccggatatggtgtttcagtttatgcctggcacctacaaagaaaaaccggctatggttaatatgggcttagattatcaccattgcaaaggatgtctaagatgcgttgatgtttgtcctacaaacgctttagttgccggacttgaacgtgaacatccgaataaaaaatggtttgtcagaaataaagatttgattgtagataaattggaatatgaagatgcaggcgcaaacagctggattaccagcgaagcttatttgaatgaaaaaagagtggatggaggtattgtatgagtaaacaaaaacttttatttgaaagcggtaatgaattagccgcatatgcagcaaaacagattaattaccatgtaatgggatattatccgatcacaccatccacacaaatagcggaatatttggatttaatgaaagctaatggtgaacatgatatatctcttattcctgccgagggagagcacagtgctgcaggaatatgctacggagcgtcaaccggcggcggaagagtttttaacgcaaccagcgcaaatggacttttatatgccttagaacaattacctgtgcaatccggaacacgtttcccgatggttatgaatgtcgcttgcagaactgtatccggtcctctttcaattaaaggagaccacagtgatattatgtacactcttaacaccggatggataatactttttgcaagcactcctcaagccgtttatgattttaatatttgtgctttaaaaattgctgaaacggtaaaattgccggtcatagtagcttttgacggattttttacaagccaccaaaaacgacgttgttatgtatttgaagaagataagaccgttcaagattttataggtaaatataatgcagaatattcggcacttgatttagaacaacctgtttctatcggctcctatatgaatgaacctgacattttaaataataaatatcagcttcatatggctatggaagatgctagaaaagtaatacctgaagttttttcagaattttcaaaattatctgaaagagaatatcaattcactgaaagttataaaaccgatgacgcggaagttattttattcttattgggttcaagctatcatacagcaaaaatggctgtggatatattacgtgaacaaggaaaatcagtaggagtatttacatcaaatgttctaagaccatttccagcaaaacagcttgctcagaaatgcaagaatgcaaaaacaattattgttggagacagacaagacagttatggagctaacggcggaaatatgacgctggaaataaaagcaatgcttcaagacgcaaagttagatacacgtgttatatcaagaatatatggtcttggaggacgagacttttatgttgaagacgctatagaatttttagaagccggattagattcacattctaaatcatttgactataagggaatatatccgggcgatatgagtacgcctaatactcaatactttaatcctataaccgacgaagaatccagccccggtctaacaacatgcaaatggaacgatgataagcagaatatggaggtatcaggcggcagaataaatgaaactacaaaaatgccaaaaagacttgctcccggtcatggagcgtgtccaggctgcggaataccggtgaatgtcaatttacttctgagaggtatcgaaggaaacgttgtactgctgttccatacgggctgcggcatggttgttacaaccgcatatccaaagacttcttttaagattccatatgttcataatcttttccaaaacggagctgcaactttatcgggtcttgttgaaatgtttcatcagagacaaaagcgcggcgagtatccgaaaggagaaattacgttcataatggtaagcggtgacggcggcatggatattggaatgggaagtgcaatcgggactgcgttaagaaataatcatattattctatttgaatatgataacggcggatatatgaataccggttatcaattgtcatattcaactccaaaaggcgcaaaaagttcaacttctcatgtaggtgaatatcagtacggcaagtcattttttaataaagatatgcctcagataatgtctgctacaggtattccatatatagctactgtggcagaatcaaatccagcggatttcataaaaaaagctagtaaggcaaaagcgtattcacaggaaagcggaatgtcttatttacgtgctctttctgcctgtcctttgaattggtctgataagccaaacctagaaagaaaggtaattggagctggcgtggactgctgctattttcctctatatgaaatagaaaatggaataactaatataaattataatccagaagataaaaacaagaaaataaatgtacttgaatggctgagtatgatgggcagaacaaaacatcttaaagataaaaaatataaatatatagtagatgaaattcagggggaaattgaccgaagatgggaaagattaaaagctcaggattcaaatccgcttttgtaagaataaaaataaaatcatgtatattttaacagcaattacaaataatagatatataaaataactggaggtgagaagatgagtccaaaagaattactttatattgaagacgctcttggccatgaacaatttttgaaaacgcaatgccaggatactgccaacaatcttcaagacggcgaattaaagaactatgtttcacagcttgtaatgaagcatgatgaactgttcaaacaattctataatttagtgtaacatagcgctattattgatgaactcgttaacagagaaaggatgaaaataatatggatgataagaaccttatggaaagtttgctgatgtcaacaaaaggagtatgcgacctttatatgcatggttcaattgaatcgggaacaactaatgtaaataactcatttaataaagcattaaatgacacattatgtatgcaggatgaaatatataagaaaatgacagcaaaaggttggtacccaaccgaacaggctgaccaacagaagataagccaggttaagcaaaaatttgctgcacaagcgtaaaaatatataaataatataaaatgcactttcattgatacgatagtttaaatacatcgacaataaaggtgcattttattattcaaaacaaaaacgccgtataaatacggcgtttggcaccctctacgtgagtcgaacacgtgactagcccttaggaggggcttgttatatccacttaactaagagggcagattaaataatcaactgtttaattatatacaaagtgacctttattgtcaagtgaaaaatataaaaatttcatgctttactgtaggattacaatagatgtgttacaaatagaaaaaaagaatacggaaaactcataaattgtgttatagttatatcaccataatatcacatacaagcaattgacgcaccaaattggttggcagtaacattagcaaaatcatgttttcctgctctgaagtcgctattatatatattaccgttcgaaaaagcggacgtttcattctccgaaaggctcataacctgtgatatgttattaaaggctccgtacagctctgatacatttagcctcagattcagctctgtttcacagtttattacttcttcgttgcttccttcatatcctccgccgagtaacattacatatactgtgatacccttatttgcaagttcttctatcttttcttccaatgcggttttatctgttattttttggacgaataaagttatcactttgttcccatttatagatatactttcctcctcatttaacgcttcctcgcatcgtgcaagcatagtttccgcatctgttgttcccgaatattccttggacatcattagttccagtgaattctttgcgctttctgcgtcttttgcatatccatagtttgtatcgtccactaaaactatttctgttcctttatttgccgaatctatcagcccctcaactgaacttgcccatctttttgttgaaccctggtcaaacttctgcatatcagctgaattatcaattcctattgccaatgtcactgccgagcctgtctcttctatatccttgcttatgtcttcctgggtaagctcattttccattgccaatatcattatattttctgaatctgccgtctgcacgcttgcttccgcagtaccgcttgtttgaataagaattgattttctgtcaatgtaacccaaaccatctcctatacctacaataacttttatctgttttctcaatgcgtccggatcaactgtaaactgtacgcttctataatcgtcacagccatcaacaggcagaaatgttccttgtctcgcactccagaaaaagaatggcaccgctttttcagaacatctatactggtcgtctcgtatggtcagttgatatattcctttgctttcatctataactgtcattgacgctgctgttatttcgggatatacatccggggctgtttccggatacatctggtcatattccatacctatagaacgtatcggcacatcggttgacggttttattgatgcgtcttgcagcacagttaaatcaaatcttgccttctcgccgttatcgtattgtcctatttctgccgttagtgttacatctgtatcttttccgtatgcgtccgggcggtgtacttctcccgtgttgcttatgtatccctcgtggctgcttgtccatgttattttgcttcctttgggtccctccgccggcagtgatatattttcggttatattgtttcctatattatcactcatatattttctcagccagcgcatatcctctatctcgattgagctatacttctgtgcctcttctgaatataccggcatacagccgtctatattggaaccaaatgaatacatatatccatatcggctcagcgctatgctgtatccgtttccgcatactatttctgttatttcttttcctgccagacttgtaacaactgccggagactgctgtgttcctgtcttatttaatccgagctgatagttagagccatttccccatgcgtacactgttccgtcattttttattgcaaagctctgcaagttttcagcaaatactgattttatatcgctaagccccggtacttttgcaggtatatttctgctcactttatccccatgacccaactgacctgatgcgtttctgccccagctgtatacgttgcctttgttggttaaagctatacaataattaacgctggtttttatatcgacaaatttttcgtatggctcatcaaagcttacctgaagtttttgaggagtgtttgcagaactatccgttccgtttccaagctgtccgtctgtcccttcaccccaagtatatacttcatttccggcaattgcagcaacaaagctgtctccggctgatacttttgtaaagttatttttatccgttatttgaaccgggacttttgaatctgtgttattaccctgacataactgtcctaaagtattggctcccataccccaaagcgttccgtcgtttttcaggaaaatactgaaaccgtctcctgctgtgatctgctttacatctgatatatctgatattttagtcggtactttatatttaccggccatgccgcccataggcttattagtattacttccaaatccccatacattgccctctgtatcaagcaccaaattaaaattctttccgcgctcaattgcttttgggataacgccgtctcctaaaactatttcatgaggagcgttgtgtttaacttccttatctgttccgtctccatagtatcctgtgccccaagcaactacttttccttcgctgtttattcctattgtctgtgctcgctgtgagtctatatcaataaaatcatagatatattctgatttaagcggcttttggtatttttttgaagatttcaattcaaaactgctgtcgtccgtcaggcttccccagcgccataatgttttattcacatcaacacctatagaaaacttgtctccgactgcaacctcatttatatttttagtgttttcaacctttttgaacgatgcgttatttccgtcaaatacctgtcctgcctggtatacttccccctgcaaaacatatgcagtagagtttcctccggcaaaaacattttcaggatatattcctgttcgtattggggccgataaatacgtttcattttctcctaaatttctgcccagctggcaatatgtattatcaccaaaaacataaagctggttatcattgcatatcattgccgtatgattagctccggttgcaatctttttgatgttgtcataatcatttaagtaattaaagggattcggcatacttccgcccagctgacctttatcattctttccccaagcataaagtttgctactatcaagagaattatacctatatgactgatagcttccggcttctataatttctccactgtctactccgcgtggcaaatcataatattcaaccttactgtcatcatctatttgcttttctttgttagaaccccaggaatatattctataatttggaactgaactttcctgtctcaatgcagaagcgtgttctactcctgctgtaatatcagatatacctgttagaatttctacaggtatatttttattaacataagttccgtctcctagctgtgcgcttgaattatctccccatccatacaaaactccatcttccgtcagagcatatgatgttttggcacgggtttctgtttttgctattcttttatttccccacactgctttaacttctgtaaaatcctcagaatcaatatttgtgccgttgcctagctgtccgcagtcattttttccttttgccatcacttttccgtcttcaactttaagtatatgactgctgcctattgctatgttatggtctctatacatttccggtgagtttacatacgaattaaatactgaaaccttttttaaacgaaatgaatcattgtcattttcaggtataaatattgtgctcccgtatgatgttactgactgatagtcaaccaactccagtttatagttgtcatcatataaattaaactccatccatgaatcataatacggatcatacagacacggtctgtcctccacggtatatttatgtccttcatcgtcaccgccaaaccatgatgttccgccctgataatacaggcaactacctaagtttgtaaatattccgccgaatataccaatattatctgaattagagggtcttatttcgcctcttttccatgtttcatctatagtatcataaatatatacatcatttgaatgctgatcagcataccaatcatgtccggcagtaaaataaatcctgccgttagcggctgttgaaactcttccctttaaagagtgaacttctcctttctgcacaggaattgtccactggtcattttcaggtgaatatttatatagactaacctctccgctggagtcactcggatacattcctgctggatttcctgacacaatacctccgccgatgtaaatatttccgttcacagcatgagcgttaaaatatgagcctgtctgcggcatgtttgacttttgagaccatgtttttgtatttgtgttaaaagcctgaacctcgttgcctgccgcatttggaccagcccctccaattacatatattatatcacctattgctgcaactccggcatatgctctgtacgttggaatcaccggataaattgaccaactatcgtttgatatattatatgcaaatgtggcgtctgaatcaaaacaataaatgtatccattacactgagtaacaggaactcccgtgcctacgcttccgtcgacagaacggctgtaagaaatattaaatccaccgccatctgcatagtctaaattttccgaatattttttaactttctcgctgtaggcagtctcctcatcattttcatctgagagaagcattaactcactttcattttgtatcaaatatgtattatgttcatacgtctctttactattaccagggataacaaatactgtttctttgtatctatatccggcagcatacactttcaggatatgctttcccaccggtatactgtcaaaatgtgcaataccattcgaatcagaaacagcatgatcttcatcaactgatacatctgcattcgacacaattattccgtcttgtgtagtaaccataatttcaatctgacgtgaaaaattttcaactgtattattatccagcaacgcaggtgtaggaatagtttcctgcggtttggaactttcaggcgtttcaaccgactcctgagtaaatattaattctgtgggttccggggttgtatcaaccggttgctccgttgctttactctggaattccggcagcgttacattttcagaaacatcaacgtcgttattctcttccccctgagaatttactataccaaaattactcatacatattaacattgacattgccaatattagacttattaaccttcgcttcaatttttctccctcctaatttctcttttttcttttttgtttttttacttaattaaaatgcaaatttaatattttcatataaaacaaatttaaaaatattttcttcaaagtatgtattacttaaaacaattaatatattacaatattttcggatgataaaagtataattaaaattcatataatactgcaatctctaacacgaacttattttcattttttcacttcctttctttaaaattaattcaaatatcataaataaatttttttgaaatactaaatatattgtaatatactattttttatagttcaaagaaatatttaaaatgtctgaatgaaaatattaattgattaacaataattaaaccatttaactataaatagctaaaataatatgtgtaaagataaaattaataaatttaactttctatttatagtttatatttcactatattatatatattatattttagtaatttataataagtgttattatgaatatttatgtgttaatacaagtgtaaaataaaaataatttttaataaccgcatattttattggattatttttacaatattattatagtatatattaccaaattattgtaaaaatgtcaacacttttatgtatattttcttttgttttaatgaataagttatattttaataaataattataataattaagataataaataaattaaatctagctattatataataactagatttttaatagaaatttatgatattctattaattaatataatatattttaaaaataattttaagttctgcgttaattttactcaaatttataccatattctaaattcttattttattatcaatttatatcaattaacatattatattaattttaaagcgcctcatatctttttaattattttttataatgttctacaaatatctagttattaaatttatacctattgaataaaatatataaatattttttactatacaaatactaattgacatacaagttagagtgtgctaacctatatgtgaggaaatagcttgatcatgcttttgataaggagtgtttattaatgaaaacgcttaaagatgcagaatgcggcactactgtcaaagttgtcaaacttaatggcagcggcgcattaaaacgaagaataatggatatgggaataacgaaaggtactgctataagtgttcgtaaatttgcgcctttgggagacccaatggaattaagagtaagaggttatgaactgtctcttagaaaatgtgacgctgaacttatagagattgattaacatacatatttaaggagaaatctatgactgtaaaaatcgcacttgctggaaatccaaattgcggaaaaactactatatttaacgctttaacaggatcgaatcaatatgtcggaaattggcccggtgttaccgtagaaaaaaaagaaggtactttaaaatataacagcgatgttattattatggacttgcccggcatatattcattatctccatacacattagaagaagttatttctcgaaaatatttaattctagaacgtcctgacgtgattttgaatgtaatcgacgggacaaacatagaacgcaatctatatcttacaactcagctgcttgaacttggaatacctgttgtaattctcataaatatggcagatattttaaaaaaacaaggcgatgttttaaatcttcaaagattttcggacgccttaagcggctgtccggtttttgaggcatctgcgcttaaaaatgacggtatttctcaggctgtagataaagctatagagttagctcaaactgataaaaataagaaaattttaagaccacttctttttagcccaaaacttgaggagactcttgcatttatatctcataagcttagcagggaaatccctgatactcaaaaacgcttctttgctataaaaatttttgaaagagataaaaaaattaacgagttaataaattcaaattatattccaaacgttgaagatataattaaaaagaccgaaaagacttttaacgatgacagtgaaagtataattactaacgaacgatatgcttatattacctctattattaaaaattgttatataaggaagtctgataatgaacagacattatcagaaaaaattgatctagttctaacaaataggtttgcagctataccaatttttataatagtaatgtttgttatgtactttgtttcagttacaatagttggttcttatgtaaccgactggatgaatgatggaatatttggagagggatggagtttatttggaaactggataccgggtatcccggtaattgttgaaagtttcttaagctttattggaactgcggactggctcaatagtttgattattgacggaataattggcggtgttggtgctgtgcttggttttgtacctcaattaatggtgctttttatatttctagccttcttggaaggctgtggatatatgtctcgcgttgcttttattatggacgaagttttcagaaaatttggtctgtcaggaaaatcatttattcctattctaattggaacagggtgcggcgttccgggaattatggcttccagaactatagaaaacccggctgacagaaaaatgacaataataacaacaacttttatcccatgcggagcaaaacttcctgttatcgctttattttcaggagctttattcggtggagcctggtgggtggctccaagcgcatatttgcttggaatatcagcaattgttgtttctgggattatacttaagaaaacctcagcgtttagcggagacgatactccgtttgttatggaattgcctccataccacatgccaaccgcaacaaatgttttgagaagtatgtgggaccgctcatggtcatttataaaaaaagcaggaacagtgatattaatttcaacaataataatatggtttttgtcaaatctcggctttgaaaacggaaattttggatttgtaaatgacttttctaatggactgctgtcttacattggaagatggatatcatggatttttatacctcttgggtttggcagctggagagaaactgttgctacacttgcagggcttattgctaaagaaaatatagtaagcactcttgcagtcctgtttgacttttcgcaatccggttcaattgaaggttcctggggtatattgacttcagcgtttacaccattatcggcctattcatttttagcatttaatcttttatgtgctccatgctgtgcagcaatggcagcgatagcaagagaaatgaataataaaaaatggactgcatttgctattttatatcaaacgggatttgcgtatataatttctttatgtatctaccaacttggctcgtttatagcttatgggacatttaatatttacactttctttgctgtaatagcatttgcagctttattatatgctatttttagaaaaaacagatataagaagtcaaatgagtatttaaatgaatttaataaaaaacggaccgcataaaaaatgcaggtccgtttttaataattatatatttaaaattctttttgcgtttttataatatatattttctagttcaattttttcaagaccgatactgtctataaactctttttcttcttttacccggtgccatggattatcggttccaaataaaaccttatcacttccatgatttctaacaatacgtttaaattgttccttatccataaatccggccgtatatgaagtgtcaatcattattggcgttccaactatgtatttttctacggcatcccattctttccagccgcccatatgagctgcaataatcttatctccgcttatataatccaaaacatgattcaaacattccggcatgcagtgaacaggctttggcataccaatatcctgtccggcatgaaacacaacataaagaccaagttcatttgtcttttttaaaattctttttatttccggggaactcacaaaaaccccctgatattccggatgtaactttatacccaataatccggcctctttgatttcttctagaactttctcacaatcattttgtaatgggtgaacgcttccaaaagatatgattccgttatgtccatttatttccgctgcaaatttgtttattgatgttgattgggtaacggtggttgcaattggtaaaaccacagaatagtcaacattatcctctttcattgttttcagcagctcaccaaggctgccgtctgttctggagggaaagttttcaccctgaatttttacaatattattctcaagcgaatgaatcgctctcttagatatcttgtccggaaaaacatgcgtatgaaaatcaataatcactgtaaatcctcctaatattaattgtcatatccaaaaatttcattagcaatcttaacagttgctcttgcgtcttttccataataatcggcgccgacaaaattaacatactcctcatttaatacagctccgccgactactaccttagcgttgctacctgcttctcttaaggcagaaattgtatctttcatactttttaccgttgttgtcatcaatgcgctgagaccgaccagcttaatatcattctgaattacagcgtctacaacactttctataggaacgtctttacctaagtcaattacatcataaccataattttcgagcagcatttttacaatattttttccaatatcgtgaatatcacccttaactgtagccaaaacaattttgccttttttattttctccttctttttttgaactgtcacgtataatttcaaaaccacattttacagcctctgcagattggataagctgcggcagaaacgccgttcccttttcgtatctatctcccacaatatcaagtgccggaataaaataattgtcaattatttttatagggtctaaatctttgagcatttcttttgttgctatacctgtttcttcacgtcttccatcaatgatataagaagtaatatcttcatttgtacctttttccgcattcgtattatcactaatttttccggcactatctttgccggaaccggtttcagacacataatctgcatagtttgaaatataatctacagcgtcaacatcctgattgttcagcactttaaaccctcggactgttttcataatatcaaaactcattggattaactattgccgaatccagtcctgcgccaaaacctgcggccaaaaatacactgtttaaaattgggcgcgcaggaagcccgaatgacacgttgcttactccgagcacagttttaaccccaagtctctcttttaccagcttgatagcgtttattgtttctataactaacttctgttgggctgaagctgtaagtactaaacaatcaataataatatcttcttttggtattccgtatgtttccgctgtacgtactattttctcagcaattttatatcttccctctgccgtttcaggtattccggtttcatcaagacataaacctacaacaaccgcaccatattttttagctattggaaaaatggcgtccatactttcttgtttgccgttaacagaattaataataggcttaccattatattttcgtattccagcttcaacggcgtttttgtcactgctgtcaagctgaagaggcaggtttactgccgcctgtatctcactgacggcttttgcaagagtctccgcttcatttatctccggcaagccgcaattaacgtcaaggacatcagcgctgttatgcatttgcgagatagcttcactgactaaatacctaaaatcctgttgtcttaatttttccttcagttttttctttccggtcgggttaattctctctccaataactgtaacggcattatcaaaaataacagttttagttcctgacgacactgctgttacatgctcatattccggactgaaaaactcaacatcctcaaccaattttcttgtttccttaataaactccggggttgtgccgcagcatccgcctaaaacagaaacgcctttttctgcaatttttttcataaagttagaaaaatcctcagccgtaatattgtaaactgtcttatcattctcaatatgcggaagtcccgcattaggctgaaccataaccggtacccgtgagtattttatgagctcatctatagttggcaataattctttgggtcctagagaacagtttacgcctaaagcatctactcctaatccagaaagtgtgacagcaaccgacttagggtcacagccgacaaatgttcttccgtcttcctgaaatgtcattgtgacaaataccggcagttttgtgttttctcttgcagcaagaatgccggccttaacctccaacaaatcagacatcgtctcaaacaggactatatcagcaccggctttttcacctgcaactaattgccgtttaaacatttcatacgcatcatcaaaagataatgttcccatgggctccataagctgccctaaaggaccaatatcaagagctgaaaactttgcgccgctttttttagcaagctgcactcctgctgttattatctcttctaccgagtatccgcagtcagacagtttcaactcattagcttgaaaagtgtttgctgttattacatctgcacctgcttttacatattctttgtgtatttcaagcactgtttcaggtttctcaatattatatacttcaggaagacctccaggctcaagaccggatttttgaagcatggttcccatggctccgtcaaaaaataatctattatgctttatatactctgccacgctcacaagtagttcctccttttctgaacatacaattttctctcattgaacaaatatcgcattttgattttttctttttaaaacttatattttcagtaaatccaattattgcggtaaccgactttccgggtatcattaaagagctgttcgtcactgtcaatccaatttttctgttggcgtcaagaacatcgagtaaatttttctgaatgtcaattggtaaatctccataaccgggagaaaagcgcaaatttgttcctttccctaaaacttccgcctcagcttttattttcttttcaacttcatcgcaaaccttttcgataaattcagtggcgcagctatccattactaccgccttcagcatatcattcccttgtgcaatacgtatgctgttatcaacttctataccgagcgtcacagccataacggcacattttcggcattcgcgcaaatgctcatatatatcattgccttcaagtcttaaactggtaccaacaacatctatacaagaaactgcatcatgatatccgacttttatatcaaaaatcttatacacatatctataccgcgagattttttttatttcctctatacagttatcaatcatagtttcggtattagtatcaatttcctgacctctatgtcctaaatatcttagtatttcatttttatcaagctcaatattaaacattaaaccactctctcaaattatattatacatattcaagaagctgcttagctatctcaggtttgttcatagaatacagatgtataccacacgtattattttttaccaaatcgcttatttgtcttccggcatactctattccggcttttagaagatcgtcagggctggattcatatttatatagaattctaaccatttccgaaggcaaagacgcaccgcacataaatatcatattagaaatctgactcttagacatcattggcattataccgggagttattggaacggtaataccggctttttcagcagcttcaaaaaatctataaaagtatctgttatcaaaaaacagctgtgagacaaaaaaatctgcacccgcttcttcttttattttcatatgttctatacttttattaaaatcatcgcattcaatatgaccctcaggataagctcctgcagccacacatagttcactattcgacttaatttcttttattagttcaaaggcatgactataacttgctttttcaggttcaaaaccttcttttggaatatctcctctcagggctaaaatattttctatcccttcgtcctgtattaccttcacctcttcaagaacactatcaggtgtagaagaaatacaggtcatatgagccatagactcaatattaaattcattttttatctttgatgcaagctctatagttttatttctgtttgaacttcctcctgctccgcaggttacactaataaagttcggttcaagataagacaattcttttagcataattcccacattttcaaaagcctcttcctttttgggaggaaaaatttcaaaagatattataggtttgtcatttttatttttaaacagttgagaaatcttcatattctatctcctagtatcaaatatatttaaattttcatacgcagattaataacaaaaaccgcaaaattttaaaatattatatcataacaattgtttatatgcaaataaataaatttgtaaattatacaaaaataaattatatacactctatatacttgacaagaatggaaaagaaagttatatttaaacttgttgtttttcaatattttaaaatttatttagattggagatatgaaaatgagcgaaaattgcacacatgattgttcaagctgcggtgaaacttgctctgaaagagaacaggaacaaaatagttttaaggtagatttgggagcgcatagttctgtaaaaaaggtaataggtattgtcagcggaaaaggcggcgtaggtaaatctctcgtcacttcactcttagctgtaaacatgaagaaaaagggacacaatgttgcaattttggacgctgatataacaggaccgtcaataccaaaagcttttggtataaccaataaggccgttggcagcgactttggtattcttcctgaaaaatcaaagcttggtatcgacattatgtctataaatttgctgcttgaaaacgatactgaacctgtagtttggagaggtcctattattgccggaacagttaaacaattttggagtgaagtagtttgggaagatgaggattatatgtttgttgatatgccgccgggaaccggagacgtaccactgacagtttttcagtcactcccagttgacggtataattattgtcacttcaccgcaggagcttgtctcaatgattgttggcaaagcagtgaaaatggcagagttaatgaatattccgattattggacttgtcgaaaatatgagttatgtaacctgtcctgactgcggcaaaaaaataaacattttcggagaaagtcatatagatgaaatagcaaaaaaacacaacataaaagtattggataagctgccgattgatccaaacattgcgtccgcatgtgacaatggtataatagaatcaatatccgaaaatccaataccaaactctattgaagcaatagaaaatttgtaataaaattaaatgtaatgatatataaaaggtcataatgtggtatttcacattatgacctttttgttatcttatataatttgtttttatctttgcttcacgttcaggcggttctattccggcctcttttgctgcatttaaagatttcaaaatccatgccatatttcttccaagtattctcatagtctgaacgccttcttcgtctttcaaaacttcctcaggagtattcccatgaaccatgttccaataatttgaacaaacaataggcatatttgttatgccaaaatattttgaaatttgatcaagcgttgctgatgcgccccctcttctgcagcttgcaacaactgctccgggtttatatgccaagttagaaccgccagcatagaataatctgtctaaaaatgaagttattgcgcctgacgcagaagcataatgaacaggtgagcctataattattgcatcggcagttctacagctgagaatagctttatttaccacatcgtcatcgaactgacatagtccatttccatttttagcgcacatgccgcagccaatacaccctcttatagggagcataccaacctgaaaaatttctgtatcaatcccgtttttttcaagttcatctgctactattcttaaagcagtgtatgtacagcctttatgttttgggcttccgtttactaataatactttcataatttaacctcctcataatttaacttattattattttaatggtattataactatttgatataattatatatttttttacattttaagtcaagaaaaaagactctccaataaggagagtcataaaaatataaaaaggggtaatataaaaaggggttatgaaaaacaatagattcagcgtattaatcatcacctcttctattgataaattaaaatccgcctcgaccgccgccgaaccttcctccaaatgttcctagttttgaaatggtttcagaagctgttatacttccaacttcagctcctccaatgcaatttgaaggctgactatacagtccgtcaatactttcactatcagctgttccaccataagagatagtataagtatcatctgaatctaaatcaggtgagctgaaaatcaaagcctggtattcttttgacggcttaaatgtcattatattttcaccgcttgaatttttgatattaattatagtctctttttgtacagcttcagacaacgataccactaaaacattttgttttgaatcatcacttggtatttcaagcataccattgcttccgacagcaacaatataaccaccgtttatccacatggaaccgtctgtatcaagcggactgtctccgccgcacgttggaccgtccaggatgatcgttccgccattaacttccaaaaaaccattggagtcaattgcgtctgccattgcgtcaatatagatataacctccgtttatagtgatagaatgaccgttattatcaacgtccgtacgctgccctccaaaattagccggatcattaaaactagatatattttgtccattatcagtcggtctttcaccatttggagggagggaatcgggctgctgcattatttgttctgtattaccagggaaaaaatcaggcggcatattattttgctgattatcaatatttccattaacaattctctcagcaagacgttctaaaattatactcgaatccattacaccatgttccatactatcactgcctgttcctccgccatttaacccatcgtctgtggatattatatgaatgtttccgctgttgattgtcatttctgctttactttctattccttctgtggaatattctatatttatatcacctgcattaacattcaaatttccgtgagcgctcatacctttgccctcttcagaataaatatttaattcaccgccgtttatctcagtaatatcttccgaatgaatactatggtcaattgaatgtatatttatttttcctgagtttatataaatatcttctgctgcttttaatccttttgaacttttttcattggtagtaacgccttcctcctgagtttgctgtgtgtcttcaatatttccacttattgataattctccgttttcaaccattgatttaagcttttcagttacttcctcaacggtcatattatcaaagactgaagtatcaatgttatttaatatttgtgaaatatcgcctttttcatttacgttatttctgcgattttccggtaaagtgttagaatcaaatttcgctccgtcgtcctgctgatcatttctttcaaaatcttttggaaaaccggtattgtttttgcgtgaaccgattatttccccggtagtagttatatttatttcaccgccatcaactgtaacattccattcaaccgactggataccgtcaccgtctgaagtaatattcaaagttcctcctattatcttaacaccacatttggcatgtatcccgtcacctatttttgaatttattgttatattcccattttctatctttatatcatcatcaccggcaataccatgtttataattcgcattaattattaaggaaccattgccttttatctccaaatcatcatcactgaataagggagcgcttgcgtcttcataattatattgctcactatcagtaagcgtattatcagtttcgtctgttaaggttatatatcctttgtcggtattttcaaaatatattgccggaccgtcactatttgttatgtctacaccacttaatctaagcttaactttttcatcggtatttacgagaatcattccgtcttctgttttgccgctgacttcaaaatctccgccttcggttatatatacaattttatcatctgctctaactccgcttccgctcacttccatagaagtcatatcaattgttccaaaattttctttccatgaatcatcttcaatcttttctttttcggttatataaacagtatttgtattttcattccattctacctgagctcctaaaaattcagatattaatttcaccggaaccaatgttctgtcatttagtacgactggaactgtctcagtatttatcacctctccgtcttgattagtgatttgaccgcctattgtcatagagattgattttttcttctttttcacagttacagtctgagtttcttcgtcccattttacctttgcgcccatagcttcaaatatagttcttgccggtaccatagtaaaattatttataatctgaggttcgacatcaaaaactaataattctccttcataataaacatttatgttttcctcagccagcgacgttatcggaaaggacattaagaataatagtataaatacagagaatattgaacataatacttttttcattttattcctccttaaaaatatttccacttgactatacgaaaattataaattagttttcttaaataaaccttaaaactaaaaataaaattgtaaagtttatatgaacaaaatctctatataaaaactgaatagcaatttggctataagggtaaaataatccaggtgataaaattgatagatacaaatttaaaaaataatgagaataccgtaaaacagctgtttaactcagataagaatattgattttaactttcgcgaatttaaagttgagtttaaaaacgaaacggctgacgcttttttaatatactatgacggaatgtcaaatcaaacatttttaaaccgtgatattatgcggtctttgctcacatgcaaagcgtatgacacaagcgtaacaccaaaaaaagatattgtttttaaacaaatagtatcagtggcgcctctaagcattgccgaagattttgatttaatcggagaaaaaatctcctttggtgaatgcggtatctttatagacggctgcgactgctgttttatagccgatataaaaggctgggactcaagaggagttgattcgcctactcaagaagtcagccttgccggacctcaggaagcatttgctgaatcaataatgacaaatttagcacttgttagaaagatattaaaaaatcctaaattaaccgccactaatattccggtaggcaaaacaaataaaattccctgcgctttaatgtacattgaaggaataacaaacagcaagcttatcaaagaggtaactagaagattaaaagatatagataccgagtatatattttcttcaagtgatgttgaaatgctgatagaagacaccacttattttcctatgactagaaccttaaaaacagagagacccgacagagttgcctcaatgcttgtcgagggaaaggttgcaataatagttcagggcagcccatttgcattgatagttccaactacttcattagatttgatagaagccacagaagacaattatgtacgtgttcccgaggcaaatttgatgagattagtacgaatatttggcatgtctctgtcaattcttcttcctgcactgtttattgccgtaatgttataccaccaggcaattctccccactgacttactaatagctatttcagccagccgtgaaaaagttccatttccacttatagtagaattaatcttaatggaaatatcatttgaacttataaaagaggcatccgtcagagtaccaaacccaattggcagcactcttggtataatcggtggactgattttaggccaggctgcagttgaagcaagcatagtcagtccaatattaataataatagtatcaataggcggaattggagcattttcgacaccaaccttatcactttcaagatctctcagcgtattaaaatttgtatatatagcagcggcatatttgtttggaatagttggtctggtggctgctataatgataactttgtcaggattggcagcgactaaaacgtttgggtttccatttctatccgatttcggaattaacgttcgttcatctgaatcattgcttgtaaaaccaatatggaaaaaagaaagacgtccggctgaactcaaaacaaaagataatataaaacagccgcacataagcagaaagtggaaaaaataaaaggaaacagagtgatatctatgaataaaaaaaatatcaatttaggtatatggtgtttaacatttaactgtctgctgataaaaatatttataggattttcgaacattctgcttcacgagacaggttcttcatcatgtttggcattaatctttagttttgctgtatttacggcgattttgtttatagtttactttttcaaaagatattttatattgagccttaaaaacacttatttaagaaacactatatttgtgatattaattggttatttaatatcacataatatatattttatttaccagctgattaatacaataaacaacagcgcttatcccaatactcctctttggattgtcttgacattaattgctgttacagtgctgattgttggaatcagagacttttcgtctatcttaaaactgcatagtatatgcgttccgttaataataattggattgattataatttcaataagcagtataaaatatgatgatatatataatgctcttcctgtattaggaaatggaatcgcttccacgataagcagcggattcaaacatctgtttgcattttcagaaataatagttccaattgtatttttaacaataatgcctgaagaaaagtctaaaaatataaaccgttcaaaaattatattatactcagcaattattggcgctgggatttacagtatatttactataatatctctgctggcaatcccgaccgactctgtttttgtagcagaaaataatccattgttccatatatcaagattttcaggtataaaccggcttaacacccggcttgatgtgttaaatataattatttcaatcacatccggtatattatatttatcaacatcacttgcggtcataagaattcttatgaaaaaaattggtttaccaaaaaacagcttcatgaaaacaaccgcgtcaatattggtattgttaattggaatagttcctctttgcggctgttacgacaacagggatattgaagataccgcatatgcaatagctgttggcgtagataaagacgaaaatacaggttcattgatattctcatttcaatttacaaatccgctgacaaccggagaaaatacagacccgcaaaattcaggttcagaagaaagtgaaacagaaaataagtcagtaaacaatatttcaattgatgctgataatatatttgacggtttagagagcgttaaaagatttataggcaaaacgccatcactttcacatttaaaacttattgtcttttcaaaatcaataactaacagtgatgggtatttaaaaaatatctgtgaagattttattaacattaatgatgtgcgtccggaaactaaaatatgtatagcaagcacagataccgctaaagagtatctatatggagtcaacccatcactcgaagaaagtacggctagatattatgaattattattttcagattcttctacaaccgaaactttgcaaacaaatttaagaacatttttaataaaacttaccggtagttcaggagacgggtatcttccaattatttcaccggatggatttacgggggcaatcttgttttccggggaaatacccaaaatagaactaagtaatcatgaatgtcaaattataaacatacttttagggatagaaagagattctatattttttacttccgaatccaccaatcaagtctacaagataaaaagttcatcacctaatataaaaacaaatatagagaataaaaaaatcagtgctgaaattgaaaccaaaatatttgccaagaaaaatcaaaatggttctgaagataattatgaattgctctatgaagatttaatgaatgatagtaaaaatttaattgaaaaaatatatcaaaatcaatgtgatatattatcaatcggaaaatttgcaaaatctaaattcttatatgaatacgaatggaaaaatgtaatccaagaaaaagaaaatatcataaatataccgaccgttaatattaatttattatattgatatagttatatagtaaaataaaaaatttcaaaaaatgacacctgccttttgtaattgacaaatttagatatatgtggtattattatcatattgttaaggaggtagcaattatgaaacctactagtgtcattcgtgaattagatcactatggacgtctcgttattccgagcgaaatgagacgggtactaggtcaatcagacgatgaaaaaataagagttgaaatatatacattagacaataaaatatttattcaaagagttacgccttgctgtgctttctgtgatagagaagataatttagttgaatacaggggaaaaatgatttgcaaatattgtcttaatgatttaaccaaacaaatataaaatatgacctgcggattaatcacaggtcattattattttaagtataaacttgttaatcagcaaataaattttcatatgatggctttggagttgctgttgttttatcttcattgcttacaacaggtgacgagctattacttttttctattgttcttataccggtaatagcccttttaataggtatagaatatccactctcattatttaaagataccatagtagtaattttcacttttgttccaatagggttattattttctacaccaagctgttcagtccaaaaattttctacttcaggaatatcagtaataggaatcattttatatggctcgttttcatcttgtaaataatatttagaatccaattttgatattataccaacagttgaaataagagttttatcttgaatatcttttttatcatataagtcagctatcgaaactacattttctttagtttcatcataatcatctaaaatatatacgttcattgctctgtcggtcttaccttcatcatcattaacaaatttagcgtttacatcagctccaaaagcctctgaaattgctctagcaggcacaaatgtacgaaaatctctggttatatctccctggaaagccggagcgtccagttcaactgtttctttcaaagcttgctcttcaccgtcaattttataaatatcaagtcttggcaagccaataaccaaacgtaatgtagtatcatatctcacaatctgaatttttttatcagtattaaaccaatatacagtagctcctaaagcttctgcaatggctctaagcggtatcattgttctatcattttgaatgtacggacgttcagcctcactaaaatcaataggctgaccgttaatataaatgttttcaataggtgatgcagcgtagcttgatatagaaaaactgcaaattataccgatggttatcgataaacttataaacaaacaaatcagttttttcataataaccttccttaactatatatttaatacatgattttttcaaatctaaatttattttatattatactataaatcaaccgaatatgcaacagaaaataatgtcaaaccttttagagtaagtcgcagacagctttaaaaccatacattgatttggaaaattttatagcattaactattgctttagacgtcacatatgccgataaagttccaaccaaattaatgtcagcttttaaatcacccagcgataacgcatatatagtatctccgtcaagagtggtgtgaacagggcatatacttcgtgaataaccgtcctgagccatttgagcaacttttgtcatatgtgttttatcaaagttagcatttgttaaaacagcaccaattgttgtatttgtaattatttgattttcaaaatttgaatagaattcaaacattaactcttgacaatctttctcagatagttttgttttatccttattcagcacccctgcaactttctttcctgtttcaaaatcaaaaatatctccgaaagcatttacaactactatagcgccaaccataagaccgcctaattttgctgcatatataccaattccgcttttagtacaacgatccattcccaacactttgcctacagtggctccaacgccggctccataacagccttgctcaggcatatttatttcagcattttcacaagcttttactgccatatcaaaattaggcctttttttcattgaaccaactgtcaaatcaaaaatagatgattgacaaacaataggaactttagtaacaccaacatcaaatccaatacctttggattccaaataactcataaccccgccggacgcatcaaggccaaaagcactgccgccgctcagaaccacagcattaattttatccatagccatagtgggattcaaaagctgtgtttcacgtgaagccggcccccctcctcttacatctacgccggcaggggctccgtctacacacaaaataacagtacaaccggtgccgccttcaaagtcctctgaacttcctatctttacatttggaagttctgtaatgcttatttcctctataagattatctacgaacattttgctcacctattgcttattatcattatctctaatctcaacgcgccttatcttgccgcttattgtctttgggagttcatcaacaaattcaactattctaggatacttataaggagctgtatgtttctttacataattctgaacttctttttttctttcttcgctgccttcaacaccttttaccaaaactattgtagctttaaccacctggccacggatcggatccggtgcaggagtaatagcgcattccaatacataaggaagttccatgataacactttcaatttcaaaaggtcctatacgataacctgatgattttatgacatcatctgttcttccaacataccaaaagtaaccgtcctcgtcacgccaagccgtatctcccatatgatatacgccgtcatgccatgcttcacgcgttaattcctcagaattatagtatcctttaaataatccgcatggaatactgttcttagtattaatcacgatttcaccgacttcgccggctgcagcagatttaccgtttggcaaaacaatatcaacatcatacagcggactgggtttgcccatagaacctggttttggcgtcataccaacaaaattgccgactacaagagtagtttctgtttgaccaaatccctccataagctttataccggtatgtttataaaattgctgatatacttcgggattaagcgcttctcctgcaacagtagcatactcgagtgaagacaaatcatattttcccaagtcttcttttataaaaaatctaaacatcgtaggaggtgcgcagaaagaagtaatattatatttcttaaacagcggtaaaatatcctctgcctcaaatttatcaaaatcatatgtgaatactgcgccttcacacatccactgaccatagagttttccccacagcgcttttccccagccagtatctgatatagtaaaatgaataccgtcaggatttacattctgccaatattttgcagtaataaaatgccccaaaggatatttatggctatgcattgctatcttaggatatccggtagtgcctgacgtaaagaacatcagcatagtttcgtctccgcatgcagtttcatccagattctgaggacgagggaattcatcactgaagttttcaatttcattgtcaaagtcatgccagccttcacgcttgcctccaaccataatttttaagacatcaaaatcacaatttttttcgccaagctctgcctgatgtgccgtatcaccatctgaagtacaaactatagcctttacttcagccgccttaaacctataatcaaagtcgtgctcaacaagcaggtttgttgcgggtattacaacagcacctatcttatgtaatgcaagaatagaaaaccagaattgatagtggcgttttaaaacaagcattactttatcgccttttcctattccaagtgacttaaaataatttgcagtcttagcggaatactttttcatatcttcaaaagtaaacctgcgttcttctttctctctggacaaatgcagcatagccagcttatcaggagctttttcagcaagcctatcaacaatatcaaatgcaaaattaaaattatcttcattaataaaatctatagatttaacaataccgtttttgtccgtttcagttttaagatagtttttatatatcatatcatctgaatcttcacggataggaacaggcttttcaggagttatttcaacattttctatatagcttgtccctctgccgttgggagtcagcactattgcataaaatttacatgcgtcacaatcaacagcaatcataccgtgaggagtcttgctgtcgtaataaatactatctccgggattcaatatttcaatattatcacctatttgcactttaagcttaccgcttaaaacaatatctaactcttgtccctcatgctttgaaagctttatatccttatgctgttccgcttcagaaaatggtgcggttacaagaaatggttctgcaattctatttttaaaaagagacgccaaattattatattcaaattctttacgtcttactattttcataccttcaccggcacgagtaagctcatatcctgacaaagttgcgctttgtccttctaaaagatctgtaacatctacgcccaaaactctagcgcaaagacatataaatgaaaaactaaaatcactttcaccgttttcgatttgcttatatttttcgatgtcaactgaagtcttttcagcaacttcttccatcgttaatccatcaatttcacgtaaggtttttatacgttcagcaacctcttttattcttccgtccaaaacattgtccatactgataactccttaaaatacaaattttataaaaataatagataataatattatttagtaaaataatacaaactctataaatttaagtatagcattactaaaaatgtttgtcaacttacttatattttagctttttcgttctttgtaggattacaatagatgtgttacaaatagaaaaaaagaatacggaaaactcataaattgtgttatagttatatcaccataatatcacatacataaaaataaatataaaaattttataaaaatgtggtatagcaagcatcggtagggcgtgcgaagtacgccgcgtaaggcgcgcagtcgcggaaaatttgtatttagaaaagattatggacaactgttctaaatatgttcacgctacgcgtgagatgatagttcacctaacgaggcagacgtcgtctgccctaccgatgttcactataaacactgtatatacggaaataattgaaaatgaaacaataaagtgcatagaaaagttgaggtatataataaaccatttgagcagaacatatactgaacctctgttccgataaaatcatcacttattgcaaacgttcccgcctgctcattctgtctgcctttcgaaaaatcttcagctatatagctcagctgtttcacaaacttaaccgcatataaatccggcagccatgttgaactgtttgtaaatgttaaagatccttctgtcaaatcctgcggcagtgtaaatgttatgaaagaataaatattaatagcgcaattcatgcttatcaagatggagttttgtcctatgaggatatgttaaaaaatgttgtactcaatggtggaaccataaaggaagaaaagaaacttgatgctattactattgtccaatcgggaaaaattataatataaccataaatgcttacttatttggcgaaatgtctaataaaacttatgacggagtagtgtagatagtatattaaaatccggtgtaaataagtattggagtggaaatgtgaatggatataatatgactactaatttagttttttcagatcccaatatatatcaagtagttaaaatagaaataagaaagggactaattgatcaatctgataatcaaggaagttctgtttgtatatattgttcagaaaacggcaatgaattgatgttaacggacacaatacctttgtatgcggaaacgccaacgtatgttgacgcaatagaaaaagctatagctcatgaaataggacatagggtttttaatataggggatcactatagaaagaaaggaattcctgaatatgtacaattgcctagtaaagtaaaatcaattatgaacgaagctttccaaacgccaacacaagcacaacaaatggatttagaatatgtaatatattcaataaattttttaaatggtcggccatttcattatacaacgcatccatttatattggaaaagtattatcctaattggagaaatataagtagataagtaaaccttaaaaattagtttatttatagaaatggagaaaaactatgaagtatttaagaaaaattgttattttaatatgtgtttgttttttatttattggttacataaatgtaatggcaaaagaaaattataataaatataaaatagatgatagtaataatcaaatgtttatattgccggatgaattaaaggagtcggatattctagatattgagattataaatatggacgaatatggagttatgttggctattagaaaagaagataataagaactataatgtttttattgattataaaggaaatatatacaaaaatccaatattattcaaagacgatatagcggttatagagattgaaaataaattcggttatataaataaaaattatgaatggatagtgccgccgatatatgattatatggaatcttttaataatggatatgggatagcacaaagaaataatatgtattacataatagatgtaaatggtcaaattaaatatagttcccagaatacaatttatcaatttgataatggatacgcattaatgagttgggtggataatgatggtacaaggaattatgcaagcattgatctagatttaaatataaattatattagtgaaatgagtggttattatatttttatacgaaagtctaattcagaccgtcgtgtaattaatagaaacaataatgctattttgggatataatccaacaacaaatacctatactttgtttgatattagtggggaaataatttgtacaaaaactatagatcaaaaatatacttattatacatcaggggtgtgtttatataataggagtgcaataatatgtgcaaaagattcaaatctaaattgcataaattatctattaacggaggacggtaaggttgttgaaaatacaaacggaacagatattccgtttaatataaacggagcttttagttttggaaataaatatataataacatattataatgacatttatgacatgaatttgaaattgttaggtgaattatattttgatgaaaattttgatgatatcattacttatggttataaagatatatttacattcttaccgattagtttgactgaaaatacgaattcatggatgtataatatgagtgctgataagttatattttgtcattgatgaaaaaatacagaaaaaagttgatctagttgatttacaaaagataaaggaacctttgaaaaataatcaaattacagtatatataaacaataagcagttaaattttgatatatatcctataacagaaaaagacagaacattagtaccaatgagagcaatatttgaagcgctgggagcagaagtagagtgggaaaatgaaacccaaacggcaacagcaacaaaggagggaataacagtgtcagtgacaattgacagtaataggatgctaaaaaatggagaagaaatagagttggatgtacctgcaagattagtaggagacagcagaacattagtaccattaagagcaatatcggaagcatttggctgtcaggtggaatgggacgaagaattgcagagagtagacatttattcaaactaaaattgttgcggagggtgtattggttacgccctccggtaaaccaaaaaagttggacaagcatacgcataaataactgaaatggagtaaaaacaccggaaagtttttgaatatataaaattaattaactatttgaaataaaaatccattaaatacttctttttaaatggttaagaaatacatatagctccgttcaattttttatgcgtaagtaaattagacaaattatagaagataaaatattgttaagataacttattttgcctgatccgaatcaaataagtgaaaatattttgagaaaataacaatggtaggtgcaagagtatatcatgctacacttaaaaaaggagttataaaatgaataaaaatataagtaaaataatagtttttattttaataacaggcataatgtttcaaggttactcaataaaaacatatgcagaagagagaaaagaaataaatactgatgaactaacagaacaattaatattgtatgaaaattatgaaaatgatagttttacaagagaagattgcattgttaacataatgaaaattataggtttgaatgagaaaaaaattgataaaaatggaataataatgggaatagagaataactttttagattacaaagaaagagggctgcatatttatgattatgactatatagaatatgcgttgagaataggaatgatacaactagagacagatataaaaggaagaggatattatttaagaccatatgataaggctactattggcgaagttttgactttgtgtattcgttgtttagaaaaatctgaaaacaaatgtgaatgtaattactggaaatacatatttacagaacaagagttatggcaaaaatcaatggaatatggattaatagatggaattaatttaagtgataaatacactttttactctcctattaatgtagatgtatataaaaatattatatcaaatttactgaattgtgaaatgaatttacactttattgatagtgaatcctatcctgttgaagctaagtgcgataaagaaaacatcggaaaaacttataaagaatatataattaataatgggggattcgaagcgagaaaaaaagacttatacttatgtataaatggaaataagtatagcgaacctgtatttccttattatttagaaaatgacaaaattataataagttattttggtctaaaaaattgttttctttatgacatgagcaagaccgaatttagcaaaatagtagaaaaatatgatattgaaagatatgaaaaatattttggaaatgatatagataatacatatgtgtcagtaagagaattctgtgaagcaataggatataaagtagaatatgaagaaagcagtaatactataattttgacaaaataagtatattcaaattacatcttaacaaattgataaattgtaggcaagaagaacaagctgtatattaaatataaaactgtattatacagatatttaataattctttaaagtaaaatatttaattggtttatttataaattagttaaatcaatttttttgtgttgttaagctatggtaaatctagtattgtttaaattatttaaatgtttatattaaaatccgtaaaacaatttttcatattaagttgataaaaatgatataagtcagtaagacggatgaatatagcagtttaaagaagactgctatatgttgatatatttatgtatttcattaacagaaatagagctgttacttataagaataaaatatttcacttgtttaaataataaataaaaacgttacgaaaatttagatcgtaacgttttttatttaattatttaaacaatgatttatatgtaactaactctttgccgagacagaagattctatcattttataaagctgttcagagtctattggtttagctaaatgcccattcattccagcttcgcctgcttttaccatatcttcatgaaatgcgtctgctgtcattgcaataataggaattgttttagctttgggatgtccggattttcgaatagcttctgttgcttgatatccattcatataaggcatttgcacgtccataagaattatgtcataatcgtcaccgtttgttgtgaagcgttctacagcttcttttccgtcgcttacacagtcaattttcatacctgtcattttcaaaagttcaacagcaatttcacggttaagctcattatcttctgccagcaatacattgagaccatttaaaacgggatttggctgattatctttattgttttttattgctctttcaattcccgttacagtcagcagcgtattataaagtgtggaagcaaatataggttttgaaaggaatgcgttggctccggcttctcgagccttttgttcaatagaacttcaatcataagcagtaataataattatcgttgtattaggacctacaaattcacgaacacggcgtgtcacttcaataccatccatgtccggcattttccagtctataagacatacgtcgtattcttctccaaccttgtgtgctgacagaacctcatcaacacattctgctccggtcattacccacttcgatttgattccaagattctcaagaagcaatgtagtatggatacaacaatcacgatcatcatcagcgacaagaacttttaatgcttccagtactcgatgattgtatgaagacttttcttctttagattctgcagtatcaaagtctaattcgactttaaaagtgctgcctttctctaattcgctgttaaccgagatagtcccgtccataagcgtaactaaatttttgcagatagacattccgagacctgtgcctccaaattgattgcttgcggaagtgttttcctgctcaaaaggaaggaatatacgttttacaaattcttcactcatgcctataccggtgtcacttactgtaaaacgcagacgtatacgtccgtttttcttttgtatctgccgtatttccatgcggattgagccgccaggcggcgtaaattttattgcattggatagcaaattaatcagaatttggtttagtctaagcgagtctccaattaatattgtatcggttaggtctatcaaaggcattgaaaatgttatacccttttctgcagcctgcggatatatgattgatgtgattgattcagccacgctttccaggttaaaaatctcgtgggcgatagtcatttttccttcatcaatttttgacatatcaagaacgtcgttaataagtgtcatgagatgcttagatgagtatccgattttttccaaacagtcttctacgcgcttcctgtcttctatgtaggcgcccgcgatagtagtcattccaattatcgcattcattggtgtccgaatttcatggctcattctagaaagaaagttttgctttgcagcgttggcattctgagcgtttatcagggcgtcttttaaagcctgttctttaataattttttcagttcgatcagaaagagaaacaatatagcgaactattttgtcttgactgatttgagggaagctttgcgccaaaaaccagcgtacttgtccggatgggttcttcattctgaattcaacgcttttgcttgacgttgttccagttggcttaataaactccataaaatcagttttatcttcattgataatcagattcaacaaagaatctgtttctttaaatatagagcgttcttttatgccgagaacacgctgacagttattgctgacatactctaattctgcatgctctttgttatagattaaaaaaacttcatctacgttggaagaaagaatatcaaacaagtgttcgcggtattgaatctcgcgaatgttttttctttcacgccaaaaagcaaataaaaagtaagccggcaggaagatagtgagtaataaagaagaaaggatagctgtggttgctgtattagcggaatgtttttctaaacctttaattttttgatccgcaaacgcaatgatttttgtcagcgctgcgtctacagcgtcatatttaggatatatattttgctctacatataaagctgtttcttctttagtcattggtaaaataagaggcagtgaatcattttgagtgttttttaggtcattcattgcattaagcagttggatggtgtcttcactcggtccaagatattggttggtaataatttcaattgcattatattgcatattataacggccgtttaataattgctgaacattatctatctcccatgaaggttccgcgacaatatttaacagaaaacttttcatgtccagcaaacgtgaccgcattgcacgagactcatttgagacagtgtaagggtggttataaatcattgaagctgtttgatgaagctgataagtagaaaaaatgctgaatgtggatagaaatatagaaaatgcacaaattataaacattactacttttttgagtttgttttttcttttttgcttactcattaacatatactcctttgtccccccgagaatattttcgctattagatgatttaaggcaggttatttttcgatcataatttttaatagaaaaaacattaaatttggacatttaaaaattatatatacaagtgttcaaaatatctccctttttattttgattgtacatatggtaatattttattaattaaaaaaatacaacacaaaccaacttgttatataatttatatatatacaagtttctaaaacaattttaaatttttgtgcctaaataacaattttatgtatatgtaatagctgcaccatattttgttaacgtttattataacacgtattaaatataaaagcaagatattatttaattctgatttttgattaattttattgcagaggaaaataaaatagcggcaaaacagccctaatctgtacggactgtacaaattaaggctgtttacatggctgacgtttttttatgtagagtacgatattcttttggtgttatattgaaatttttcttgaatactctgttaaatgtgcgggagcttccgaaacccgacaattcaccgataacagtaagaggcagttgtgttgagcgaattaactttgcagcatgttcagatctaagcataccaatataaatgttaaagctagtgtttagtttatcagaaaatatatttgttattatatgaggatttacaccaaatttatgagatatatctttgagagtaatgtcgttattaaaacttgtttctatatattttaatattttgcacgttagattaagagaacccagtttatttgtttgaaccaaatctatactttctattaagtcggataacaatatcatactgcagcttaataatataatattatctgtctgtgctaagatttggtcaaatatcatctttgatttatcacctgctgtattttgggaaattttatagtttttttgtttcagtatatgtatatttggacaaacttgtttatatatctcgggttcatattttaaaattaaaatttttgattttatgttatcgcatgtagaataactatgaaggtattccggaaatattatagctgtatcacctgtattaagaatatattcattgtctttaattttaattttttgactaccctcaatgacttgacaaatttcaagctgttcatgaatatgtcctttagtatttatagagttatttaatttataaatgttaagaccgtttataagtttaaaatctgaattcatattttacaccccatattataaatacaatattttatattattttataatcagttttttacggtattctctgggagttattctgaaattattataaaatgttcggtcaaaggtgcgtacactgctaaaaccagacatggtactgatgttttcgagtgagtcgttggtacttcggattaattttgcagcaatattgcttcttattatgcctaggtaagttctgaaattaactccgatttgctcagaaaaaattttagaaacagtgaatttattaatatataattcttttgatagtgtgtcaagagttatattttcacggtagtgttcctcgatatatgatattattttatattcattgctgatttttatattattattattaattgggattggctcaagttgattaatgagtttttttactgctattgtacagtagaaaaactgacgaatttcagaaaaatcttctatcatgtatttgaaaatttgtgacatgaaatcatctatttgatttttatatattttgtattgattaaaggtgtagttatcgaaaaactctttaaattcttgtatacgctgtgatttaaaaatgatactaacaaattcggcgtttttattatatttgttgttttcctcagaatctattcgaaagcagctgtgcacatatccaggaggtatgagtacagcttctccggtatttagaatatatgtctgttcgtttataattaaatgttgtataccgctgaataagtatattatttcaactgaattatggatatgaggcagaaatttaacttcgcgtttgttatgaataatacgaatatcttttgtattgagttcataatatggctcgtttgacattataacaccgcctttaaatattctttattttaattttaacacacaagaaagattaaaacaagacaaaaacagagatgaataagacaaaaattgaatacaaatggttaaataaaaagttgacaatctttgtctgaaactgctccttttttgtcttgttaataaaatacggatatgttatattgactttagataaaccggttgaaatcatctaaaaattaatttttaaattgaaaggagaatttaagatgataagaagattgttttgtgttttagcagtaatgtgtatggtgatggcattagcggttacacctgtttgcgcagaatatcccagtaagctttcagcaagagaattgttgaaactatctttagattactgcagcagtatggatcaaagtaaatatataaatgaaacatgggatgtgtttaatgaagcgttagaaaacgcatggaagatatataataattccggagcttctgaagtggacatgactacagcaagaggaagtctggaaaaagagaaatcaagattaaaatttgtgcagtctgatgagcctgaagatccattaagttttcgtttattagataagaatgaagttgtgaatgaaatgggagtaggctggaatcttggaaacactatggatggaacgagcaacgattggagcgacggatatatgattccgtgcgaaacaggctggcaacccaatgtgactactaaagaaatgattaaatctattcatgatgctggttttaatacaattcgtattccgattacgtggggaacaatgattgatgatgaagatgggtattctataaacccggattggatttcaagagttcaggatatagttgactactgtattgatttggatatgtatgcaataataaatatacatcatgacggcgctgaacaatacggatggcttcgcgttgcggcagacgacatagatagtgtatatgaaaaatttgaaggaacgtggagaagtattgcttcatattttaaaaactatgatgagcatttaatctttgagtcaataaatgaactgacatgtatggaaggggatatgaaaaattccagtcaggctaaagcctatgatatacctataattgttaacttaaatcaaatctttgtaaatgtggttcgctcaaccggatcaaacaatctttatcgctatttgtcggttgcatcccattatgcaaatgggggaactgaggataatttcattatgcctgaggatacatataatattgataatagattgatgtttacaacccatatttataaaaacaatactgctgtatcttggaaatatgatgaagcttatgaagttattaatgttttgaaaaaaatatgtaaaaagttttctgattatccgattatattagctgaatatggaaatagatatcacgagtttcaaggtaatccttcgggggcaaatgatatacagcgaggatactatgatgaaatagtaacgaaaggaagcaaagtttgtggtgctgttccttgtgtgtgggacaatggaacaggaggagacttttctatatgggacagagtcaataataaaccgatatggaagaatattaccgatagtatgatgaggggacattatattgagccttccgagttgaatttaaatgatgtaaatctgacagatataattgaaaatcctcaaattaataaaataactgatataagcggactgcctgatagtttaacactggaatacggtgaggttaaaaatctaaattttaatactgagcctgcagaaacaaatgatgtattgttatggaagtcatcagatgatagtatagttactgtacatagaggaattatgcgtgcaagagctgtagggtctgcgacaattacggttttttctcagagcggaagctgtgaaaaaacatttgctgttactgtaaagccgtcaatttctgatgttcctgcaaatgaaatattgactgctaaagacaagtatgaaataggtgaaaatagagcggaatatataaatgcccaaatattaccatcagaatctgatgatgatttaatatatgtttcagatgatgattctattgttacagtaaataaatttggaaaaatggtaggtgttaaaataggtaaagcacaggtgacggttcaatctgcaagcggtcttaaaaagaaaatagatatagaggttgtagacgctgaaccatattaccaggagattgaggagacaataaaatctttaaagtttgaagatgatggaaaatctgatacaattccactgccaactgtggatgggtataagtttgaatggaagacaaataccaacgacaaatattcatatgtgaatgatggaggagccattactgttattaggccggcgtatggagaagcaagtgttgagtcaagtgtaaaggtaacagcctataatgaaattaccggatatagtttaacatcaactgtaaaatttaatatcagtccttatattaataccgatggttccggaagtgttaagtgtaatttttatcttgacaataaatataaagatgccgaaacttttgttataaagttctataaaaagggcgctttagtaaagagttcttctgtatctgttccttcaaatgttaatatatacagtgaatctataagtggtatcccgaacggagattatatagtaaaatttacgcctacgagtgatgttatgagagtaaaggagtcgtcacaagaagttagtattattccggataatgaaacgagtttaaatgtattagctgcacaaatggtgtatacaaatattaaagcgtgtgaaagcattagtccaactgataatattacagtaattgattttcttgaaaaaatgactgataaagaacgtcaggattttaaaaattcaaagacgataagattaaattacacggttgtagtatctccggaaaacattagtaatactgcatttatagatatactgggaggagatattcctgttgagtatcaggcaagttcggacagttcgagatatacacgtttgagaatatacaaaagatggaatcagcttgatatgattgatggaactttggctaactgcagcggttctaaggatatagaagggcaccaaaaattaaatattggcggaaagtttcaagatggaactatagaatatcaaatctcgcttctaattgattatgagaatcaaacaattacacaaggaacaaaatcgtctgttggttctagtgactttatttttacaggttttccggctgacgcagatagatcaaagcttaaccttattgcgtataataatttgggaacacaagaagtatatacgataaaagatgttactttatcgtttgagcaattggtttatccggaagttgatgattttaagtattcaatagttagtattaatagaaatgcaaataatgttgaggtatcagtagagggtgaaggagaggcaaaacttatcttagctttatacaatggttctgacattttgttaaagactgatatgaaagagattaacggaacaggaacttatgattttatggattatataaatagtgaagaaccaaatatatcactgaaagcatttttatggaaaaatactgatgagataataccaatatcaatgcctttatcatactaatatttatattattatagattgtaaagttgtataaaattagaattagtaaaatgattatttataattaaatttgacagaagctttttttataaagtttattaaataatttattagttttatggatgagaatcatattggattaaataataaaaaaccattgctttaagcaatggtttttttggcggagatggagagatttgaactctcgcgccgcgttaacgacctatacccttagcaggggcacctcttcagccaacttgagtacatctccgaattcgctgcagttagttttagctaaaccgctctgtattaaatttgaaaaaaacgacacagaagtttatcctgtgccatagcgcctttataaaaaggaatggcggagaggcagagattcgaactctgggtgctttcgcatcactagttttcaagactagctccttaaaccgctcggacacctctccgtattatacgacttttaggacaaacctatcacgtcgcgacttgataagtataccatatactagaaaggtttgtcaacactttttttaaaaattttttaatttttatatgactttttttctacataattacagcttcggttataaacactgccaggcttgataataaggcaacagttattaggctcttttgcatatatgatagcgctattgctgctgcaaagcctataacagcagaatatatgctagaggttgaatagagtatagccgggaatatcatggcgcctaaaactgcatatggcatataaaaaagaaaggataacagaaaacggtttttaatcttttttcttattattgttaatggtatcattcgtattaagtaagtaggaacggccataacagctatatatattaaaattttaaggttgtccatcgatgccatccttcccattagtttcatctgtatcaattggggcgaaataagcgcccagaccggcacatacaagtgcacagattattattacaaaaccattagataccatattaagaacaggaaaccacttaaagcacgagctgagaagcacagctcctaataatacatataaaacagccttattatcttttgccggaggaacaacaatggctataaacattccgtatatggcgataccaagcgcgcttctgattgattcaggcagaagcataccggcggctgctccaacaagtgttcctagagcccagcctatatatggtattgtcataagtccgtacatatatttgggtcccaattgagccggcttagttgtggatactgcaaaaatttcatcagttatgccaaaagctattcccatacggtttaatcctccgatgccgccgaatagcttttgagataccgagactgacataagagcgtatctcatattgattacaacctgcgtcattgcaacttcgagataagaagctccgccaagcataagggaaagcccggcaaattgtcctgcagaggtaagatttgtcattgaaataagaagcgccgcccacacaggaagtcctcccattgccgccattatcccgaacgtaaaggataccgacaggtatcctaaacctatcggtattccatctctcacaccttgagagtatctgttttctataaattcttttgtattggatttcataataacttgtttttgtttgtctcctgaattttattttccggtgcttccaaagccgccgtttcttacacctgtcgcatcatcgtcaacggtgatgccgtattgaacaaatataccctgtgcgaaagcgtccccctggtttagcgaaacagtttttcctgtatttgtgtcgtttgttatttttataaagatatgaccctcgttatcagaattatagtagtcgctgtcaattattccgacagtattatttagctgaagtctaaatttaaaaccaagcccgcttctggggtaaaggcataagacccagctgttgtctatttttgttcttattccggtaggtatcattattgtttcatttggctttagttcaaaatccaaagtcgaataaaaatcataaccggcacttcctgctgttgcgcgttttgggagttttatactttcataagtttttttaattttatctatatcagtactgccgaagcagttattccatccttcggtaaactgttctatactgactttttcaaattttgctatacctgtcataatcgtctcctttatgttgattttatgcttttgtatacaaaactatatcatcgcggctttgtttaacatctataactctttggttggtgcttccgcgccaatgtagttttggatccagtttgtctttcacaaattttccgtcaataagtatatctatgtatcttataaccgtcaagtcttttatgtcttcccaattgtatccggtgtagagccaaatagttttgtccggatatttttcttttatttcttttgccagcgtttcaaccccatttatattagattgatataatggatcaccgcctgtaaatgttataccggatatatgtggtttgtcaagttctgtaaaaatttctgacttttcatcttctccgaaaggcagtcctccgtcaggatcccaggttattgggttatgacagccttcgcatttgtgctcacagcctgctacccataacaccactctcagaccgtctccattcagcatgtcgtctttggttatattatgatatcgcatatcttacatacttctcctgtctttaatttcagccattttcgcatcgttaagccgggtgtctcccttaacgcgcgaatatgacaaatatccgttcatacggtcgattttagtgaggtttttgcttccgcacttaggacatacgtccatttcaagctcgctgtgaccgcagtcgtcgcagtatgccaacgagagattaactccttcataaaagcccatatccatagcccggtgaatcaatgtctctattgcttttttattatagtcaataggatattttacatattgaatttttccgccgttcataaggtcccaaaatcttttttccaaatcttgttttctgataggagaaatatcttctgaaacatgacagtgaaaactgttgctgacatattcccggtcggaaacgttttctattatgccatactttttcctgaattgttttacctgcagaccgcacaagttttcagcgggcgttccgtaaagtgcataaaggtttccgtcttcttctttaaactgagctacctttttattaatgtgttccatgacttctatagcaaactgtccgtcttcaaccaaagattttttattgtgaagctgctgcagttcatttagagcagttattccaaaagaggcggtagccgtctttaacagcggctttatcttgtcgtgaatacccaaatgtcctccgtaaaatccgccttcacaataagcgagaggattggtggaagcccgcatttctcctagatattcataagtgcgtatatgtaactttcttataagctccaaataatagtcaaggacctcatagaaatctttgttttctttttcggccttagcgtatatcattggaaggtttaagcttactgcgcctacgttaaatcttcctacatataccggtttatcattatcgtcagcgggattcataccgcctttttcgtaccacggtgacaagaatgcacggcatcccataggagatacgactttgttatatttcttgtatataccggcaacatatccgtcgcctgtaagagacagccaatcaggatacatagttttagcggagcattcaactccggccttgaacacgtcttcaagctctttgcccggtccgtgaagattctcatcataaagaaatacgattttagggaataatacaggtttcttgcattcctttttaccctgaccgttcttgtgaacttttaagagtgagatggttgccattttttcaaagcgttttgttccgagacctgcggtaaccgttataaacggataatcgccgcggctggaggcaacagtgttaaacttatattcccagccctgaaagccctgttcatagtctctctgcacatcttttatagtttcacgttcagctgtttcctcagacaaacccatttctaaatagcgggctttattttgggcatatgttttttcagcatacggagccaaaagtttgtctacttcaggaactgtaaaacctccgtattgctgacttgctgctgacaatacaatgtcgcctataacatcaaaagcaaccgctaaagttttgggttcgttataccaaaggttgcccatttcaaaaccgccgcttaaaacagttttaacatcaaacaggcaacagttcatagtgtctcgccttgcggacatatcgtgtacgtaaatatagccgtcgcggcaggcctggagttcctcaacagtcataaagaacttttgataaagttctttgttgagctggttaaaaatgagtgatcgtttagtggaaactaaagctgaatccgagtttgaattttctttgtctcctatgtacataattgcctgactcttttgatagacttcgtccagcatatgaacaaaatcctgtttgtagtttctgtagtctctgtaacttttggctaccacaggattgaccatatcaagcgcgccctcaactatgttgtgcatttcggcgatatggattttatccttttgcatattaagaaccctgctgtctacgaaggcacaaattttgtgtatgtcttcatcagtaaactcaactaaggcgcggttagctgatttttttactgcgacaactactttctttacgttgtaatcttcttctgttccgtctttcttaataattttaatcatacaaaacactcctaaattatactattgtgcggatttaagtccggtaaacctttttgtgcggaaaaactgtaacgtaaaattgttgtttaaatatatgtatttggcaatatatttaaatctctaatgctttattacttaaaactgaaatttcgggaatttttctcgaatcacaacattttgcgttaaatgtaaattcactaacacaacatatagtataataacatatgttgtaaaaaaatacaatggctttttttgtcttatttcatgacttttttgtaacatcaataaagcgttatataacggcacttctataaaaactattggctctttgtaacacaattttaattgaaactactaaaatattgtcaattaataaaatttcggtatgaaaaaatatggtaatattattttttgtaacgttactgtaaccggtcgttaaactacatgtaaaaaagattatagcatattcaggaaatcaagacaagaggaaaatataatatagataaaattcagatataaattaaaaataaaataattccaaacctaaataagaaataaatagtgtttggatttaattattaaggaactggaaacatttattaaattccttgattttcaggtttggataatgtataatgcttgatagaaaataaaggctgatggttatattttaaagcatatcctgtcggcaattttggagaacggcaaatgaaaaagtcaatttgttccataaaaaaagttattctaaaagcacttatgtttagtgttttatttttgtttccgcttaacggttcgttttgttatgcaatgattaacggcgcagggcggcagaatttgtacagccaaaacctgatgttaataacggtgatgtgctgcatcattttaatcttgttaatatgtttagtgtttctagtaaacaaacttcttaaaacgaaaaaaataattaataagaatatggaaaatgaaaagattttaaacggtcttgtaaatactgttgtgtataagattatgcctgacggaatagaaactttgtattacagcgacggagtgccaaagcttttggatatgaccaaagatgaatatgacaattgggtatcagacggagacttaattgaaaagtgtgtatataagggggatttgccccggtttatgagaatgtatgaaagagtgttaaataataaatatcctaatatgaatataaattttcgattaaatacgaaaaataatgttcatacttggatacacctcaatgcgtttagaatacgtgaggagaacggttatccggtatttgccgcacttttttcggagggttctgatgaagctaaaatgtatcggaaaataatcgatgattctccgaccggcgtttttgtagcatcggtaagtaatgatgaaatactctatgccaacagcgccatgtatagattaggactgtgtgacagcggtgagattttaggcagaaattgctatgaggttttctttggccgcagagaacgctgtgagttctgccggaaagaaaatttgagttataactctctgctggtatgcgaattgtttaacagggatatgacaaggcattactgcaacagtgccagactcatagattggaacggtattcctgcgtatattgaatacataagcgaggatacagaaagtttttttgcttataaaaagcgtaatgacctgattaataattttccgggcggcgccggaatatgcgagatggaagacggcaagttcagggtatcttttctcaatgaaggctattataaaatgctgggacggaatatggaagattctatgagtgttgagaaaaatcatagtctaaactatatttatcctgatgacaaaaagaaaattttaagtgaaatagcttctttaaatgaatgcggacagataggagaatgtacggttcgtgttgagacaagcgaaccgggcgttttaaaatggattaatatgcgcggaaccttgtctgaaaaagacggggataaaaaagtcttttacgtttctttttcagatgttgatgaatcaaagaaagccagtattaagcttaatgaagcatataagaatcttgaactcagtgaaaagatgctgaatgaggcaataagacattcagaaataaaattatgggagtatttcccggagacaggctgcgttgtttggacttctccgtttgaaaatgattttgacgcggagaatcttatggaaaattatcctgactcgtggattgaaatgaacattaccgcgcccgagagcgttgaggatttaaaacgtttttataatgaagctaaggctggaaaaaccgaaggatcctgtgagataaagaataaatttaaagacggttaccgctgggagaggctgaattttacatcaatcccgggcaaaggagaagagcggacaaaagttattgtcacagctatagatattaccaagcaaaaagaagctgaaaaaaggttcgaagaggagcttgcaagaaagagcgcccttgaggctgattctgtatccagtattacatataatgtttctaaggatactatagctgaggcggttaccaataacggtcaccgcaatataattaagcagaattgcagattaagcgacgcagtgtcaggtatgtatgaatttatggcgtcagataaggacatagaaatatgcaaaaaagagtttaatcaaacgactatgctcaataattattataatgattgcagaaaatatgaggttgtttattgcattacgccgccggatgggaaagatagaattaaatattattcagcggatatcagtatggctgaagaccccaggtctaaggagatttatgcttttgtttatactcatgatgtaaccgatgatatattaaaaaaggaagttattgagagtgcaattgaggaagaagtagactttatttcatacttaaatttgaaaactaatattgttaaaatgctgaattataaaaaagacgccgtagctcttccgggaactgaaccacgagattatacggaaagcaatatggtaaatatacccgctatgattccgccggaggaacaggaggaatgttttaaagccttcgacgttgaaaacataaaaaaagagcttataaacaaagatgagttttctataattcattcagtttacaataagaggaatcctaatgaaaagagacgtgtgaaacataggatttattatctgaatgagcggcgtgatataatagtttttgtacgcagcgatataactgatgtttttaatcaggaacaggaaaaaaaccggctgcttcaagacgcacttagacaggcaaagcaagctaatgctgccaagagcgactttttatcaaggatgagccatgagataagaactccgatgaatgctgttttaagtttggcaagtttaggcgctgaggattctaaagatcctgaaatgactgagtattttaagaagataaatgattccgggaaatatctattgggactgattaatgatattttagatatgtctaggattgaacgtcaaaaagttaagctgaatcccgaaatagcagagctggataagtttttttccactattatgtctattataaaaccattataccaagcaaagaatattgactttgtgtttgacaggtcagaatttaaaagaaaatatgcaaaaattgatgttatgcgtacacagcaaatattaataaatctcttaaacaacgctataaaattttctgataacggcgacaggatagaatttaccgcgttatctttgaatagaggcggtaaggaatataataagtttattatccgtgattacggcgtgggtatgagcaaagactttttgagccgtgtttttaatccgtttgaacaggaacaaaataaattttcttcgtctcaggaaggtaccggattaggactggcgatatcgaaaaatttggtcagcttaatgggcggaaccatagaagttgcaagcgttataaatcaaggaagcacttttactgtggagataccggtttcagagccgggagcggaagaaataagagaatttattgatttaaagagagattcaaagaatacttgtgatttaagcggcagaagagttttgcttgcggaggatcatccgataaatacagagataaccgttaagcttttggaaaaacgcggaatggttgttgagcatgcagaagatggagtgattgctgtagatatgtttaaaaaatccaaaccgggttattatgacgctgttttgatggatataaggatgccgaatatggatgggcttgaagctgctgaaaaaattcggagtctaaacagaagcgacgcaaaaacagtgcctataattgctatgacggcaaacgcgtttgatactgatatagagaactcaattaatgcagggatgaatgcgcatttatcaaagccgataaaacctgaggaggtttataagacgcttgaaattttagtaggacgggtgtaacgttttaatgattttgagaaatgaattacattaataattataatatttattggttgcagaaaatattttttggaggttagtatggagaattccgatgtatttgatcctgcctggaaagatgaggagtatgattcagaaaatggtctgagtcctcagcaggtaagggagagagtggggaagggagcggtgaatgaatctgtggattcatctaccagaacatatggggagattgttaaaagtaacgtatttacttattttaatctgatatttgttattttggctctattgcttcttattgtaggctctttcaaggatatgacgtttttgggcgttatattttttaatacagtgataggaatagcccaggaatttcgctctaaaaaggcgcttgacagtttgaaaataataagcgacccgaaagccaccgtaataagaggcggtgtgcaggaaacgatacctgtagaaaatcttgttcttgatgatttagtgatattttcggcagggtgtcagataccggctgacgcggtggtggtctcgggaaacgttcaggttaatgaatctcttatcactggagaatctgaggagatagcgaaaaaagccggagatgaactgctgtcgggcagttttgtggtttccggcgaatgcaggggcaggcttctgaaagtcggaaaagaatcttatgtttctaagttgacgctaaaggcgacaaaagataagcgtgaggaagaatctgagcttattcgctctttggataagcttgttaagattgtaggcattataattattccgataggtctgactttgtttattcagcagatgttttttgcgggggcgacattcagcgacagtataaccggaatggtagccgccgtgataggtatgatacctgagggattatatcttttggcaagtgtagcaatggttgtaagcattatgcgccttgcgagaaaaaaagttttggttcgaaatatgaagtgtattgaaactttggcgagagttgacgttttgtgtgtggacaagacagggactataaccgagaatactatgaaagtcagccgcttggtgccggcagagggaaaggacttagattgtattactgcgcttttaagcaatatggtttccgctatgagcagcgataatattactatggaagccatgaaggaattttttacaaagactacgaaagctgaacctgaaaaagtgttttcgttttcttctcagtataagtacagcggatgtattttgggcggtcagaactatgttttgggtgcgcctgagtttgtgctcagagagcaatttgacaattatgccgaggaggtatacgaatattctgaggaaggctatagagttttagcgtttgttaaatatcttggagaaatgacaggcaaagccttaacggataatgttgagcttttgggttttgttctgctttcgaatccgatacgttcaactgcaaaggagacttttcagtatttcgctgaacaaggagttgatgtaaaagttatatccggtgataatccggtcacagtgtccagagttgcggaggaggccggaattaaggaagcggataagtatgttgatgcgactagtcttacaactgaccaggacatatatgacgcctgtcttaaatataacgtatttggacgtgttgttcccgagcagaagagacagtttgtgaaagcgctcaaagctcagggaaaaacggttggaatgacaggagacggagtcaatgacgttttggcgctcaaggaggcgaattgcagtatagcaatggcatccggaagtgaagcggcttctcaggtgtctcagcttgttttggtggattcggatttttctaaaatgccgtcagttgttggagagggaaggcgtgttgtaaacaacatagagagaacagccagtttgtttttggttaaaaatatattttcattgctgctttcattgttttcaatgattgcggtgaatggttaccccatggaaccatcgcaggtttcgctggtggcaatgtttacgattggaatacctgcgtttttcttatcactggaaccaaacaagagcttgataaaaggtcggtttttaacgaatgtttttaccaaggctgctccggccggtataaccgactttttagtggtcagtgctttagttgtgttctgcagtatgtttaatatagatgaggaaagcgtttcaaccgcctgcacagtgcttatatccgttgttgggtttatgatactgtatcgtatatcaaaacctatgaattggcggcactggcttttgattatcgctatgatagcaggctggataggctgtgtaattttcttaagaccattgtttggtataacagcaatgagtgttcagtgcataatgttattggcagtgtttgcgctggttgccgacccggtgctgagatttttcagcttgattgttgataagtcgttttggcgctcaaagatagataaagttctgagcattgtgcacagaagataaaacctaagaaataagcaaaatcagattttgttattacccggctaatgctgatgcattagccgggatttgttttatatatcaatattattgtctctaggctgtgctttttaaagcatataaattaataatgtaaatatatatacaaactgctcgttttaagtgaaatgtcttcattaattatataattttattaataatattagcggataaaagttttattataattttacggttctgacggattatatccgtcagaattgttttgtttctatattaattattattgtgctggttttgatgtatttggcatacatttaacaggaggtgcaatataaaatgttcaaagcaaattataaaccaaattctgctgccgatatatcaggcggcgaaaactatccggggataagagggcgcgtaatattcagacagcagaagaacggcgtgctggtcacggcagatatatatggtctgcctacgggagaaacaggatgtgattccggtgttttcggctttcatatacacgagggcgaagactgcggaagcaatggacaggaaccgttttcaaacactaagggacactataatccgggggagtgtccgcatccgtaccatgcgggagatttgccgcctttatttgaaaatgatgggtatgcgtatatgtcatttttaaccaaccgttttactgcgaccgaaattattggcagaactgtggttattcatcttaagcctgatgacttccattcccagcccagtggaaactcaggggaaaaaatagcctgcggagttataaaagcgttataggtatgtaaaatttgtcgaaacataaatatttaggttttattatttaaaaagatatgttataataaaacgaaagaattaaaacataattttttataatgttttatgaatataatttgctgccgccatacttacggttcggcggcagcattgggttaatcaatgaaaatataaaagaaaggggagtatgattaaatacgagtttagtcatatacataagctatgtattatcaaaataaaatttggatgggtaaaaatgaaaaccctatttttctgtttccgcagatggcaaatcgtcacggtttgattgccggagctaccggtacagggaaaacgattacattaaaggtgatggctgaatcttttagcgatgccggagtgcctgtttttctcgcagatataaaaggagacttatccggtatgagtcagccgggagctgacagtgaaagaatgcaggggttaatagcaaagtttggattgaatgacgcaggttttaagtatcagtcatatcctacatattattgggatgtgttcgggaacaaaggtactccgatacgtactactgtttctgaaatgggaccgcttttgctgtccagagttttggggcttaatgatgtgcaggagggaattctgcatattatatttaagattgctgatgaccaaaaacttttattgttagatttgaaagatttaaagtctatggttcaatatattggagacaatgcgtcagattttaaaaatacctatggtaatataacgacagcaagtatcggcgctatacagcgcagtttaatcaaacttgaggaagaggggggagattcccttttcggggaaccgggactggacgttaaggattggtttaaaactgacggcagcggcagaggatatattaatgtattaaattgcgaaaagctgtttttgcagcctgatttatactctgcgttcatgctctggatgctttcagacttgtatgagattctaccggaagccggagatatggacaagcctaaaatagtgtttttctttgacgaggcgcatcttttatttaaagacgccccaaaagaactgctggaaaaaatagagcaggtggtaaggctgatacgttctaagggcgttgggatattttttataacacagaacccgatagatatacccgatacggtattatctcagctcggaaacagaatacagcacgctctaagagcctattctccaagcgagcagaaagcggttaaagctgctgcgcaaacgtttagaccaaatccaaagtttgatactgaacaggccgttaccgagtgcggaaccggcgaggctttaatatcatttcttgatgaaaaaggcgttccttctatggtggagcgggctaacattctgcctcctcaaagtttgatgggacctgttgataataatattatggctcagatgatagcttccagcgatatgggggcaaaatataatgctgtaatagacagggaatcggcttatgaaatactttcagctaaagcggaaaagagtgaaattgctgaaaataaggcgcaggaagagaaaataaacaggcagcaggaagagacagaggctaaaatgaaagctgaagctataaaagaagccaaggcggaactaagagaagaaaaacagagagaaaagcgttataatgagattgaaaaggcggctaaaagtattttgacttccgcgggacgaaccgctgtaaattctttggttcgcggtcttttaggctcgctaaaaaaatagggggaattatgagcagatttactgacgagtataaaatcaaatatgaaggttgtttaaagcgcgtgcagaaaccggccagatatatcggaaacgaatttggaagcgtgcataagaaatggtcggatgatatgctgacttttgctttttgttttcctgatgtttatgaggttggaatgtctcatttgggaatgaagattctttatcatatgctgaatgagcgtgaggataccgtttgtgagcgtgtgtttgctccgtgggatgatatggagcaggagatgagaaaagagggaatacccatgctttcgatggaaagttatgttccggtgaaaaattttgattttataggatttacgcttcaatatgaaatgagctattctaatatagtgaatatgcttgacctcgcaggagtgccgctgcgcacggcagaaagaacagccggtgacccgtttgtgtgctgcggaggaccatgcgcgtatcatgcggagccgctttcggatttggttgatttttttatcctcggagagggtgaggaagttaacagcgagattatggatgtgtataaagaatggaaaaacagcggaagcacagaccgtgatgattttcttatgtcaataatacctttgggcggagtatatgtgccaaagttttatgacgtagaatataatgatgacaacactatctcaagattcgaacctaaccgtgaaggggtaccgaaacaggttagaaaacgtataatcctcaatatggataacacttatgttccaaaaaaacttatcgtgccttttatggagaccgtgcatgacagaataatgctggagctgttccggggatgtatacgagggtgccgtttttgtcaggcagggtatatataccgaccggtgcgcgaaagaagtgttgacaagctggttgagactgccggagagtgcataaaaaacactggatatgaagaaatgtcaatgtcatcgctcagcacaagcgattataccgatttggacgagcttacaaataagctgctggatataacagtggacaagcgtatcaacctttcgcttccgtccctccgtgttgacaatttttctatggagcttatggagaaagttcaaaaggttaaaaagagcggattgacttttgctcctgaggcgggaacgcaaagacttagggatgttatcaataaaaatgttttggagagtgatttaatacgaacctccaatatagcgttcagaggcggatataacagaatcaagctgtattttatgctgggtctgcctactgaaacatatgaagatgtattagggattgccgagctgggcaaaaaagttattgacgagggcttcttctccataccggttgaggagagaaaaggcagaagcgtaagcgttacgattagcacctcattttttgttccgaagcctttcactccgttccaatgggaacctcagaataagatttccgaaatggaggaaaaggcaaaatatttaaaagagcatattggttcaaagaaaattgtttataactggcataacagtgatatcagtcttcttgaagccgtctttgctaaaggcgacagaaggctgggagaagttttgataactgcgcagaaacttggctgtaagtttgacggctggagtgacttttttgattttgacaagtggatggaagcttttaaaattaatggaattgaccctgagttttacgctttgcgccgcataggatatgacgaaattctgccatgggattacgctgatataggagtgcctaaatcttttttgataaaggaacataagagggcgtatgaggagaagacaactccaacctgccgcgaaaagtgcagcggctgcggagcagccagctttggaggaggtgtctgttttgagtaaaagacgtcttaaattttcgaagttaaacatggctaagtatatttcacatttggatttgctgagatgctttacacgttcaattatgagggcggaacttcctgtgaaatactcaaacgggtttaaccctcatcaaaagataacgttttcacttcctttgtcaataggtgtcacaagcgacagtgaattcgtggacattgattttgaggacggaataaaagacagtgaaataatggagcgtctcaataataatctgccgcctgatatgcggatattgcatgttggtgatataaaggacagcgctaatgatatagtttccgcaaagtatcaggttaaaattatatcggataaggtcatagccgatgaaaaagtcaagggattttttgatatgccggaatatacgattatgaaaaagaccaaaaagaaaggcgaacagcctgtaaatttaatggatttcataattgattacagtatttcggaacattcagaaagcagtgacggcagtatactgcaaatggaactaattttgtctgccggaggtcaaaaaaacttaaaacctgaaattgcggtaaaggcgttgtcggactatctagcgccggaaataaatataataagttatgatatacaccgaactgagatttacatcagtgaaaaagagggcctaaaagtatttgagtaaatctgtgaattttggtgaaaatgatattaaatctgtttaacagaaaattggaggaataattatgagaagaattgggattcttacaagcggaggcgattgccaggggctgaattctgccattcgcgctgttggaaaagccttatatgagcgattccagaacgatgttgagatttatggaattcaggacggttattatggtctgatagagggcgagtataaaaaaatggaaccccgcgacttttcagggattctgacaattggaggaactattttagggacatcgcgtcagccgtttaagagaatgagggatgttgatgagaataatgtagacaaggttcagaagatgaaagatacctatatgaaaatggggttaaactgtcttgtcgtactgggcggaaacggcactcataagactgcgaatttactgagcgaggaaggtctaaatattattggtcttccaaagacaatagataatgatatttggggaacagatatgacgttcggtttctatagtgcgcttaatgttataacggatgttatagacaggattcatactacagccacgtctcatggcagagtgtttatcgttgaggttatgggacacaaagtgggctggctgactctttatgccggtcttgccggaggagcggacgttattctgctgccggaaattccttatgatatagacagtgtggttgccgagcttaacaaaagagaaaaatccggcaagaagttttctattatagccgtggcggaaggtgctatttcaaaagaggaggccgctttgaaaaagaaagaacttaaacagagaagggctgagatggtacagccttcaattgcttatcgcgtggcggatgagataaaagaaaagtttaatcatgaaatccgcgtatgtgttcccgggcactttcaaagaggaggaagcccttgtccgtatgacagagtctttacaaccaggattggaaccagtgccgctcagctcatttccgagaataaatatggctatatggtggctttgcagaataatgaaattgttccggttcctctgagcgaggttgccggaaaactgaaatgcgtcagccccggttccaacgaggttgtaacaggcagagaactaggtatctgtttcggagattagacccttttatatttcacccattgacagccttatgctcttacttataagtgcgtttaaaagctgtccttctgttacagtttttgttatttttccatcgtcatctatgacgtcaattatatgatatttatagcagcccagtttccgcaggaacagtcttgcgggaactgattcatgggctgccattcttgtaacctgacaaaattcggttcttttaagccgtgttttgtaatacaatatttctttcagtgatattaatgatatatttttttgttcaatactcaagtttcccagcagaaaagcgcctataagtatcagcgacagattgaagtcgttggtaaggagcaaccatactgaaacaagcagcattccgattattggcactctgctgattttcagcattaagtttgaggctcgaacggctcctaaatttattgatataatagcttttgctattcgtccgccgtctaacggaagagccggcactaggttaagtatcataagagacaggtttatttttataccgtagtctatagcttcactgtatacagacagcattggatttttgtttagcatatagagcagtgctgccagtgcgccgctgaatgcaggtccggctgcggcgattacagcttctttgtatggatttttaatgaacccggcgcttaattttccgcatattccaaatggcagaatttcgattctgacgatagatacgccaagttttttcccgcaaaacacatgggacaattcatgcagaaaagcggagatatatgcaataaagaaaaggtttccgtagccgcctaagattgaagcggcggccagtaaaaaaaacagcgggcttactgcaaggtgactgcctattggtataagccagaggtgtgtttggagagcagaaaaaatgttttttaacttcttcaaaatatttcactccagaattgccatatttctgaaaaaaatccacaaatgctgttccagagaccaataaagtcaaaattatatcttacagctcttccaagagcggatatacagtttcgtccaaactcgaatcccgacctgtttataagtataccgccgattattattaccgccacggcgatagattgttttaatataagtttcattcttaattcaaaacggtcattctttatattgttcttgcggtttggctcggaaaaagaacctcttctcctcagttcttctctcatactatatttataatataaccgtgcggttatattatttcctcctttccgtttgagtatatataagtatattgaattgaggagacaagtatgaccttttaaattggatttatttttagggtatcgtaatgagattatcttatatttaaatatttaattcatatatataagaaaagacatgcgttttaggtgaacttaatggttttccaaaagttagaaccaaatatctgacaatcggtgattgcatcaaacacatgtcttttttttacatcctgattataggaattttttgcggtatttttatttattgagtgtttataacggcggcaatttctaaatcatgtattctttttgccggaccgtaaactgctgcaaaggatgataacagaaccacaaatataattataaacagtgctgataacggtatttgccaagtatctccccaatgttgcgtaacaagaaagctgaacataaatttatgaattggaagccccaggacgcttcccagaatgctgcctgttacggcataagtgactgcttctgctgttatcattttgactgtttgtcttttttccattcctattgctatcatagaggcgtattgtttaatctttgaggatacgctcatagagatactgtttattatgttgaatacggtaattagagcgatgattaatatgaacccgtatataaataaggcaaatgccaaaaatgcccccctgacttccttattgcttaggcggcggtcagaaaatgttatatcagaaccggctaaaccgcgaatatagtttacatcagcatcagtcgcttgatttgtgagctgaatatcaattatagtataattcttttcaccggttattcttttaaaagtttcttctgaacagataattgtctcagttccttgttcactttcaaaagggcaggtagaaagaactccggatattgaaactgtttcgtttcctaggtttattttatctcctgtatgcaaagaattttcattactgtatacagcaagcacataatcactattgccgagaacctttgataaatccccttctaatatataattttttttatcagcccaattaaattgattggattcgtaggatattaaatctatttttctgtcgcttccgtttatttttacgggcatattatatttaaatgaacgtccataaactcgcttaacgctacgcaaaccggatagttcagcggttaggtctctgtttacggaacatgtgttatccggacttataattgatacgtcaggtgtatatggcttaagcggttttatagcatgattcataaaactcacaacagctgagaaagcaagaaataaaacaatgcttaatgcaaaggaacctgtcattagaataaaattttttatattcattttagcgtgatatataccaagcccggtgtctactttaaataagtttgtgccggcagcatggtatacatttttagtattgttataactgcctgttattgctgaaagcggcgatacttttgcagctttttttgccggtgactgagcggaaatcaaaacggtgaggagaccgacagctattcctgatataattcccaaataacttattccgaaaacaggcatatcttcaaaataactgccgcttaaaaattttaacaaggaacaaagaacccatacaactaaaactcccaggataactccgattggtattgcagctttgcaccagtttaaggcttcaaggcgcacaaagcgtattatttgctttttttcggcgccaatacaccttaacatcccgaaaaatttcgtccgctgtgatatattactgtttaaactgcttgctatcattaaaactccggcaatcagcaccaacaaaaacaatacaaaagctgagccataaagacctagcatatatgaatcattgctgtatcccatagtacctaaaagagcggtattgcgagaaatattatcttcggtgaatccatattgtttctttatatcttcgattgctctgcgaatgtttacgtttttgtcaaattggacgtaatatatcatatctgaatcttcagcagagctataaatatttttaaaagcaggcattggcagaaaggcgccgattgcgtcagcttgtgaaatcatagaactgtccatgccgaacccggaaataatataatttattctctcgcctgaaggtagattaatctcgatagtatcgcctatagatacttttagtatatccttagcattttgggtcagaatgatctgattatcatcggttggatattgtccttcttctatagagtcaggcattatatcattgagcagcgattgttctgttccgcatatcaccgcgtctttaccgttaataaaatatccgtcttttaaacggtaatttaaagtattataccaagaagccgcagcaatatccgatcgtgcagaaagtatcccggcatctttttctgatatgtttttcaatgctatatgccagtttccatagtctttgattgcttttattttctggcttctaatttccatatcagccatgctgaatatggcggttacaagaaaaactgcgagtatgatacataccatagtcattttattttgttttttattgatcttggctgaaatagggataaggctaagataacttttcattattatcacctcccaaatcagtgagaacgccgtcggctacatggaatactctgtctgcagatgaagtaagacttacgttgtgagtaatcattaaaatggtctgtctgaatattttagaagctcttgttaaaagttctataacgtcggaactgttttgactgtcaaggtttccggttggttcgtcagccaaaatcaacatgggtcttgttatcatggctcgccctattgcgactctttgctgttgaccgccggataattggctgggcagatgcttacgtctgttcgaaagcccaagcacgttaagaatttcgtcaacgtcttttttgtccggttttttatagtccagtaatagaggaaagataatattttgctcaacgtttaactcgggaataagctgaaaagactgaaaaacaaaaccgatgtttcttctcctgaaaatagttcttttttgctctttcattttaaatatgtcatcgttgtttatatatattttccccgatgttggcgtttcaagaccgcctatgcaatttaatagggtgctttttcctgaaccggattctccgacaactgctgcaaattcccctttgttcatggtgaatgagacattttttaacgcatctacacgtgtctctccgtttccataggttttactcagattttgtacttttaagatttccataagttaaatacctccttttactgagaatacaaagcgcggcttactatagcgtgaattttatcttacagttttgtaagatatactatttaaagaaggtcaatgtaaaagttgttccggcatttaactcgctttttactgtgatgtttccgccttgtccctcaataattgaattagcgagaggaagaccgagacctattccggaggtattattgttttgggttggtacgattcccctataaaatcgtttaaatatataatggatatcttctgtagaaatcccggagccatcgtcggaaataaaaatttgagtaaatattggggagtttttccactcaatttttatatgtccgcctgcgtcggtgtgatccaaggcgttttttactatattgctcaacgcttctgccgtccactgtctatcacaaaatattttatcttttacagagccatttattgaaatttctttgttctcatgttttgccctggttgtcaattcgtttattgactgataaacaatttcgtttaatgtgtattcagatttattaaattcaatactgccggaatcaaaacgggcaatttttaaaagtgaagatataagctgttcaattcgtataatggaagaggatgatttttcagtaaaaattttaacggtctcagtgttatacggttcgtccaatactatttcattatacatctttagtgcggcaagcggcgttttaagctgatgtgatatatcagaaatcatattttttaaaaattcttttgttttatgttcagcctcctgtttggattttagagcagcagccatatcgttaatggaattgaatagatgataaatggttccgttttttagttgagggagttttgaagaaaaatctccttttgtgtagcaggtaacggtttgtattgctcttttataaatttggtctcttttatataaaaaaataataattaatatagccaacaaaagaaaaaatacagatgttatcagaaatataaatgtttttgatttgacctgaaagtctgaaacaaaaggtaaaaatcttgagtcagttttttcggttattccgagtttatttaaaagctcataactttgaggactttttgttgtgtttgtcaaagattcagctattatcttttcagaaacaccattttccaataacgcagccgtgatagattggtcgtgggatacaaaaatcttttgaatgatgtctttttggtatatgcacaaaatagtttcgagcacaaacaaaaataagataattaacacgacagaaacacaaaagttccgggtttctttttcataaaaaatactcataaccccacctcgttccatttgtagccgaatcctctgacagtaagtaaatgctgtggttttgacggatcattttcaatttttttgcgcagtctgtggatatataccgaaagggtgttatcgtcaacaaatttttcatcacagtcccacagctcgtttaatatcatatttctggttacaactatattagcgtttcgtatcagaattagcaggagtttatattctgcgccggtcaattcaagagtttttccgtttaaaattatagtatgctttaataagtcagctgttacatctccgcatttaactgaagtttcattatatttttgtgctgttataccggttctgcgtaatagtgcatttattcttgaaaacagttcggccagtttaaaaggctttgtaatataatcgtcagctccgctgtcgaggccccgaattacattgacctcctcgtcagaagcagtgagaaagatgatggggactgtattcccggtgtttctgacaaaatcacatatttcaaaacctgtgccgtcgggaagagtaacatcaagaagaagcaagtcgtatttttcagtttttaaaaatatcttagcttccttaacagtaccaacaaaatcagcagaaaaaccatttttacttaacgaatatttcaatccgtctataaggctcgcatcgtcttccagtagtaaaattttcttcatttttattctccgttctgtaatatataaaaattatatagaggattatttgcactgtcaagcggcctacggaatgtttatagaaaatttatattattaattctatctgacctgtgcactttagtgaaattctaaatgcacagcttaatagaaatatgttataaaaagcttactaaaaattaagtcatttctaaacacagaagagtttgtgtaaacttataaataatttttaaaatatgtcgtattgtgatacatagaatggattaacagtttaaattctgtgccgttaaaatttaatctgtatgattatatatagttagcaaacactaactatgttttgccttttatttttaacaaaattatgcaaatagacaaaaaaacacttttttattagaatttgcttgacaggtttatggagcgatgatatactttttatagaggttagcgcgagctaactatattttataccgtatggttagtattagctaactaatatcaatttaaatataataaaaataagatattttttgaaaggaggggaagcatgatgcctttgtctatggctgagattggtgagaaaaagagagttataaaagtaggcggtaaggatgaagtcagaaggtttcttcaaaatttaggatttgttgaaggggttgaaataactgtcgtttctgagttatcaggcaatatgattatcaatgttaaagataccaggatagctattgataaatcaatggcaaacagaatcatggtttaaaaattaaaaggagatgttaaaatgagaacgttaagagacgcgaaagttggggagactgtcagaatttcaaagctccgcggagaaggtgcagttaagagaagaattatggacatgggtataactaaaggaactgatgtttttgtccgcaaactggctccgctgggagatccggttgaaatttcggttaggggctacgagctttctatcagaaagtcagacgccgaaatgattgaagtaaactaaaattatttggttgcagccggttcatacggctgtaatataggaggtaaatgcagatgtcaataaaaattgcgcttgccggaaatcctaattccgggaaaacaacaatgttcaatgcccttacgggtgcgaaccagtttgtgggaaactggacgggagtaactgttgagaagaaagagggaaaacttaaaggtcataaagacgtaggtattatggatttgcctggaatatattcactttctccgtatactcttgaagaggtggtagctagaaactatttgattaatgatcatcctgatgtgattttaaatatcgtagacggcagtaatattgagcgtaatttatatttgacaactcagcttattgaacttggaattcctgttgttgtcgctgttaacatgatggacgtagttgaaaagagcggtgatacaatagatttcggcaaactgggaaaagaattgggatgcgaagtggttccggtttcggctttgaaaggaaatggagtaaaggaagccgcggagaaagctgtaaagacagcgaaaagaaacagcggcgttaagatattacatagttttgacaaccgtcttgaagagtggctgtcagaaatcgaaaaaagaattggtataaatgttcctgatgaacaaaagagattctatgctataaagctttttgagggcgataataaaattaggaatttaatgaatatagttcctgatgtctcggatatagtgtctaaagctgaaaaagaattggatgatgacgctgaaagtattatcacagacgccagatacaagtacatatcgtcaattattggcggatgttataagaaaaataagaagaaaaagcttacagcttctgataaaatagacagagtggtaacaaaccgctggctggcactgccgatttttgctgtggttatgttgatagtgtattatgtgtcggtaaccactgtaggtgcttgggccactgactgggcaaatgacggtgtgttcggcgaaggctggaatctatttggcatttgggttccaggaataccggttttgttgaaaaacctgctgaatgcaataggtacagctgattggataaacagtcttatccttgaaggtatagttgccggagtcggagctgttcttggatttgtgcctcagatgcttgtattgtttatattccttgcgtttttagaagactgcggatatatggcaaggattgcatttattatggatagaatttttagaaagtttggtttgtcaggcaaatcttttatacctatgctgataggaagcggttgtggtgttccgggtattatggcctcacgaactatcgagaatgaccgcgacaggaagatgactataatgactaccacatttataccctgcggagctaagctgccgattatagcattgatagcaggagctctgttcggcggggcatggtgggttgcaccaagcgcctattttgttggtatagcggctattgtggtttcaggtattatccttaaaaagacaaagatgttttccggggatccggctccgtttgttatggagctgccgcagtatcatctgcctacagtgacaaatgttttaagaagtatgtgggaacgcggctggtcgtttataaagaaagccggaacaataatattgctgtcaaccatagttctatggttccttcagggctttggatttgaggacggaagctttggaatggtagaagacttaaataactcagtgcttgcaaagataggcggagttatcgccccaatatttgcgcctcttggatggggtgactggaaagccgctgttgccgctgttacaggtttgattgcgaaagagaatgttgtcggaacttttggagttttatatgggtttggcgaagttgcggaagacggagcagagatttggagctccttagctgcaagctataccgcgatagcagcttactctttcttagtgtttaatttgctttgcgcgccgtgttttgcagcaataggagctattaagcgcgagatgaacagcgctaaatggacttggtttgcaatcggataccagacagtatttgcttatactgcagcccttgcaatttatcaaatcggaaacttgttcacgggcggagagtttggtgtgtggacggtggcagctctattgattattgcagcattcatatatctgctgttgagacccggaaaagaatcaaatatcttaaaggttaacagaaaagttatgagagtttagaggtgattttatgatttcaacaataatagtttcaattattcttttggccattgtgtctgcaatagtaatacacttggtcaggaagaaaaaacgcggcaaaggttcttgcggatgtggatgcgacagctgcggaatgtcaaaatattgtcataaggattgaatttaacgtttagaggagttgtgttattttttaaaggggaatgaaaaaataaaattcttctgttcagatttttgtttgttcatattatgtgaaatttagccattttgcaaagagtaaagataaaaagaacatgttttatttgtgattgatcactacatgaaatgtgttcttttttatttgtctaagagctttatagtaaataggttacttttttataatatggatatggcataaaataatgtagattttttaagaaaaaaaagaacgaaaaatggagaatagacataatatggaaaggagggggtagtaatatgtcaacactttgtaatgtatgtaatcgtcgtcaagcacgctgtccaaactgccattgctgtaaagcatgctgtcagtgcggcaattatccgtgcaaccagcctgaagatgtttcgtttactatttatgtccgtaattgtgtaaccggcgaaccaatatccggggcgtcttatgcaatatgcaagaatggaaaagtaattgaaactgtaacatcaggtacagatggttcgctgaatttttcgtcaattatgccggggtgctaccaattggcggaagtatcagcagctgacggataccagttggatgacaaggttcatcagataatagttgaaccaaacggaaaggtaataatagacggaaagagttcagaatgcggtgagttatgtaataatccgcttatatcattatcttttttaaaagttaattccgtaacaggtttgccagtacagggcgccgtatttacgttgtctgatggtcagaaagcggtatccggtattaatggcacagttagatttaacaatctgtctccgggaaaatacaccttggttgaaagcagtgtcccgggtggatacgtgccgaatacacgggtttattatgtcgaagtatctaattgtggtaaaataacaatcaatggaattcctatgggtgaattcaaaatagaaaatcagccgtctgaaggactaacttttaaaaagactgaccaaaacggcacattaggacttgcaggggcagaatttagactttcaaatggcgcaagagcggtttcggattataatggcaatgtagactttggcacacttgttccgggaatatataccatgagagaaacaatagcgcctgacggttataagctggataataagatgtatgatgttattgtgtctaataatggttcaataacggttaatgggatcccgattcagaattttaaggtttataatactcgggaggagcgtagtcagcgtccggtcattacgtctgtaagtgaatgttacaggggtgtaaacggcaccggtgttccgggggctgaaataacagtgacattttctgacggaactcaagtttatacggcagttgatgtttgcggaaactggagtgtaaatgttccggttaatgtgacaattactaaaggagacgcaatattggcaaaacaaaccgaacccggtttgccgccgagtgaaaacgcattttttctgattcaataagatgcaggctgagaaaataagttaaagtttttaaaccacagcttttagctgtggtttacatattataaatattaatcgggaaaataaaattttttatagtatcttatttttaatgaaatgattttttgcattcatataatggactaatttttgccttttatatattttgaatatattttatcaaattaagtgaatatatttcgttatctaaaagcgtttttctgaaatgtgttacctgttaaaatatggcaaattctgataaaattattctatattttgtcaggagtgaatttaatgaacaatattgaaatggaaaagatagttaaatcaacatttggcgggcttttatatgaaataaggtcagaatatgaaataagtcaggaggttatggctgagatatgcagaatctcctgcaggcagtatgcaaatttagaaaatggaagatgtgttccaacagtattaaattttattaatatattaaaaatatttgatgtcaaaatagatgattttgtagataaattaatagctaacggctatgtaattccggatatggatccaaacagagaaatggatattgtaaacatttaaggttgactaaggatgcgaagttaagtgtatttagaaagtttagattcaaagtttcatttaaaatacatcaatgtttttgatatttatagaattatgtatcataatatacactcgaaaaataagaatgtgtgccggcggggacagtctgcggtatgatatatagatatacatatgaaaaagaaagctaccatcatatagacattggcagttacacgtcgtatgcagtaaaggtttataaagacagcaaatgtgttgaatacctaccggatttatttgatgaggcaaaaaaagctcttagatttaccaggttgtgcgaggctctttatatggaaccgaaatatatctatgattttttagatattattataaaataagcagtgtatataaaaacagcaggtcagtaatatgctgtcctgctgttgaggtatgtaaaattatttttaaaaattagatacagttagtaatttattatgaattttatgatgtaagaattcagtaaaggtattattgaagccgtaatattgtttctatttgcttttaataaataagttttttataatatgaaatttgttttatatcttaaataaaaacttatatagtgacttgtaatcaaaatcactatttttatctgccttatcttaatattacaacaaaatgttctgaaaattattatctgcaaattcacttgatttgtttaattccgctgaaaacagcctgtcatcgggaagaaagcccaatttcttgatattagagggttctaataattcttgaggggtgtatatttgtattttaaatccaaaagattcaaaatgttttaaaacatcattgccgtaaagccggcaatggtcgtcttgaccaaaggctttaattctggaagcggaggaagtgattgttttatcctcaaaagtttttctgtctttcgcaataggaataaaaaacaaaaattttccgtccggttttaatactcgttttatttctgagagcgcagcattttcgtcagaaatatgttccaaaacatgattaataatcacgtagtcaaatgtattacttccagctgtaagatttgttatatccataatatagtctgcgcgccctttagctaaatcaccggttatgtaagtacaattcggatttatcttttttatcttttgggctatttgcggttcaggagctatatgcagaactttacattcagttgataaaatgtctgtaaaattcacgataacataccacgtccaccgatatctgtctaaagacttacaatgaggacacttacagttttttctccatccgccgccgataatatttatcttttgaaatatatcctcattttgaccgcaaggtaaaaaatagagagattttttgccgcaaattatacagcgtctcctgccaaatggcagagcggccaaaaattgagttagcttatatttaattttatgagcgagtgtaaacataataaccgctcctttatctgcttcttaaacaattataacatatttttgataaaaattaaatataagattttataatactctataattctactaaaatactaatatattaaaccatatgttaaaaagcaaactatttgattattataaaaaagcgggtttttcagtgaacatcggtaggcttgttgcgaccgcaccttttaggtgcgtgtgaaccaaattaatttgttttgtttaacctacaatgtcaataaattgcttagttgtgatgtatgttaacaagcacgttaggtgagctattatctgaacacgtagtgttcaatatataaagaaactatttattataattaactttgtatatgaccccatataataataattattttacttataataggtgtttgaatcatttaattattacacaaaagactgggtatgtagtgaacatcgggagggcgcatttatgcgcctcgttaggtgagctatcatctgaacacgcagtgttcaatatatcaagtaaatattcataaaaattaactttatatatgaccccatataaaaaaatttattattacataataaggtgtatgaaccatttctttttctggcaagaaaaagaaacgcttcaccaaagaaaaagtactgctcgcttaggtcgcctacggctccaaggggcgctcgcccacgctaatttcatcttgaatctgcgtttcaagatgaaaaagccttgtaactttcccgttgactttgtgaactgccgtgaataaagatattccgatatattatttattttctctaataaaaactgttgttttggcaaacatcggtagggcgcatttatgcgcctcgttaggtgcgcagtcgcggatttgttaatatcttttattattatctttataactttctataagattaattatcagggaaatgtgacatatgcggaatatgacaatttgggcagacagatatccacaaggaatcctgacggaacaacagtaacggttgaatatccgaaagcctcatcagccggacagatattggagaattctgtaataacaaaagacggaagaggaaacaaaacaaagtatatatatgacggcttgggaaagataacaaccgtgttcaactgtgaaacaaaccaaacacagaccgcttatgagtatgatactgtaggaagaataagcaaaataatagacggaaacggaaacagctataactatcagtatgacaagaagaaccgcaagacgaaaatggaagtaaaagacgcagcgggcagcttgacatatgaggagaactatgtatatgacgatgtagacggagacctgtccaaggccgagacaataaaaggaagcggagccggaaagacagtaagcgcagtatacacagacaagtatggaaacactgtcaaagaaacaacaggagagggaacggacataagcgagacggaatatacatacgattatatgggaaacaagctgaacaccaaaacaccgaaagccaaaagcgaaggaaaaggttatacatacagaacagagtacggaaccaaagacggcggagggcgcatttatgcgcctcgttaggtgcgcagtcgcggatttgttaatatcttttattattatctttataactttctataagattaattatcagttctgtatccttttcattaagtttatttattccttctattattttatgtattttttcagggtaccttatattttcattaaaaaattcgtatggcgttattcccaaatatctacatatttcaaaaaattcgctcatggatggcattgcttttcctgatgttatatgatttatatatccttgtgaacgtcccatcaaacggcaacagcaacaaagaatggaataacagtatcagtgacaattgacagcaataagatgcaaaaaaatggagaagaaatagaattggatgttccagcaaggttagtagaagacagcaggacattggtaccattaagagcaatatcagaagcatttggctgtcaggtggaatggaatgaagaattacaaagggtagacatttattcaaactaaaattgttgtggagggcgtaatgatttacgccctccggtaactccaaaaagttggacaagcgtacgcataaaaaactgaaacggagtaaaaacaccggaaagttttgcttatataaaaataattaactatttaaaataaaaatccattaaatacttcctttttaaatagttaagaaatacatataactccgtttcagtgacggtacattctgaaccggaggcgctgcgggcgcctgagcagccggagccgctgtagccggacttattgttggagcttcagtagcgacaacggtacattctgaaccggaggcgctgcgggcgcctgagcagccggagccgctgtagccggacttattgttggagcttcagtagcgacaacggaattagaagcttttgaggagcacagcagctattcttctgcggtattcctcgaacaccttgtaaaagcctttaaattccctattgagtgcgttcagactgataacggacaagagtttaccaagaggcttggcagctcccaaaagccgaccctaactatgtttgaaaagcggcttaaagaacttggaatacaacataagctcataagaccgtacacacccagacataacggcaaggtagagcgttcacaccgtaaggataacgagtatttttatgcaacacataaattctactcgtttgatgattttgcaaagcatatgaaggaagcagggaagaaataataaactgtgaaacagagctgaatctgagactaaatgtatcagagctgtacggagcctttaataacatatcgcaggttatgagtctttcggagaatgaaacgtccgttttttcgaacggtaatatatataatagcgacttcagagcaggaaaacatgattttgctaatgttactgccaaccaatttggtgcgtcaattgcttaataccattttatataaatccatttaattattctataattgcttactttgatgcgccagaccctgtttcgcccgccgagcccgggcgagatcgtcatccccttcagagacgattaagtcaaaccaataatacctatataataaaaattatattaaaagaacttgttatttagcaagcatcggaagggaggactttgtcctcctcgttaggtgcgcagccgcggtgatacttcataattataaatatcattttatataaatccatttaattattttataattgcttactttgatgcgccagaccctgtttcgcccgccgagcccgggcgagatcgtcttccccttcagagacgattaagtcaaacctatataataacatttataacaaaaaatgacgctatagcagttttagctgctataagcgtcattttaaaatatattaaaatattatcccgattatctgtatgagtatccgccttttatcattactataacatcattactggctgtgaaacctctgccgtcattcaccggaacaatcagcatatgattcgacggcaactctgttccgtccggcaagtcataaccataagtcgtgtcggctattccgcccttctctgtcccgattaccacaccgtttccttttctcagaataaattctgccccagcgtcaaatataaccgtttgtcctgcatccacatttacaacagaaaacttctcagaatatgaatctgaagtcccgcctgacatcttctgctcaacgtatgctttaagctgcggcaccaccacatcaactatatagctctttgtaaccacagggtcgtctgtgtcccccggttcagccaataccagcgttgcgcccaaaactgagagaatcgccgcaaccgcaataatcatctttaaccacttatttttcatttccacgcctccttttcatatgtgtatataaccgccgttcattttttattaatcctccaaaccaaagctgatgcttatggcatggttaacacggttcatcagtccatcgtctagatgaccaattttctctttaagacgttttttatctatagtcctaatctgctcagccaaaacaaccgagtcctttgacagcccgtagccgcctgcgtccagttctatatgcgtgggcattttagctttattaagctgcgacgttatagccgttgcaataacggttggactatacttgtttccgacatcgttttgaataatcaaaacaggccgtactcctccctgctctgaacctacaacagggcttaaatcagcataatatatatctcctctttttactaccaaatcaattcacactccgcaagttaaattcccgtttatgtctttggtaatattttatgctgagagacctgtttttgttctgtgctgcaaccggacaacttgcggtaatgaacggttgttttatgtacaggtcaatctttgaaaggactgtccaaaaggtaattatgaacgtctgcgaccttgccgcccctcatatataccctcggaattctcttaccaatgacacaaaggatttcataatttattgtccccataatgctcgctatattctcaatgggtatttctgcgccctctgagctttttccgaacaatatgacctcatcaccgatatttatattattaacatctgtgacgtcaatcatacattggtccatacaaatatttccgacctgcctgcattttttgccttttactatcatttctgtcttatctgaaaggattcttgagtacccgtctgcatatccaataggcacagtagcgatttttgtttcattattttttgttttaaattttctgccgtagcttacagacgttcccttttcaaccgtcttaatattggttatctgagccttcagcgacatagccggttttaagtttaaaatatcttttgatacaaaatcactcggcataagcccataaagtattatacccggtctgaccatatccatgtgaaattccggaaacctcatcagcgccgcgctgttacagcaatgacacagcggaacttttacccccgcttcccttatcctgctgcacaaagtgttaaaccggttatactgcagcattgtatactcgtcgtcatcgtcatctgcaatggcaaaatgggtaaacaaaccgtctatttccaaatacggcagttttgaaatctctataatttcatcaaccgtctgcttatttattttttcatcctctgtgtatctgaatccaacacgccccataccggtgtcaattttaatatgtattttgccggccttattcagcttggctccggcgtttgacatcgcgactgccagctctttggtataacaattcggcattatatcgttttctattaactcctcggcatatttagacggagtatttcccaaaatcaaaatcggagtatcaataccgcacagccgaagctgaatagcttcatccaaaaaagccactcccagcgaatcagcgccgttttcaagaagcgtttttgcaacctcaagatagccgtgtccgtatccgtctgctttgacaactcccataattttaggcttatcaccaacatgtctgcgtatctcttttatattattttcaattgcgtcaaggtctatctcagcccacgcgcgcttttcagtaaccataattttctccttcaaaaaacatctttcaaattaaactgccgtgttcaccagcctaaaagcctccggtaacatttcaaccaaatcagttgctataagcccgtgctcgcccttgtcacgtcttgccaaatccccggccgctccatgcagaaacacgccgagaacagccgcgttgtaaccgttaagcccttgacccattaacgagccgataactcccgacagcacatctccggtacccccggtcgccattccggcgttacctgagttgttaatatgtacgccgccgtcactgttggcaataacagtgtcctttcctttcagaactaccgttacgccgaactcctcagcaaaatcacgagcgattccaactctgtcattctgaaccgcctcaatgctcaaaccgcacagccgcgccatttctccaggatgcggcgttatcacgacctggcacgattttctgtttttatgctttcgcaaaatatccatatctcgtgaaatacagttcaaaccgtccgcgtcaatgacaaagtctgtgcttccgctcagaagcgaatctataagtttaggaatatcatcattatccgaaagcccgggaccaaaaacacaaacgtcacttttattcagtcttcgcttgatttcgcccagagcgtcgagacttattgtgccgctctcctccacctccggcaaaggaaccgtcattgcctcagtgagcttaaccgccataatctgctgctgtgattcgggaactcccaaagtaaccaaaccgcttccgcttctaagcgctcccatgcaggacaaatatgcggctcctgtcataccgcggcttcctgcaataataaacaacttgccgcagtcgcccttgttagagtcttcattacgaaccggaataaggcttttataatattccagtccggtataaaacggaatccccattcccgggatatcctcagatatatataccaccgccaccgcggtcttatttgaatgcgagatgcttaatgcagcgttaaccttcattcctccgaatttaataaacggctttccaagctcatcgtggcagacctctatatctgacagcgaaaatcccctgacgccgcttcccaaagcctttgaaaaagcctccttagccgcaaagtggccggctatagattcataaaaacctttagccgcagacccttttgagacaaaataatccgcctcgttttgggtaaacacccgccttataaacatttcaagatttttcatttcacgaaaccgtgagatttctataatatctattccaatcatattattccgcacctttgacaagcataatttttagtccagcacaaccttctgcggattaaactttttaaaaccatcacggattttctcgttagggttaaataacagcatctttccgcttccgttttcattatacactgcaaaatacaattcactgctgtttttatcaacacaggcatataccttttgataagactggttattcatatatctctcaaaatcaggatgagaacgcttcgccattatctcaacctctctggcgttgaactcggtcaaacgttttctctttctgacattaactatagcgtccacatcaaacgagccgttggtaaaacaatactcatactctaaatttactgatgttatcagcatgtataagagataaatcagaccgcacgcaactataaaaattataaatcccataagcggtatagaaaacatcagcgcccctaaaacatatataactaaaagagccccgatgatacctgccaaaatgattaaataatccttgctgtcacgttttttctttaccaattgttccacaaaaatatccattaaattgcctcctgtttgtgtttcatattttatcagacgaatgttctgatgtcaagccgcctattcggcaataggtatgttctcagcgcctataccgctcacgccgctcagtttcagtttaccatccgcatcgtcaccgacagcatatattgttccgtcatagttaagtcccagggtatggctgtttccgcaagctactgacataacatttgcccaaagcgaaacagaaccctgattcttatcgttaacacccttagaactcgtctttccgtcagcgtttacatagacaatatactgagaaccgactgccgccgacactatatttttaactcctgaggtatcacactggcggtagctgttatcaccgacagccacaacagagccgtcatattttaccaatacagtatttttttctccggtcgctataaatgcaacatcgctttggcctgcaacgtcacactgtccatggctgttccagccgacagcaagcacagtgccgtcgtttttcagacctatcgtgtgattgcctgacactgcaatctgaactatatcagtccattcctgaacatcacactgaccatacttattgttacctctggcaataactctgccgttagctttaagcgccacagtgtgtccctcacctgtggcaactgacacaatatcagtccagcccgacacatcgcactgaccatactcgttgttaccgactgcaataagatttccatcgtatgtaagtccaacagtatggtttccgctgaccgaaactcctataataccggaccaatccttagtttcgcactgaccgtagctattatccccgaacgacaaaacctcgccgtttttctgaacaactgcgctgtggttgtatccggccccaatcaatctgccatacatattcaatatttttctgacgttaacaacactttgcttatattttccgcttttatgaaaatattttaaggctttctgatattcatgtatattcatataagccattgccgttgaataatcaatctcatgtttctctgtgccgaaatagacaaaatcctgttccagcttttcaagagtgggcgcggcgttctgaaaatcacggtttatataataattcattgccgttttatagcaaagctgacgcgccgaaaaatatttctgaactcccattccaacgaacgccaatatacagcatccaacaatgaccgaagaccaaattataagttttttgttggcagacattcgctttttcagttccgttttttctttggtatccttgatagctttggtcagtctcagcctcagccagtcctcgcccaaagcatcctcggttactatatcattatcaagtttttgctctgaatttatccaaatgcttccgtcgtcaaacaatatttttgaaacctcaacaaaaacagaacaggttatatccggaacctcaaccgtttgagaattaccaaacacagcgttgggttttgcgtcaacatttatatacggaatatttctaagctgtacacaaagattaagctccgaatcaaaacaacctgcattaaaatataccgacttcaccgtttttccgcagttattatatagtttaagcttcatgacggtctttttgctgtcgcgcagtatctcgcttgtatcaatatataccggagctttgccgcggttttcatattctgtacgttttaccactttatatgttttttccgccatataatcacctttatcaacaatctatttatattgaaacaaaataacataattatacttagacattatactacaaacttcagcaaaatgtattacaacactgttaactctgttatacaaatcaaaaacaggcgtgcaaaatatatcctcagtttccattatattattagactggaaatattgagtaaataaaaataatatgatataatgatacaaaaataactgtaaaggatgagagaccatgaatataacagaagcgataaaaaacagaagaacaatcagaaagtttgaacaaaagccggtcagtaaagacgacttaataaaacttatcgatttaaccagatacgcggcatatggagcgaacctccagccgcttaaattcgcggtaatggataatccggatgaaatatatccgctgacacgctgggcggcatatatgacggaatgggaaccggcgccgaacgagaggccgcttcactatatagccatactcggggacacaagcattaagaaaaattttgaaaccgacgccggaacggcaataaccacaatgatgctggcggctgaagaaatggggctggcaacctgcttgctcggggccatagacagggacaaaattaaagaaatgctcaaaactgactatcaggtattatatttgcttgccataggctatcccgctcaaaaaagcaaagttattgatattgaagacggcaacataaaatattttgaggacgaaaacggagttataaatgtgccgaaacgttctcttgacgaaattattgttaatatatagttaaggttttgagattaaaacagctttcaattcggaaagccgttttacgttagtttaattaaaatattaggaaatgttacaataaatcaaacagaattattaatatcatatataataaaatatagtgcagcaagcatcggcagagctgtgaccacactttttttaagtgtgtgtgatacaaaatgacttgtattgataaaacttaataatcagacttagttgtgatgtgcgtacgaagtacgatgcgtgaggcgcgcagttgcagaaaagtatattataaaaatgtttattacaaaccattctaagtattcatgcttcgcgtgtggaaattcacctaacgcggcgtgcctgcaagcaatatatcacaactaagtaatttattatatgacaactaagttaattattagtgtttatagtttatagtttgtatgacacaatatagtttatataacatgcacttttaaataaaagtgtagctgcagacattgaaggtttagaataaagagatactgtggctcacacctattggcgttcacaaaaaacaccttgaatttttccgtctgtttatgttaacattccattttcttcatgaatataataatagttgctgacgtaaaaacatttctataataaacacaactatgataacaagattatggatagtcaacactaatttagacaacttatttaaggttagtaagtcggtattctttcggggtcaatatagcccagtgatgagtgaatcctgtgattgttaaaccagtttacataatccgataattcatattgcaattgttctaatgtttcatattttgacttttatgattttaaatgtggcttccgctgccgcattgtcatagggacagcctttcttgctcagtaagcagtcgatgtggaatgtctcaagcgttttatcagttgtcaaaccattttcttctattttttgttttactttataataataagtgcttcttggaatgtttaggactttacacattgctgatacagagtatttgtgggcatttgcctttatcacatttactttcgtcctaaaatcagcgctgcttgttttaaaatgtcgttctccatctttattgccgattacgtttggcagttctattattttctgctattctgcagaacggttatctttttcgtgaaaagagccgctagctttggtcatcgtagtttctctttctatactttctattttacataaccttaacttttttgtccagttttttgtagcctttccaaatgtatgtgccctcgcctgtagggtgagtgtgagccataaaggcttgttttgattggccttcaatacaataatataaatacataaaatgccaccgaaattagtatattaaattaaaataatctagtacgtgaacgttcatttttaaattttatttataatgctttttattatatagtcaaagaaaatttatttaccgttatttccgaatagaaaatttactttgcataaatctattgtataaatccttttaacgttttatacaatacatcggcgtctaccggctttgctatatgggcgtccatgccggattccagcgccgccgctacatcttcatcaaaagcatttgccgtcatcgctattatcggtatagtttcagcctgcggatgactgcttgatctaatagccctcgccgattcatatccgtccattattggcatctgaatatccattaaaatcgcgtcataatatcctttctcggatttcagaaaacattctaaggtttgatttccgtcaacagcagattctacctcagccccagtcatctttaaaatctcaaccgctatttctaagttcagaggattatcctcagccaaaagtaacctgtgtcctgaaaaatcgtaggcatttgttttcgcttccactttaggaatctcatttttgcttcccgtaacctcaagcaacgtattatataatgatgatgcaaaaaacggctttgacaaaaagctattgacgcctgcttcacgcgctttggcttcaattcctgcataatcatatgctgtaataataattatcagagtatcatgacctacaacagactttattttttcagcagtttcaaccccatccattcctggcattttcaagtcaatcaggcaaacattataatcctcgtttatatcatgtgattttttaatctcgcttaccgcttcagctccgctttgaacccattttgcagaaataccgaatttttctaaaagcattgaagcgtataagcaagctgctttatcattgtcgcacacaagaactttcatggcgttcatagacggatacttaacggacgcactatgcttatttgccagttcaaaaggaagttcaacagtgaacacagagccctcgtctaaacggctttttacagagattgttcctcctagtaatgtaacaagattttttgttatagccattccaagccctgtgcttcctaacctcggaacgctatccaggttctcctgctcaaacggaagatatatcttctttaaaaattcctcactcattcctcttcccgtatcgctgacagtaaatcttaactttattaacccctttttataaggcagctgaccaacgtcaaggcggattttcccatctcttggagtaaacttcagcgcatttgacaacaaattcagcaaaatctgattcacacgcatagagtctccaaaaagctcttcgtccaaaacccctctgagagattccgtaaattccaatcctctgtcagacgcctgcggatgaattatcgcagttaccgactccaaaagctgtctcagactaaatttttcatggctgacagtaagatttccgccttctatctttgacatatccaaaatatcattaataagagacagaagatgcttagacgaataacttatttttgccaaacaatcctgtattcggtcatcgtttccaatgtttgccgccgcaatagttgtcatgccaataattgcattcatcggagtacgtatttcatgcgacattcttgaaagaaaatcagactttgcactgttagcactctccgccgtcctcagagcatctttaagctgctgtgcctgaatctccagctttttctgcatttctctcaaatctgttaaatcggtaacgtcaatataaagcaaaagatatacaggatagccatctatccaatcaacacagtcgccgtttatctgcatccatgcagtttgaccgtcatagctctgaagcttggccagaaaatgtatatgttttcccttttttatattttcattctgagaattgataacatcgttattggtatccatattcatctgaagcaatctatctgaatcaacattggttccgacttcgccaaaaaaaccataaaaacggtcatttgcctccagaagcttcagttcaaaattatctttcacaagaaattttgccacaaaaccgggaatattattgtatgtaatagactgcgcttttttcatttcaacaaggtcgtttacatttgttataacagtataggatatgggataaccgtttacataagtatcagtatatatccagttcatccttacccaaacgtgtccgccgcccttaaccggcattctggttattgtgctgtactgagatagtcctttttcaattgtctccacaaccaaatctttaatcttttgaagttcatcctcatagtgatgatatttgtaatataagttagggcaattatgaaactttgcttcatattcttctttgcgataccctattaggtcataataaaaatcatttccccatatcatagtaaaatcatcatcaagcaaatgcttgctaacactgacctgcatagcgctcataagaagattataatccgaatcaaccgcaccgttcattaagatatcattcttgtttaactcgtttttttccatacgctttgcctcctttggttacacatatcactcgtccgaaacatcattagtatctaatttttatccgtttttaaatccgtaatattatgacaagctataaggcaagcgtctcgattaccccatcgtatacgggaggcgtccgccatagaccaaatatttgacgcagggttgtaaatctcaatagttttatttttatcctcttttattccgttcatagggcacatctcacatggaatatccctattataaaacgctctgtaacatttcatgcccaattttgcttcaggcgctatttgctgtatctttgcattaatatatttaagttcatagctgtgcgggtcaagaacatatatccatgagttttgactgtcaagtatcattctcaaatcccgggctgcgctaataactcggtcctgagcacgttttttcagaagaaaagttgataacagttccgagataaatatcaatgcgtctatttgatttttggtccacatacggagtataacacagtcgtcaaagccgacaaaaccaacaaacttttcaccgtctctcacggcgcattgaagcactgaccttattccctgcggaagcaaaatattataaagctcctttgacaggtctgatatatcctgacaatagaatattccgttctcatcaaagttatcacgataattcttacccattctctcatagctgatatgctgaagattatcaatctcaggctcaataccgtcgttgcaccactcaaatgtatttgaaacataatttccgtcttccgagtcctcaaaaatatatacccggctcacattataccgccgtccaaccaattccagtatagaattaaccgcttcatttatatcatcagactcataaagcttttggaaagcaagaggaacaatgctgtctatattataattatccgaatcatcagaatcaatctgagtcccggctgctgaaacttgtttctggtacaccccaaaacttttcatcatagagctgtcgtcatacactgcaaactggtttttgccgttatttttcgcatgatacagagccaaatcacaacgcttaaataatccctgaaagtctgttccatcattgggatatatagaaattccaatactggtagtcaaaccgaatttctgaaactcgcttaaatatatatttctaaaagtttcaacaactctctgtgctacttcctctatcattgtcaaaccgccggaacattcaataaataccaggaattcatcgcccccaaatcttgcaatgatatccccgttattaaacgtctccgtaagcctgaaagcgctttcagccaaaatagcgtcgccgaacatatgtccataataatcgtttatttgcttaaagttatcaatatcaataataagcatagcataacttttattctcattattacgttcaagtctgttctgaattatttgaaccgcagtctctttattatagagtttagtaagcgcgtctttttgagccctgtccgacagctcctgtatacggcgtttttcagaatctatatccagtataacccccaccgctttgactgcctttccggaatcatcaaactgagttgtcatacgtatgcggcaccatatatattttccctcggctccggctatacgaagctctgcttctgcgtacggaacgccttttatcactttttgcattatcttctgcaatgcaggaatatcatccgggaatatatgagacagcttttttatttgagtgaaaatatttcctgatattggttcatagccaaatttgttcttccaattattcgaaaacttaacttctccgctttctatatcaccctcaaaaataatatcattggtctggtcttgtattatacggtaacgctccatggttagcctgagttcttcctgagattgcttaatttgtgttatatccgttaaaacacagttaagatattcgtttccgtcttctcccactacccttttgcttttatctaaaatccaaactgttctgccgtctttagttttcaccctatattccagttcctgcgtgcttcctaacgaaagctgctcgttaaaccagtgccttaccgctatatgatcttctgggagaaccaaatcaatataccggttctgaaatttctctttaatttcttctttactgtaaccaaacaaagaaataaagccttcatttatatatgtcacagtaaaatattggtcattcatacactgaagtataccggcaggcaaattttttgaaaccgaagcgccggacttctcgggtttcatattctcaatattagaaggttcatcaatcaagcgccaaactatgagcgctttatgactttttgggttttctatattcacgcgaacagccgcagcttcataccacacatattttcctgaggctctgtgaaacactctgtatcgtgttgaagattttattaaaccatggctgaaaaaattatcaatttgattttttagtatatccaaaactaactcacggtcattgggatgaactgaactctcaacaaaattaataacggcttcctcaaaactgtttccagttttaagcgcctgaaaatcatcgttctgctgataaaccaaatgataaattccgctgtctaaatctatttcaaaaactgtcgaatcaacataacgaagcattgcgaaatattttatttgatcctgagcatacatattatcaatgccggaatgcagcggagacggtacagacaaagacttggcaaaatcaagcttcggcgaatgaccgtcagcatattcccgggcaagctcaaaaaaacttgccttaacattcttcaagcactctaacgtctttggtgaaaacacaccgcactcaccatttaaaatcatagtcatcgctttttcaggttctatagctctcttatacaccctgtcggtagtcaaagcgtcaaaagcgtccgctatgccgaccacctgagcacaaatcggagtattgtctcccttcaagccgtcaggataacctctgccgtcccagcgctcatgatgatatcggcatatattataagcatacctcaaatattcatcatcacctacacggtcaagacccgaaagtatttcacaccccttaactgtgtgggtcttcattatatcaaattcttcttttgtcagcctgccgggcttatttaaaatagtatcaggtattgatattttacctatatcatgaagagctgccgcctcagagataacacgtatggaatgctcattaagctcatattcaggacagcatttcataacctcttccagcaacaccttagtaaacatacgtatacgcaaaacatgctgtcctgtctcaacactgcggtgttctatgatagatgagagagtatccattattacgtccctggattccctaagctttgccgcctgttcttctaccatttcctcaagatgcattttatgccggttaagctctacagcattctgaaccctccgtctgacaacatgagactcaaacggtttgattataatatccgccgctccaaggtcaaaagctcgcacttcgttttccatcgagtcaaccgatgtaataactataacaggaatttttgtcatcaatccgttttgagtcatttctgacattacctgatatccgtctttaacgggcatcactaaatctaaaagaatagcagcaagcgagtccttatactggcgaatcatcataagagcctgctctccgttttcggcttcaagcagattatattcctgctcaaaaagattgcggagaattgctcggttgatttccatatcatcaactatcaaaatagtatctcgattcattatttttcctccatagaacctgcccaaaataacacaattgtgcatcatacgggaaaattcaattcattttttcaatataaataaacagcttaccgagtttcaggtataaaatacatatttctgccgtatttccgtttagtgtataaatacccttattttaatttttagattaaagaagtatatcacgcagcatcatttttgtcaagaaattagacctccgaatatacaatataatatatgaaaataaataaaatattttcactcattatttcataaattgtttttagtataaatatctcttattttgtattataaagtaattttaaaacctaacacttataaatttttttgaaaatttgtgaaatataaagacaaacatataaatataaaatttcatatttacaacatagaaatcaataccacgtgtaaaccggcagcatactcagcacccataaaggaaaaatacattcttaacctcaaaaatcgatcgaaatttataaaccattactatctcagacagccgctttcgtacatccgcttttttcctgctttttatttctatttaaacataaagattattccactggaatttttttatttcgccgagacttcttattttgaagcctcttcttttctggaactcctcttttgctggagtctcttcttttactggagccttttctttcaatggagcttcttctttttccgaagccttcttccttttccggcgttttctcttttactgaagttttttctccgttaaaatgtagagttatttccacaccttaaggtggaaatcataaaacccataagatcaatatcttatgggttttaataaaattagaaattattgggaagaaatctaataatttttattaaataaaagcgttaattgtttgccgtatactctactttatacacatttaatccgctttctttggaatagatgtatacaggagcacccgcggcaatatccaccgtcattgtctgagttgcgccgaccgcggcttcctgcagtatttctgtaccgttttgatttaccgccataaatctcggctcaccctgagatgacgcatgagcaaaagaaattgaaagctttcctgccgcgccgggtgtgaacgccaaatgctggtcgctgacagaacccgctccggcaagtttcagtctctcagtaaacttatcagtgccgatagtttttgaactgtaatctactacaattgcctttttgcttggattaatatataaattatcatatataaccaaaccttcagacattgtcaatgtatcatgctttccgtcatttccttttacgcctaaagcttccattggtacaactccaaatgtccaagtatgcgagccttcttgtgtctccataggataaggtgaagaagtcggagccgacgtcggagcgcttgtagcgtcagggtcgactgttggttcaactgtagggtcaggatttaccgacggttcagttgtagggtcaggtttatccgttggatccaaagacggcaatggtgaagatgaactcttttcaatagtctttgccacactgagcggtgcaatagaattataattattccatatcaaaactttaaccgtttcatttgcaggctcagtaaatccgtttatagtatacgtaccggttcctgatatgtttattgtctttacatttgtcataatacggtctgtgctgtaagaaacaaccatcatagaagcctctccgctgccgctgccgttatactgaacattaacgctcaaaccatcgtttgtatactcagttgaaattatctgatagtcaaacgacgccgggtcaactgtcggcacaggtctgtttgtcggttttgccgtaggattcggaccgtctgtcggcgccggtgcactggttgcaaagcctgctccaaagaattcagcctttgaaccgtctacaaatccataatatgttttacctgcttcaacagctcctgatgtgctcttatattcactcgacgctgaagcatttgtataagaagctaccgtgtttccgctttcatccataatatagaaagtctttcctgcatttaccttataataaactataaacgttccgtcgctctccggtgtgaatttcagtgaagctcctgtctttccgtccggtgaagctgctgtcagtccaacacacttacctgtaaatgctactccgccgattgtctgcttcttctcagtatatgtcatattgtctaccgggcttaatccaggtatacctatagtctcacctgctgtaatattcgctgccggcttccaatatgttgtcttaggcgctgctgttggaggcgctgttggcaatgctgtggcagtcggtgttggctgcgtcgggtcaagagttggtcccggtgtgtttgtcggtttcggtgtttctataggcttgatagttggttttgaggtcggtataggaccgtcagttgttgccggatatgtctttccgctgacaatatagttccaagccattgatgttgtgtattctttcagttttgcttccaatacagtatcaattgcatagctttcatcagctacagaatcatcgaaagtataaataaagtctccgccctgtgttctgccggcaaaagctgttacattgcccggaacattttcagggtcgtcaggtgtatatgtatacattgctgcagcagtgtcaaaattgttatactttgttccgccggctactgtaacatattgctcaggaaccttttcatcacggctatatgctatatatgcgtcaaaacctgtctcaatcggggttctcgcatcaactaccggaactgtacggtcaccggttatagtattattaaacatttttaccataccgccgtcttctcctgaaaacgttccttttccaagagcgtctgttccctgtcttgaagagagaacaggatgatagcagtttctgaaataattattttcaacaaatgctgaaccgccggttgtaataccaactccatactttgcgtttccatcaaaatagttattgtatatatgtattgttccaactcttattctgggatgacgtgaatccgagtggtcaaaccagttatgatgataagtaacaaagaattctcctgtgtttgaatcctgatgcataccgcaaagtgaacactttcctgaatcaaagaaatggttataagacactgttacatatgttgatttgcctttaacatcaacagaaccatctcccttttcctggtctccgcctttgttctgtccatagaaaatatcattgttatgtacccaaatattagtattagcagtatcaagtgagataccatcatcattgaatccctttactccaaaatttcttacctcaatgttatttgccatccttattaggaaactccagccattaagcatagtatcgtctccaataccttcaacagtcacattataacatcccttaacctgaatatatctatcaccgttaagtccgcttacatctgtagagtttatcataccaataaatctgataataagaggtgttttatcataacctttttcacggcctgccataatattggctaatcctacttcatgagtagtgccgcctttgctattggtaacaacatctaactcaactgtgtttattgtatccttatcaatataaagtattattgcgtcatctccgggagttccgttatctttataaccgcctgaagctgtcttgttcggtgaagccgggtcatgagcataaccgtctctgttgtgagccaaaacattaatcacttctgtctcaacagccccggtctcagatccatccattacagacgctattttaatggtatattgacctgcttccaatcctactgcgtctactctataatatgaaccatagtaacggactaattcgtcgtctaccttaatataatctgtatccccagcttttttggtatatacattatatttgtctacttctgccgtatttgtccatttaacaacagctgattcaagccatcctgcctgctcaataattttaatatccgacggcagcggctcaacaggtgaaacctgtaactcattcgaatctgtagaaccgtttttatttgaagctttcacaacatatttatatgctgttccgtttgtaagccttgtatcctgatacgttttatcagtaagccctgtagctatagctgttccgtcgcggtacacatcatatgaaaccgcatactgagccgctgtccagctaaggtttaccctctgatttccggcggttgccgtaagagtgaaagttcccggaggttcagtaggctctttaggagtggctgtcactgtgacgccggcgcttgaacctgccgagtttacagctttaaccacaaatgtgtgttcaacatcgtttgtcagttcgccaatagtataattagttgatgttgtttctataggaacacttgaaccatcaacaaatatataatatactgaagcaagacttgaagcttcccaatctaaatcaacctgactatcacctattgacgctgttaaattagtaacatcagcaggaggttcatttgattcaacagtgaataccgctgttgaaagataagcatgattagcgcttacatccactatggtacccgttccatcatccatcttagtaggcactgttacagccgttattttatatgtaccggcaggcatattagacaatgttaaaccgtcctcagcagattttcttccatacatctttccgtccggagctgttatcataaagccttttgcattattgctgtgtaaacttgagaatgttgcgctccatacgctgtcaacgacgaatgtcaaagcgtcagttgatgtttttgtaatctgaacatatgatttgctgtccgaggctgcggctgacaccgtgccagaaaatccttcaaatccctctgttccttctgcaagcgtcttagtggtcaattttgtaaaatcatacactgtagtgccaaccggaacgaccgtgccgcctaccgcgttaacttccatgaaaccaagtccggcaaacaatgttatcatcattgccaaactcaataccatagcaatagtttttcttgtaaaactacccattagaaattcctccttaaatttttatatcttttcaaatatatttggtgtatttatactaatacataatttttttaaattcaagtgttttttaacataccgcaaaataaccagtaaagtaaaacaagaattttagcctcctattttaattgtgcaatttgacgatgtttttttcattttatcacatccatattattaaaaacatcagtttttcggaatattcaagcacaaaaatatgcacaaagcatatcgcttcaccattatagttgtttagttttttggcatttctttatttttttgccatttctataaataccagcgaaagtgctttagaataccaaatgttaaaaaaactacaatatatactgataatttaaaatttattataactagatagtgtattagaaaaaagaataaaatatacccgcaaaatttataatataataaaaattttataaaatttacagacgaaaaatatcattaagtaaatttaaaatgtaaagtcaattcgactcttaacatattattatttgattcagcagaaattctgtaaaatccgattttaacaatttatctaaaataatagtttaaaataaacaaccatataacagtgttaaaattttaaacatctgccattaaatataacgtttgaaaattaacataaagccagacagaaaaaaattaagaatatttttagagaacatcaactgtaccgtaaaaaagctacaataaattggacagataaattaagtttatatattataaaaaagtcccataacagtgcttaaaatactaaacatctgctatgggatataatttttattcaatatactctctaagcctaaactttacaccgcagtcttcagctatctttctgcatatctcaatgtcactttccggtatagttttatctaccacactaaagacaacaagtttaacataatcttttgctcttttcgcaaaatcctgcaaagcctcaaaagactcttctccatatctgctcttgcatatatcctgatattctttagcgtttgaagcatttaaactgattcctataatatctatagcgccatcaagctccggagtgacatccctgccgttaataagatttgcctgaccgtttgtgtttattcttataacagaatcagttttttttgactttatccatcttgcaatctcaattaaatcgtcaaacctttcggttggttctccatatccgcagaatactatctcatcatattttgataaatctcttttctcaaaatcagcttttatctcctcgatactcggctccctatccagccaaaggtcatcctttccgttaacattatcatgttttgtcctgacgcagaaaacgcatgcattcgaacagcggtttgttatgtttacataaagtgaattatgatattcatatgttatagtcaatattctctcttcctttcaaattcaatctaaaattaaacaagcttctcattttttataatctgataaagcgccaaagctatcagttcaacatccacaagattgtcattattccccgctgaatcacgcagcctgagaaaatctccgctttcctctttggcggtcaaattcagcactactgtaaatactgagccgccttcttttatatttgagacaagaatttttccatccatatttccggccagtttctgacaaaccaaaaggccgtatcccttatatgacctaagcaaggtcttgctaccgtcaaaaacgtcattgatgttccgttccataattgcatgaatctttttcaaatcgacgcctataccataatccacaacagagattgcaatgaatttttcttttttaaaactatttaatataatatcaacttttctgttttcagagtgactgtgaactaaagcgttaacaagcagattgaccagtatatgagtaagccctgtctgattaatactggcgtataaatcatttcttacgttgttacgcaaagaaatatttctgcacattgaaacaggcagacagttatgcacagttttaacaaactcatttaaaaacgcactgatttcaaccgaatttcttgtttttaaatttatgccatatttcccctgggtaagctcacatagatttcttaggcgcaaataagttgttcccatagaagaacttgccttatatataatatcaatattatcaggtttaagatcctcagactcgaccaggagtttaagaagatttctgacataatatgtattatcttcaataagttttactatataatcaatatcgttttcaaatgttgaatcaaaggcgcctacacgtaaaaccaacttttcgttttttaaattatttgctaaaaatgctctgagatttttagcgcttaactttccgttttcgcctatacaaagctctttaacagaatcgttcatatcgggcacccccaaatctttagaatataataacacattttatataatttttcaacagtgatattatattattttaagctgaaaaattttatctactatccacttttcttagcggctgcttgatttaaatatactttcagcaaatagttcgatattataaacttcttaaaggatactattattctgttctcacttattccatatatattatcccattacttacttgcagcatattcaaataaactaaatatatccttaatgaatctaatattttgcatctatttatatattttcctgccgctgctaataaataaaaagttaaatcattttcaaactccagcattaaatatccaacatcaacacaaatcaacaaaacctgtaaaatgatattttatttttttatactatctcaattcatctcgcattatttataccgctctgcccggtccataatattccctgtttaagtctttcttatatggtcagcttgactcaatacatttggatatcaatagtatacagtactttaaactaaataaacataaaaaactaaaacggagctatataaatttctaaccatttaaaattaaagtgtatgatgaattttattttaaatagttatttctttatatattcaaaaactttctgatgtttttactccgtttcagttttttatgtgcacgcttgtatatatttacatcgcttcttagtttcctgaggatgatgtttatagctgcatccccaggaaacatttctaatttattagaacaataatagcagtgccaaatatattttatctatattataatttttttaaatccccattttcttgtctttcctctattattacacttccatccatagggtctattattacgactacattggatgtatttaatatagtaattaaatcatttttatcttcttcattcgcattgaacaaaagatgtacctcatatacacaatctgcccaatcagcagttggctgtaaatatgctgcatagtaaaaagaattttcatttatataatctgaataatattcctctgtaatagctttaccaatttctaaagcagtctctgaactttttattaattgttcatcttttcccgcttgttttaatgttatttccttactctcctcactccactctacatttttagaaataagtttcgccaaatcccttaccgaaatatatgtattattattatatgaaattataggattttgtaaataatcgcttatacgtccttttattgaatcaatctgtccaaatatagtataatcaactatattagcttctattgtttcagtagttagcgcaaatgtcaccatacttataaccataactactataaaactcaatacaataataaattttttcataaaatttctatctcctttcgttatataattctattgttgaagcaattatactttgtataaaatttgattaaatatcaaaccatttagcgaatcagaaaaaatattactgaataaaactatttgtaatttagtttaattaaaaagtcattaataaattatatcgtaaattattattatagtttcatacgcataaaaaactgaaacggagttatatgtattctctaactatttaaatttaaggtgtttaatggattttattttaaataattaaatatttttatatatacaaaaactttccggtgttttttactccgtttcagttttttatgcgcacgcttgtccagcttttgagggattaccggagtgtgtaaatcactttacacactccataacaattttagtttgtataaatatctactctctgtaattcttcatcacacttaccatatacactttaattgcaatttttatttgcatacttaacattttctatcttcacactctttaatagcatatattgcattatcaaaactcataacaattagtttaaatatccttagattacactaaaagttaaaattttaatccattatatcatgtatctcttcaaaatcaggtttcgttacgcttggtcgtcctattcgcctataattatacatttgagcataatcacctatttgtctcgtatgtatatataatgcttgattaaccaagtataaatattcatatgctgttatattttcttctaactgctctggatacacattcatttcatattcacttattgcatttttacaatttattattccggtatctatacaaaattgataatatggattagttacattcggataattttctgaataatatttttctatgtacaaatccgccaaaaagctagaacccccagaagtcgacagcattttacatattgttataaatgcttcattatatttcacgttatcatcaaaatttgcatataattttccatctcgctcttctcctgctaataaattataacgaaataaactagccgctaatttatagtcatatgataatggttcaatatcacaaaattcaaattttcgtgccgtcctgaattttccataatatccattcatcccatttgaccaagaaatctcttcgagttcactttttaatctttcactagaataactattaacccagcttataaaatctctacttgatgtattaaatacatatgctatttttaaagcatctctgcgagtgattaatgatgtctcatcccaacgtgtttgtacatctcgaacaatatctaatcgttcaaggttttcgattgcagctatctcattaccaagtttatactgttcttctaaattatactctgtatcatatatattttctgcaaaaacaaacgtatttgtcaacaatattattattagcacatatactacttttttcattattttatctcctttgctcttgaaataatgtcataccatataaaatatgtattaagtaatgtcacgccaggcatactttcagttaaatcgtcactaacttcccataaaactgtgtaaggcaaattttgtatccatgccccataatcgtttactcctcctatttcacctcttgatttatctcttttagaaaaacccatttcttgacggtatctttcttcaacagttattgctattgcttcaccatgctttttcttggtgtcaatatttccaaaatctttattcactgcaaatatatttgcagctttcatagcaccaaaaacctctgaatatgtatgagctgcttcgtgaattaatattgttgaatactcattcatcatattgacatctgcgttatctatatctatatttatcagatctatataatcaatccctgcagatgaatcatatatacttttttcatctgagtttgtaaaactaactttaatttccgaatcactacatattaaatcttttaatagcgctttccccgtctcacttccagtatctatatcatcatagtcccaattatctttatctataataattgaatcaccgttagttttataggctaaattaaaatcatcactgccaaaaacaatttttgctaaagcattcaacttaacatatgactcttgactcataacaaaatataatccccaagggtcaacaaagttcacaggattattaccgcagtacgcgtaccagttcaatccgtcttttgccgggtcttcctgcgtgaagcgtccttcgtttattttgtaatacctgtttctcagatataccattccgctttcgttgtcctggtattctccgcagtatttgaacggcgtatttatataactctttattgacgttctattcccatacgcactatagtcacatttggatactgtcgccccgtttgcgtccgtcagcgttactgtgttcccgtgtccgtcatatacatagtagttcactgcgtttttcttattctgcgctattatatttattcccctataatacgttaccgctcctgttccgctgtatcctactatgctgcttccatcccaacggtgcgttggtcgctccatcgacctttttgcttgctctccttcctatcgcatcatatgtatacgttgctgtttctactaatatattttaaaattctttttaactatatgctgtgtttctatttgcgttatatgaaaaatatcttttattgtttccatcttttatttttaattaaacaagctataatccaacccaaaatgataattattaatgatgtcgtaatctgcaacataataatatgtactgtctcgctgtcagggttccataagtttccggtggaaatcccccagttaaaataactaattatatgtcccaataatgtcaggctaatcatcaatagtaaaaaatataaaaacttgcctatgctaaccttattcaaatatttatagctaattattatcaagtatataggtataactaacgttcctaataatagctcaattaatgaaacaccagcactgctagcagaaggtatatccagaagccaaaacggtaaaaacattaaatgaacaataactggtattaaatatatcaaaatataatttcttctcattagtcatacaacctcgtaacagcatatgaatacatgcctttattgtaattctgtgcccaatcacttcctagtatttttatatacgcataaaaaactgaaacggagctatatgtactttttaactatttaaatttaaggtgtttaatggatttttttaaatagttaactaattttatatacacaaaaactttccggtgttttttactccgtttcagttttttatgcgcatgcttgtccaactttttggttaccggagagcgtaaataattacgccctccgtaacaattttactttgtataaatatcaactctctgcaattcttcgtcccattctacctgacagccaaatgcttctgataccgctcttaatggcactaatgttctgctgtcttccactaatcttgcaggaacatccagttctatttcttctccattctttagcatcctattactgtcaattgtcactgacactgttattccctcctttgttgctgttgccgtttgggtttcattttcccattctacttctgctcccaatgcttcgaatattgctctcattggtactaatgttctatcgttttccattactgattcatttaaaaataatgctttttctatattagtatgtaatattataacatttgatatgtttttattttctaaatataaatcaactcttttgttatctatattcacaattatatcgctttttttaaataatcttgtacaaattttattaaactcttttggataaatatacatatcatcatcaaatatttttaaagcagaccacgcacaacaaggttcgttatatttttcttcatcaattatttgaataccgccttgagttggaaaaaaagtttttaaacttttatcactatattttatattaaaattctcttcatattgactaatttcacatcctaaatcatttaatatatttatatatggaagccaaaaacaatttccctctatcttacagtttacgtttaataaaagcatattatttaaataaatctcaccgtttttaacttcataatgtttaatataagattcaatagtatatttattgtaagaataatctttataaacttttttatcactaagctcaggactaatatttgcattaacttcaaacatatactgtgctctatcagtatttaaccataatataatacttggattatcggtattagaatctatatcaaacaaacaataatctaatactttaccatctattccaaaataatttgaaaactcttcaaccgattctattttagaaaaagtctctatcaaatccggcttgaccattatcataaaacttccgcaacgaggataactatcatttaaatcataaagatgttcaaactttattttatccatactacttatacgttctaaaatcaaattctcctccaataatatatattctttaaatttgtttgaagattcttttaattgcttaacattaacattttttaaaaacgtatcaaacgaacttttatctatagaataaatttttattgattgctcatcgtactcctgagcttcacatataaaaaagtgtgtactaaaaacaaaaataaatattaatagtaaaatttttaatttcatacgaattatgcctccttattaataaacaaattcgacagtatatataccgaccaataatttatacgcttgtcccactttaattaatttctctaaggatgtaataaaaatacatccctagatttattaatctaatccatcttttaaatattaaacagaaaagcaagtttacacactatcaatatgatattatttttaatttatttttttcataaacataaaaccatttttataataatacagaaaatcatctagcaggtaacaacctacattttctccatatttgccattttctctaaagcttaaatcactgcattttaatcctagagatttagtttctaacgtattaatgttatatacatataagtttaaattgtctcccggaaaagtaataaagttatcatttatatttataaattgttctattgataaaataccatcattttttaatattttaaaatttccattttccatttcaataacctctattgctcctccatctctaatataatacattttattttgatttattaacaacccaaaatattcacttttagtacagtacaattcaacattgttttccccatctaaatcactttccattaatttatatccttctctatcttttgcaatcattgaatatattttatcatcgtatatccaaaattttaatatcttttcactttcgtcgcttaaaacttttatgccacttccatcataattcattgataagagttgaaacatacaactattattataattgtatgataataggtatagtttatttttatatgtatataaaaatgtgacgtcatcattaaatagcaacttttcgttttccccttctttattcatagaatagactcttttgttttcatccacataaaatatttgatctttagttatatttaaataataaaaaattccttttttaatcatttctttattacttaaatcataattgcttctatataaaacagattctccaccttttaattcattaaaatataaattttcttcatcataacaaaaaagtccataatttaaaagatttcctatagaattaccatcatttttattaatgtctatattaatagatttatcgcaagcagttaatataaaaaacaaaaacattataaaaatactatataacacaattcttaaaattttattcaacatgtcaacctccaaactaaaaatatattcctgaataaattatatattagttatattttgtatttctatatacgcataaaaaactgaaacggagctatatgtattctctaactatttaaatttaaggtgtttaatggattttattttaaatagttagtctaattttatatattcaaaaactttccggtgttttttactccgtttcagttttttatgcgtatgcttgtccagatttttgggggattcccggagagcgtaataatttacgctctccatgacaatttagtttttataaatatctactctttgtaattcttcgtcccattctacccgacagccaaatgcttctgatattgctctcaatggcactaatgttctgctgtctcctactaatcttgcaggtacatccaattttatttcttctccatttttttgacatccaattctatttcttctccatttttttgcatcttattgctgtcaattgtcactgatactgttattccattctttgttgctgttgccgtttgggtttcattttcccattctacttctgctcccaatgcttcaaatattgccctcattggcactaatgttctgtcaccttctgttatcggctctatatcaaaatttaatcttttattatttaagtatatatttatttcaccataaacatctttaggttcaacatatttacttattctatttttatctacaagcaaattatcattactcaattcttttttattattataaactatgtatacatcacttaactgataaagacctttactaaatatactatctgatgaatctgcatattttagtaaactacatattaattttcctttatttacaaaaattttaacttcataattatcattgttatataaatgacccacatattctaagttattatccataacaattccattatcaaatactaacatattataaaaactatatacttgttcaaatggaaatccatctttaaaataataagatgtataacaatcacttgttaatgcagaaaatagtacaatgcaatgtgtatcattttcaacatttaaacataaaattagatctccattatttaatatttgacttgtaaaaatattaaattttttaccaattttatcacttaaatttagtgcgtttagtaattcaccttttgaattatacccatttattattatatcgttatttttttcatcagctctataatatatattatttttaattctattatcaaaagtgatataacctccttgacttacttccttttcttcttttgaatttaagtcatacttatttataatattaaaactattatccaacaaatattgactcttagtctttagattacttaattttaaaataacatcaccagtagaaaactctgcataaaattcatcttgtctaaaagaaatttgtacttctccgtaaatattaaatatatatattcttttgtttctctcagccataataaaaccgttatcgcaatacactattctctcatatataggtggaattatccattcatatttactatttatacatccatatttatagtttgttttatgctcgtctaaatttttatctgtcgtttttataattgcaataccaccctgaaaaattattggatttaatgttatattaccattattatctacaaataattcatttgatatatcattcgacatatcgtaatagtgaaatgtagttccaaagttatatacacctgaacaaaaatacattccaggacttaactgttcttttggaatgacatttttccaatttaactccaaatttttttccgcaatatcctcaattgtcatatttcttataacccgttcacttgcaaacacgttactacaaaaaaatgaacatataacaactatcaataacaatatttttttaagtaaatttttcatttataaattcatcttcctttctaatacaattttaatcttcataaaatcttttataataccaacctggagaatatctgtctaaaatattagtataatctgaataaaaaattccttgcgaaaaattacttattttataattttttatcataaacgctaaatctaatgttgatgatgatagacctatcatgttagttcgcgtcattaccgagtacgcatgaatagatttactcactggaacttgatagtgtcttgcatctctacaattatcattaatattaaaaaataaatgtccaaactcgtgagccgctactattttaaatagatcagtattaggatttatattttcgctattgttttgccaaagtacctttgatactccattaggaaaaatgttatttgtaccttgacttgtacttgaatccttataactgccattctcaattttcatatctttccttttatgtattccatcatctgttgtaaccaccttagtagttacagtaataccatctatagtgccactccaataattttcgattccttcagttgcatattctgaatatgttttaccttcataacttacattacttaaattcccagaatatcttacatacgcagttactgtaaaaccattttttgtttcttcaacttggatagcatcaagtttcttttcttcctttatagttccaccattgagtacaacattttttaacatatcctcataggacaaaactccatcttgataagcatgaattgcgctattaatatttattctttcctgtccaacaacttgaccttgatttgaacaataatcctgtataggatcttcatcctcaacatttaccagcccgcttgggtcaacaaagtttactggattattaccacagtatgcgtaccagttctgtccgtccattaccgggtcttcttgtgtgaatcttcctgtttccgggtcatagtaacggttccttaagtatatcaatcctgtctctttgtctgtatactggccgttatatccgtatactgttcccgttatttcctttgagcctccaaacgcgtcatactcgtatctcgtcagcatctttgtttttgtgttttctaaacctgttatgtctccgtgtgcattatactgataataacttattcccgcattatctttctgcgctatcaggtttattcccatatagtataccgttggattctctccagcttcgctcactatattgcttaatagcgataggtaatcctttgatgttatctccggattttcccccgccctaaaccgggcatgaacctttcagctcacccggcttgccatcaggaacagaatttatttcatctcaataactctcaacgtggacaaggcttcttaacttattgagtttttctttctgcttttggtcaaggcctaggatttccatatactttctgataatatcagggtttgtagcatgaatcaggtgatgtacatcttcacataccaacaccagattttgataattgtccttgccgcctaaataccgtggcactttgtgatggcaatgaatatcgccaatagaaagcactttgccagatacggcgcattttcccatttgggccgaatacagtgaaagcctgttatcgttgtattcgatagtacggtacagaaccgggttcctcattaagtaatgaagaaccgtcatgtcgattctgtccagattcttatggatttcggctctgccctcgggcatataggaattgattttgcggttcatggactttgggggcttgtgccgtatgtagccaatcgggacaactgcgtgtccggctacatatcggagctgtttgcttttcccataccgttccctgataactttcggaacttcacacggaatcttcctttttctgacctgttttgcagttttaacccgttctttcagtcttgcccgcaggctcttgtggacagataaggcgaatggcgtaaggtcatcgcagacctttgtggctaattgatagtagtcatggattcccattacataaacgttgtagcggcaaatcgcctgatattcagtacgtttgccttgtgacgggaactcaatgtcgtaaatcagccgttttaagtttggttttattttcgcaatagatttctctctgatatggctctctactacatatttggcgcgtccgttgctccgtttcccacgggggataacctttaacttgaaaccaagaaactctgaatactgctctttcaggttaatcaccttcgatttttcaggactgatttcaagagaaagcctttcatggagccagcttttggttgcgtggaataacttcaccgcattttgatagctgttcgtgaatatcttaaaatcatcagcgtatcggacgcaggtgacttctttcagccttgtcctccgcagtgcggcaaatttatggctcttgctcacgcttccgttgtaattgaccgattccttgtaagggaactccgttggtatttcttcccattggctggcaagccaccaatccaattcgtttagaactacattggatagcaggggagagataatacctccctgcggcgtacccacctccgggaatcctatcccggccacctccgcttttagcatagctgatataatactaagcagcttcttgtcttggattcccattgtccagagctgtttcagcagttttccgtggttcacgttgtcaaagaaccccttaacatctatgtctacgacatagtggagattgcttctctgcatatttttgtgaacctgggcgattgcgtgctgttggtttcggttagggcggaatccataactgtggtcgtggaatttcgcctcacatatcggctccatgacctgcaatacgcactgttgtatcagcctgtccataatcgtcggtattccgagcgggcgcttcttcattgggtcatttcctttcggaatttctacccgccggacgctttgtgggacataccagtttaatttgcgctgtatggcgcatataagctgttcatcagagagtgctgataattctgtgattgtttttccatctgtgccgggcgtcgtactcccgtggttcttcttgatgttgcggtatgccagccgtatgttttcgggtaatgcaatgatttcaaccagatgtttgaaaactttgcctttattgctgtcggcatacagcttatcttgaattgcctggaagtcataatactcggcgtgccttaacttatctttcttctttgcctttcctgttgccatagtcggttacttatccccactttcgtttggattttcgcctttcttagtcctactcgaacctatgcgtgtttattgaatatgattttgtttctgttcctgactacagcccgtccctccaccgcttactttgttcacggcttcacaggtagcatggctgctctttcctcccggattaagaacggttataccgcacctcccataaaaggcggcacgattttcccgcccattgcttcatcatgcgtatccactccacatccggggctttccacgttccgatattcctatctttgcataatacccttaaccctgccctttaggcctgtatgcctgatggtgcctgtaacaccatagggaatttcatatcgacaaatcttactttaccccacatacgccgttttcacggctatggcatttctgccatatcccgttatagacctgtacattcgggcttttgtcagcggtagtcagccgcattctggacataggtactttatagacctccggcctaacacccccggccacctctggctcggctttgctttatcccccaaaggggacagtcgcgggtgcagacagccgacttcagcgtgctgtgtcagtcgcgggaaatacgtcccgtttcttccaacgcagtatcaagggaagcgtttcagggcgttaccccgccattccacttctcggaatatcagttagaaaggctatagcctttccgtcacttttacctctttgcaggaaaatcccacgcagagtttatatgcgacaacgtgtcgctgcactgtcaaacggcgctaatctcgcgccgcacgaaatcaaaatacttttagcagtcttgccggctgccattttgtatttcttatactgctttactgcgaaatgctccggttccttttcttccagacggtcaaagagtaaatcaacggggcttttataattctcgtcgtcctcttttgcttccgacgcgtttatcatatccaaaagagttatgatgttcttttcctcgtcgggcgcttcgtaccaaatatagcctatgagggcgcaataatacaggcgttcagccttaacccagaaatcctcacttgacttttcgccctcgcctttggtattcgcaataagggtattaacgagcttcaaaatatccttttcgctgcgtatgtactcaaacggattatatttcatactctttttgaaatttatcgtattaaatgtttttatgatatatccgcctttttgtaacagcttcccgcactcaattaaaaccgtacctttcggatcggttacaacatagctgctgtgcatttgcattaaattcggttttatgaaaaaccttgtcttaccgctgccgctgccgccgattacaagaacattcttatttcttgcgtacttcggcagcttcgggcggctgtccattgtaagccgttccgtattcgtgagaagaacattattatagaaattctgtccgtcaatatacggggctatgtctgacgccgtaccccagcgcgccgaaccgtattcaatgccgtttcggtatttcttagcatttttacccctgacataaactgcgcacttaatcagaagcgcggctattactccgattgatatatcgattatgtggaacaaaaaaagcggagctttgtaaaactccgcaattccctgaaccaacgctattattttattaccctctgttatcctgtatatatagcatatcttatcagcaatccaaaagaacagaagatacgggatatttaaaagaataaaccttttgtctatcctcatatatcgcgctcctgttctttgcggcgggcgcggtctttcggattgatagtctttgcaagctcgcgcatttgagataacattttacggattgacggtttttcccgtaacagcttttgcgaatactcctgaaacgccatatttatgacatcaatatccttacccttgaagaatacgaggtacttcggcggtttcgtggaattatcctttttcaaagcatagtcaagtccgtactttttcgccaccggctcaaaagattttatatttttattcgttatctcaatatttgaaagcgccgcgcctgactctacaagctgcttaatcgtctgtttaccctgatagcccttgtttttatttttctgctgctgtcttaggtattcacgaattgccgcctgcaatacgcgccccgtcattttggaagcgcttataactaacgcaactgtttttttatttatttcttcctgtatagacatcactccttgcaacaaaaaagcggctgtttattttcaaacaaccgcttattgcttaatattctctgtatctgatttatggattatttcttccgccttatccaaaccgtttataatccactcgtcaaattcagtctgtaccgtatttgtcggttctatgcgttcctccaccgtttacaccccttatgtataatccaattataataccaatgcttttttaggacagaaatttgaacatttaccgcaccctatacacttgtcataatctattatcggtgcttcaaaatctttctgacttaacgctccaacaggacaaacattgacagcggggcatttatgattttggggacagttttctataattatttttaattttttatccataatattctttcctttcgatataaaatattataaagattatatcatatccggtcaacaaacacaatacacaaatcagacaattattttacccaagtttcgccgctctttccgtcaacggtattatgcgtattgcttgcttcaaggatttcataaaacgcccaatatgacttgtctttgaggtctgtaaatttatttacggctgacatattcttattgatgtattccgtatcggcggcgcgtcctgttacgcggtttacaatcgttacaacctccgcgcgtgtgatgttgctgtccggcttaaatgtgctgtcgctgtatccgtttatccagcccataccaacagcgctgtaaatataacctgacgcccaatgtgattttggtacatcattaaaaatattcttctttgccgccactgtcttagcgtccagcgcatagaacctcatacacattgttacaaattcggctcttgtaatatgttcgtccggcttaaatgtcttatcgtcatagccggatattaccttgtacttttcaagataggcgatatagttattaaaccaatccttgcttgatacgtccttaaatgatgatttacggcttgaaatattttcgcccttacgctctgcaatattacgggcgaatatggcagctgcttctgctcttgtcatattattttcaggcttaaaggctccgtcctcatatccgactacataagaattatgcgtgtttgtcggcataataagctgaccgtttgcgtcggttgcgccgctgacggaattattcttgtctttgagcgtaacatcaatacccgccgttgtcttgcccttgttatccgttacggtaattgtataataattatcgtcaagagttttgccgctcggaagcgtcaaagtgattttatcgtccttgacggtcttattgacattgacggtctttccgtccttatcgacaacctttacagtgtatgacggcttgacatatccgctactgccgccgcttcctcctgaagaagaaccgccgccaccgcctgttgaagtcttgacgggtacagtgattttaccgtttgcgtcggttgattttgtcgctgtcttattatccttatcggtaacagttacggaaatatccttgaccgctgtattatccttgccgctgacggttacagtggtttgattatctgtattgagcttgtttccgtcgggaagaataacgctgattttaccgtccttaacctcaacggcggcattttcgatttttgcctttgtgtcctcgacaatgacattgtatgtcttttctccctcaacaacctgtgcatagccgtttttgtctgtacggtctgtacttgtcgggggaacaatcgcaatgccctcactgtttgtaaggtcttttgcttccgttccgtcctttgcaattacggtaacaggtacgccgtttacagcttttccgtccttgtctgtaattccgataataattctgttatcgggagtgatacccttttcatcagggagcttaaccgtaacgctgccgttgtctttatcaacactgacgattgcgccgtttacagcgccgtcattgtcatttacagataccttatacgaataatcgggagtaacaacctcgcttccattatcgggatttacggtaggcttcggcttttccgtttcgctcggctgctctgtcgcgtccggcttttctgtttctgacggtttatccgttgcgctcggttcgtctgttgcgtccggcttctctgacggttcgggagtttcaagtccgggttttgttgtcagagtaggctccggcgtcggtttattctcgattatattttcattcagcggaggaacagtgatttttccgtccttgtctgttatctcggttctgtcgccgcctgcattgtcatagacatttacgcttacgccctcaaccgcttttccgtcattcgtctttacaattacagatgtacggttatggtaatcaatctttttaccgtcggggaggcataccataacgccgttatcgtcaacggttacaagcgccatatataccggttccgtttcatcttcgacaagtacgatatatccgtttacattcgccgtaccgtttttgtccgtgtacgcctgatttttattcggtaatgtagcctgaccgtttgcgtttgtaacgcccttttctatatagtcgctgtcgcctatgacaatcacgtttacattttcctttgcttcgccgttctggtctttgaccgtaacagtaacgcggttgtcgctgttcatagccgtaccgtcgggaagttttacgacaatatcgtggttatcgcctatgtgaatttcacaatcgggaatgacggtatcgtttttgtctgtaacggtaacaacataagtatattttgtttcgccgttatcgccgccgatagtgccgttttcattacccgttgagctctgattattcggaacaataagctgaccgcctgcgtccgtctgacctgttgcggcgttgccgctcttgtctgaaatattgatattcaagccctctgccgctgcctttgtatctgtacgaacaaccgtaattgtcgttctgtcctcatagtcaagcaatctgccctccggcagcttaattgtgatgttatcgtccttgtcaatgctgatttctgaattgaaaacaggcttgctgtccttatcggtaatcagaatactataatcaccgacttttgaatatccgtcctcgtccgaattgtccttatcggtaagctgggggatttcctcaatttttaaaactgtaccgcaatccgtacattcaatatgcctgctgccctcattctcaatcgtagcgggaacgtcaataatccaatctgacatcttgtgtccttttgccgatacctcgtcggctctatatgtttcgccgcagtttttacaggtgtatgttgtatagcccaattctgtacaggtaggcgcggttactgttgtttcgtaatcgtgagcggtctttgcctgctcgtttccgatatatgaaattccgcagtccttacaagtaaaggttgtatatcctatacccgtacaagtggaagttgtgattttttcctcatagttatggcctttcgcgtccgtgtaatccgcgacatacgattttccgcaatcctcgcaagtaaaagttgtatatcccatttccgtacaagtcggcgcggttacagtgggaatatatttatgctctgtcggctcctgctcgtcgccgatatattccttgccgcaatcggggcaagtgtaaattgtatagccctgtgatgtgcaagtaggcttaatcgtctgcttattgtaattatgaggaagaacctccgtataatcagatttatagctgtcgccgcaatcctcgcaagtatatgttgtatatcccatttccgtacaagtcggggaagttacaacagcattatatttatgctctgttttatccgtataatctgaaatgtagctgtcgccgcaatcctcgcaagtatatgttgtatatcccatttccgtacaggtcgggggagttacaactgaattatacttgtgttcggtcttatccgtataattaccgatatatgaatggtcgcaattctcacaattatatgtggtaaatcccatagctgtacaagtcggctccgttactgtttcggaataggtgtgtcctgtcggcagttcaagaatagcgccgcagctttcgcacttttgcggttcggtacaggtagcagcctttccgggtgtatgtcctgtcgctgaaattgcctgtatcatcttttcatcacaatgtttacagtggtattccataacgccctcgctctcgcaggtcgaattagttacagtgtgtccctcgtcccatttatgaccgcgcggctcggtgtaatcgccgacataggtatcatcacaatttctgcacttgtatgtggtaaagccttttgttttacaagtgggcgcggttactgtcggtctgtaatcgtgttttgcaagtggcgttaaatccgtaatgtacttatatccgcagtcgatacaaatatgttctgtatatccgttctttgtacaagtggaggcaacaatatttgtttcataacggtgtcccgtcattgaggtactttctgtataatagctgccgcactttgtacaggaatgtaattctaaaccgccttgctgacaactcggctcacgaattacaacagtattgtaatcgtgcccgcttgcgggagtataattcgttttctgcaaggctccgcactcggcacactggaaacggtcaaaacctaactctgtacaagtggggcgcactgtttccaaaaatctgaaatcgtgagtatgaatactgtttgtatttgagggcggattatcgcttaaaagccatacatagcttacgccgttttccgtcatactctcgccgccgtaggtatattctatctcataatatacgggataatagccctcgtcggtataattcggcgcgcttgtcttgttacactttttcgcttccgttccgtaacgaatacttgtatttacgccattctccgataagtcattgacggttacggtatgaggttttccgtcaaccttgccataatagctttgtacaacagactttgccgccgcgtattcgtttttcttatatccgcagtcctcacaatccgctgtaatgtgaaaacgctgatttcccaattcgccgtttacattttcggtgaagttgtggttttcctgtttgtcctgcacccgctctttcgtgcctttgcagaattgacaatacttgcccttttttgcttttaccgtatgcgtcctgctgttgtacggtatgtattccgtactgtcaaaatccaagaaaaagttgctgtcgcaggggttaagggaatatacatctttaccgcacgaatacgcgttaattccgtcaacggaatttaccgtaccgcaattctgacaaactgattttgtccaatgataccccgtatagaacgcgtcaacgccgggtgttccgtcgtcaagattgcctttgccttttccgtcaataagcgtaccgtccgaatagtagacgccgcgattatatgcggtttcgccagttcgtgtgtattcgggtacgcggtaggaaatgttgcttgtcggcatatcgcagacggggcagaacattgtacccgtagttactgttgcattgatgtcaaactcgcttgtgcgcccgtttgcttcaatccatacgtccgccggatcgacatattcgttactctgcgccgcataagtggtgattgagggaataacgctcaaagtcattcccgccgccattacagcggctaaaattctttttattttgtttctcatttctaaaaatcctccttgtcaagatttaaaattttgtattaaaaaacacgctcgcataggcggggcgcgtgattttgggttgtatgtaattttaattacctccgtacatatcgtgatttactttcaaggtgtaatagctgtcaatagtggagggggcattgaataacgccgcaagtaaatattttcttgtatcgtgtacgtctgttgtgttattcttcatacagtctatgacatattcgatatgctcgctgtttagtttcagaagtttggattttaccgtttccgcatttcgttcctcgcttgcaacggttaagtattctcttgttgtacataccgtttcagtgataatatcaacaatttcattcagaataccgatattgccgtttagcttttgacataaaatatcatactcaatattttgttttataagctgtctgtatgctaaaatcttatccattcctatccgttcaggctgttgtggttttacaggttcgccgttttcctccggctccgtagaattgattggataagtatttaataaatcagtatttgatatttcagtatttgatttattagtatttaattgcgtggacttgccctgttcaggttcagcctgtacaggattatccaatgttggattttccaatgtaggctcggtctgttttggttcgggcgatataggcaattcgtgtatgatatattcattttcgccaagctgccctttttcgtttctgacgcgggaacgctcaatatatccaaacgcttcaagctcattgattgccgagcgtatggcgtcaatgccctctttatttaaagttgctaagcctttaagggaataatcccaatcttcaggcaagctaagcataaacgataaaagcccttttgaccgcagggacaaatctttattttttaaatgatgattagacatcactgtaaaatcttttgttttctgaactctgaatactgttgccatagctgatatgctcctttcctaaatatcgacatcaaaaaaagacattgagtgttcccaatgccttatatataaaatattctgttttacttcggcaaaataaaaattttgtcgttcttttgttttttaattgaccgccttatgtatttatgatatactatctgagaatgtaaaggtcggtctttggtgcaaaagggaaataaaaaataccgtaaatatgcaattcacgatattttttaaacataaaattattttattttaaggttaatactgtttattgaccgctcaaaacccttgtgtttatgcgatttttccataagtccaataaggacagtcgcaccatttattaaaagctgtcgattaaaatcgacagctttttattctttacaaaataataaccttttaaaattactgcattttgtgttattcacacaataatttatatagtttaatatctttgaaaataaatcctaatattaaaaattctatttccggctcagatgtcggagccaaaggaacagaaattgcattaatttcacctttggctcgacttagagggataattacatctgcgccgtcccaaatatatagtttaaagatgttttccataagattaaatattacaaataaaaatttattgtttcctattatgtattaagaaataacttgttatatcttataacactttttgaatacaaatttataattatatctctgtacactactatattctaaatcacattttgtaaatttaacagagccagttaaaacaatttttatagtaccagtttatttattctaaaaatttaaataatcaattaacaaatatttatttatatagaaattatattatatttagaaattttttgttctctcttttcatacaaaagtcttttgtctatattaaaattacatcatactatggcacaaagccatatacagataaaatatatcctctaagttaatatttttaacattgataataataatctaaatttttaccactaactccatttatttttaaatagttaaatttatacccgaaataaaaatttcaaaaaccacacaaagtttttatatcactttatgtggttcttaattataacataatttaatccgtcaaatattatcagaaataaatataactattttctgtatctgtaaaatcaatctaaccgactctatacttatagtaatatattgcaaacctaaactttatacacatctacaccaaatataaaaccaggctcttgtacttggttaattatagatattatatttctactaactcagaatctgttacaggaacaatatcatccatctcttcaaatacaaatactttaaaaaaatctatattagtatttgatgtaaattgagtattaatatttgaatctgtactttttactatctgtattgaaattaacacacctttattatcataagccgctacaaccactgaggaaccgggttcaatatttgtgagcttggtactaagccaatattctccgttttccagcttaatttctgtatcagtataagaaacattcggcagcggtgtcggtttgtcggtatgtattggtgatgggcttggggattcaatataatcatgcttatgcggctgtttttctttgacctcctcgtctgacgcgtctttaaatgaaaaaactgcaaaatcttcctgattatttccggtatcagaacctatcctgattaaagacttctgctttgataaaccatatgaaggcacagtctcataagcgtcaattgacgaatctccattcttctccaccacaccaagcaaatctataaccgcaactgttgttgctttggcgttaatatcctcagaattttttgtaagcgccaatttgaacatcttgttatctataaccatatcatcaaaataaatatcagcgtcaatctttatcctggcatttatggagtttaacttacctccaatcaaataaaaatgtttcggttttataacagagttttcaggcataacaaatttttgccatccatctccaactgacgatgaatactgcaaagcataccctgaaatatctaccggaacatctagaggattatacagctgtacgcagcttctatccataattgcgtcagttttgcccccatctccgaaaacttgataaatcactattgaatctgaaatcaattttgccgtttcggtcctttcaaaaatggtctcaacagtctcatcaaccgacatatctaagttaacgcagctgtcatataccttttgtccatttattaaaaaataactaaatttatatccattctctgccactgcattaatttgtatcgggatattcttataatattgtgcggaatagtttcccggatttttaatctgccatttgttattggaacaaagttcaatattatttacctttatatatccttttgataaatccgagataaataacgcgttcaccatttcatgtacgccccatgtttcttttatctcatttcttgcggcggtttcccttaaattgatttgagattttatactgctgcgattgtcatttttcatgctaagcgggtatctgcttttttgctcggcaaccaaatgtgaaatattattatacatttcatccaatcttgacgataatatatcattatcaaaaatagtgttcatatagtcattataacgcctaattgtctcatttctaaaatcatcgttttccaaaaatgccgcaaacagctgactaagcttccaccccttagctgaagctgacggttggtctttgccatatattcggttttcaaggatattatcagtatttagctttccgtttgcctcaagagtgtagtcgttatcaagcatagcaaaccgccagcggtcgtcaaaatcattttgtggattggtatttttccaaattaccacattgttctgaggccaatcccaatttttaaaatacacatttgcaatcacatagtcaatcatattggacggatcaaagtatttacaagcagtctcataattatccggaaccttaagattgttttccaaaatccaattataatgctcaagatactcattaagatattgttcttctccctcttctagcgtgagaatatcacgaacaccgtcttcagatgacatttttagcatagcaacatctttattgtcattcaacttatagtgatatctaaaatattggtcatcataccgctcacgcaaatcatacataccccaaaattcaccgttaataaatgcaacagacggacgataaccctgtgtatcaaaatcaagaggagcacatatatcctggataaacgcatcctggataaatttcttatcccaatcatttccgccgtttcttagcataagacgcttatactttgttattataccacccttaaaatcagtaacagttccatcaaataaatctccttcaaaagttttcagaccgccgctctgatattccggattctcacgggcataaacacgaaacgatttttgctgataatttcgtgacgcgccgccatgaatacggatacccgccggctgggctatttgacaacttccgtcagaatcaaacacttcaacaaaagcgctccgctcataaagttctcctgattctaaataattgggcgacatatatattccattttgctttgaaaacaaattatcacgtttagtagtaatagaaataacttttactccatatctagtcaaaatatcgtcactaacaaaataagagtttacgaatataggagttgtagattcggcgtttacagctctggcctttataacggttcctttaaaaactagaccgtttggcgctttaaaactggttgaaacaccggaaatttcagataaatcattgggctgtgaagtacggttctctatagtgatgtttccattgtaaagaactgaattttcggttgggtcgcttccgtcagtcgtataatatatttgtgcattttcaagatcagtagaaagtgttaaagaaaaaggtttctgatacaaaccgccgtttacagaaaaaaacactgaacaattttgattaataataccctcagcaaatacaacagaagccgaacataccaaaatcaccgtcacgaataaaagcattgttagtttgcatatttttttattcatactctcaccccaatagtatatatttactaaaattataccatgaataaatatgaaatgcaatggatatgcaataaaatctgttaaaaactccgacaactatgtactgacgtaaaattgctcatgttgactctttaaagattactgttttttattttaataatctaattcatttctcaaatatcaaataaaaataatatataaaaactaaatatatttaataaagactttcctcattaaaataaccttatcaattatctcattcattaattcagaataattttcgtggttatcaaaatttaatccatatattaagtatttaattcttgaagcttttctattattcaacctttgccaatctaaagataatccaagctcactttcaatctcagttttattaccatataatttatcaaatagttctttattgttattaatatataattctatgacaatgctggattctttattgacaagattaatacatatatgtgcttcacttgttccaattgcaacattataccaattatctgtcgacacttttctgatattaaaaggtttgcccctgttaactacaagctcattaaacattgtccaaaatattactctctcggactgagttttactcatatcatttgaatcactgtttccttttgaattcttaataaaatcatttggcttttcaataatttcgaattttggagctggtatcgaatcgccaattttatatgcatgaagttcaattaaaaagaaatttaattttttattggtattattattcaaccactctattgcacttctatgttcctcacgcgcttcttcaactatccatacaatcacttgagcatcaagacctgacgcatatgttattatcttacctaaatgatcatggtttgaacattcaagttgattttctattattatatttatacctgttgcttcatctctggcaactaaatcacatctatatgccccaacatatacttctttattaatatctattaaagtcaatcctagaatatcatttaaaagttctatattttcttcttcagataaccaattagaaaaatcatactgttcgtgatgccataaatccctgacattaacttcttttaatctgcctaatttcataattaaaatcccttcttatttttaatataagtaacatcatattaataaccatcttcacataaatttcagctcctgcatatgtttaattcatagtatccatagattctactacaaaatttttgctgttaaaataataaaacacaaattaacttttatgattagttttacattactattataaataatatatcaaaaaaaatcaagatactttatatatttattaaactattaataatattcaatatcacttttgtctaatttaaatatatttaattaactaaaactttttaaatattttaagtctgtataaccaaaaattttaaatacaaaataccgtcagtattttaatactgacggtaataaataattcattcttttttaatgttactaaacatttctaatgtttttttatatttataccaaccaaaaatcccaccagcatacctatactgataaaatatgtaatattagttaagaagcttgctccaattccggcgcccaaacataagcctattgttaatccctcattcatataattttcaattttgccattcttcttatgctttttaataataactaaaattacaattacagaagatatagctgcaacaattacaggcagtagaactttgaaatattccatccccacactccctctctaaaaagcagtaattttgaattaaattttgttttttgctgctctgcaagactataattatttttgaatatacattgtttttgaaatgatattatatctaatttatatatagttatatcactgctataataatttctaaatattaccgcctccaaaacaattactctattttataaaacaattagtattttgagttaaagtagcatttttctagaaattatcactgttcttttaaacaaataaatttatactgctacccaaaaatcagcataaagaacgctgtttccgataatatatatagtaatggcacagaaaatcagaaaatatcatagcttcactcgggaatctacaaggatactatattaattatcttctatttttctattttcttatcccgcaacttctaaattgggaataattctttaaatagtcttcataattattaaagtattttatttttatattctttttcattgttttataaatagaaccatgatgtacaagttcttttataatacaaaacaaaactaggccagctgcacttttgctcgtatttttacttaaatttacagttaaaacggcttcctctacttaaacttatttttatttgcctaaatatttcaatataagttttatattgaaatattaattatatataaaattcaattctattaacatatatctatacaaccattaaaactttaaaatatttcatataatccactaacttatcattattataattctgtttatactttttaaatcctctttttatcaatgttaatttttatagaattaaaacagatatggataataattcgattattaaaattcaacactctcatatctattgagtcaataatagatttattaccaattattatccaccaattaaaatatataataaataacaaagttctaataactgaacaataaaatataaatacataaaaatagaaattatatattgacttatttgttttaattacttcattgtttgtacaaactactaatataataattaattttacaataaaacagagcgcctgagaaataatttctcaggcagcttttttgggaagaaatctataattatttattatttctcaaaattttatttatctcaatgtaaatttttctgcaattataagaaataatgacatcgcctcaaagtatattcataaacggcagtcattctctgtaaactgcagacttctaacaatgagtataagcatattaatacattagttattaaaatgagaagcattattttctatttcattttaacaacttatgtatttatatccaaaacctcgaatcaaaacacatattaacaatttgtcaatagctgacatctcatacataaatccataaataagtatattaaatcattactacaatccatacctgcttaccctataaatcgatattgttattcaaacctatatacactttcagttgatatatatataaatctgttttttcaataaactgcgattatgctagcattatataccaaagcaatgtatcggtcagttgacagtattgctgtattaactgccaataattgacttatagattgacggaaaatatatccgcatgttataataaatatattagaagataataaaataaagggaagataatatatgtttaatttttatgaggtacatcaatatgaactcgacgttgttcatcatcaccgggcgctcaaatataaaagccatctgcataacgaatttgaaactatatttctgttcgaaggagaacagggactcattgtaaacggctccgaatatgttctttacgaaggcgactgtgctgtaatttttccaaatgttcctcactcatacacacgtccggattccataaaaaaagttaataatgctgccgacagcgcaataatatttatgcctgctgacgcactgtatgcaatgtttcccgacacgcgcggctcatatcccgatgaatgtattatcaatgctgatatattaaatgaaaatgcggtactcgcttttcataaaatttttgaggaagcgagtataaacgcacaaataggttgggcgtatattatcttcagccatacaattcctctcctgatgaaaaacacacttctttcattacaaaattcagacactattactcgtctgctctcatatatttcattgaatttccgaaagagtttgacgcttgatatgatttccgacgagttgggaataaacaaatattatatatcaagagttttttcaaatcaaataaaggtcagtttcagaacctatctaaatgttctacgcacaaaccatgccgcctcgcttataaaaatatcagatgacaatcttgaagatatagccacagattcaggctttgaatctacacgctcattctacagaatctttaaagatatatatggcgtttctccatcccaataccgtaagatgatacgcaggtattcaatatattaaataatagccggcggcagatgataatcatctgccgcttaattttttattttctgctgtctttatttactgatatccgccgcacataacggtctcatagtatctgttgaactccacagcataacctttacactgtctgcaccgactgtactgaaatttaatggtgtcacaacatgttctccgggctctgtaaatgtcactggtataaactctgtacttgtcaaaatatcattattatatgctgcgaaaatgacagagaaagtaccggcttccggtgatattacatgcgcctgaccatcttttgtatattctatactgaatttcaaaggctcaggcgtcggacttgcagacggttcagacgtaggctctatcgttggacttgcagacgggtctgttgaagccaaaacctttacattacatgttgctgagaatccaccatcaacagtttttgcggtaataattgtatcaccaggtgaaagagcaataacctttccggaattatccacagaagcaatgtcactctttgaactgctccatattattcttgtatctatagcatctgatggatttacggaagctgcaagctgtttttctgcacttacgttcaattcaaccgaagcatcactgatcgtaataccttttgcacgatttaaatatataggatcccaaccattcatcatactaagtacgctgtaatatttttgttcagcttgttcctgggtcaggaagccatgcatattatctgttgtatttttaccgactgacgggtcgtttaaatcaaagacatacaatggcgcgtttgatactgttccccagccgccccagcctgacggccttgttactcctttgtcaactttagtgtttataagatagacttcacttgtgtctccgccccaattacgtccccacgcgattgaaccaaattttcttcctttaacatccgaatttttaactgtacagtctctaaacaaataatagccgttatttcctttcgcaccgttagcggttatatatccgcctccgttttggtcgctgtaaccggctgagaccaaatcacacttttcaaacacacaccaaccgccgccaaaaatatagtcgacgtttccgcttattgcgcatttgttaaaatatagtctaacaggtccgcctgtaaacaatgtgtcctgatttgatataattacacaattattgaactcactcttatcagctgccgcaaaaacagcaacggctgtagtctgcacgcttcttgaatcggcaggtttataaccggcgtcatttggcgtcagcattctgtcataaccgcctcctgtatcttcaacaccgtctgctcgctcttcgtcagtatattccacattaaatgaatttataaatttaatattttctgctttaaaatctgtcgcagtttcttttattttaaaagccgcaccccaatcgttttgaatatcatttttaacagattttgcaaccgcatagtccttatcatactcgcctgtaggaccaacactgtaatatctatgatatgaagcatagtaccatgtgactgttgccggattatccttgtcgcttgtcaatgtaatgtacggcgtagtaagtataacctgttccctgaaagtttctccgccctttaaataaatagtaacacgttcagcttcagaagctgggttgccatttgcctttacagcgtcaagagcgtcattaagcgttgcgtaatcacaattcgttccaacagttatatatttttttgtttccggctgaacaggatatacaactaaaacattttttattttattattatcaccaagtactgtaaaactgttttttgaaagcgtcgacagcgttccgtttttatctgatttaattgtgaaagtatacactccgttcggaacggacgcactccatttaccattcgaaacagtaatttcataatcttttgttccatcgttaagctttaatatgtcgccgtcttttaaatcaacaacatcaccgccgataatataatcctttaattctgttatggctatattttgaacctgactggttcccgacgggattattcctccaatatctgtagagtttgtttcagatactttgaaaacaccattttcatatgttccaaattttatcacataagattgtccgcttagtaactccgcagaatatgaaccacctaaaatctcagcatactgtacatcgcctgatgaaatatcattaaacattatacatccggcgtccgttcccgttacagttccggtaactgctgttctagtaagcggtgttgttgtaacggaggatgcataaccgccgcttataacatttattaccgcatagccattatcattgccgagataataataatcctgagtaccgctgaaactttgtccattcacagtataagtaaatgaagaagcatcaagcgtcaccttagtatccttaactacaggaactttcaatacagtacccacagcgccatctccggagccgccgttaatctgcattgctccatttcttccgtatgtatgaaatttaccggtttgtgtgttgacaagcatatatacatcagcgtcagttttttcaccctgcttagctccggctacagctatatcaggctgatgctgaacactatttatataatgaagcgattcaggtttatagccgtttgaagcgttccattcgattacgttattttttatagtttcataatttgtttcaggtaaattttgagttatcagctccgatgtcaccgttacatttgcaccgttggtatcggttaccgtgatttccgatggtaccgcctctactttatatgtagccggcgcatacgactttgcttcaacggtatatgttccagctccaagtgcggctgttacaccggttgactcatatgttttaccgttttctgtattggtaaagacaacactttttgtaaaatcatttttggttatgcttacaatttgatttccctctgtgctttcttttataaccaaatttttaaaattacccgtcagcccgttgcttccggaaacccacgaggtctgtaaaaatattgctttttcaccctgcacaggatattgagatgtcaaagaaactgtagaaaagttccagcctccatccgctccggtataattgtccagctgtgctatcaaaactccgtcagaagccaaatcgggagtttctgctgagcttattttattaccatcaaggtttcttgtgtaaaatgcgtctgtttcctccgctgtggcgtttccgtcaccatttgtatcttttagcggaagcgcatatattgatactccgccaacataagaacttgtaagcgcccagtctatcgaaacacttattttttctattaaattcgccgttcctgcataagcaacagcaccatttgaagttccatccaaatagtcagatttaattgataaatacttgttttctccagtgcctttccaaacagacttaaaatttgcaaactccgctactgtacttgaatctgccagtgcaggaatataaatactgccgcaaatcataattgcagctatgcacaacgacaaaagctttttaaaatttttcacatcgatactccctttcataatatgttgtcataattatatcacaaatttaatatgcaatcaattgccaaaacctgactaaaacatgtcaaaaattgaccaacaaacttgattatttatttatattaccttaatgacaccatgcacatatgtatattttttaataaaataaataaaaatctaattatgacgacgcttcatacacaatctgcgtggtataacacacaaatatttaggtttaataaaaaaaccaaccgattacttaaaattgattggctcttaacattatatcaaaataattaaaatattgtcagtacgctgctattgccgcaactaaagttacaaaaattacctattcgatttcaatataatttcactcaacagtcataaaatgacactatgtataaatattagaaatcaattatataagataacatattggctcagatgagcatgaaagagtacatattacacataaaagaatagcaataacaagtaaacaaaaaacagccgcatttaagcggctgtttgaaaagtaatgtggttaaataattacttttttattatagtctatatttatatttgtaaattttaagttataaataactgtatataagttatttatagcttagttttaacatatcaaaatcatcggtttattatggcttgcaaaacttatatatttgtcaaacaccaacctgaatcactgaaaaacatctaaaattttaaatattatctaacgattgctggatatcctcaattatatcatctgcattctctatacctactgaaaatctaattaaatcaggacttacaccggccgccttcagttcttcatcattcatctgtctatgagtatgacttgccggatgcaaaactgaagttcttgtatctgccacatgtgtaactattgcagctaactttaaaccatccataaactttactgcgttttcacgaccgccttttattccgaaagatataactccgcatgaaccgttcggcaaatacttttgtgcaagtttgtgatacttatcgttctccaatcctgaaaaactaacccatgaaattttatcgtttttacttagatactctgcaactttttttgcgttttcacagtgttttgctactcttaaagccaaagtttcaaggcctatattaagcaaaaaggaattttgcggcgcaggaatagaccccaaatcacgcattaaagtagcaattgctttcatgatataagctgattttccgaatcgctctgtataaacaactccatgatatgattcgtcaggtgttgtcaatccaggatatctttcactgttcgcttcccagtcaaaattcccgctgtcaactatggctccgcctacagaggtagcgtgcccgtccatatattttgttgttgagtgcactactatgtcggctccccactcaaaaggacggcaattaattggagttgcaaaagtgttatcaacaataagcggaactccatgttcgtgagctacttttgcaaatttttcaatatctaaaacaactaaagcaggatttgcaatagtttcaccaaacatagcttttgtatttgacttaaatgctttatttaattcttcctcgcttgcatccgggtcaacaaaagtgacatcaatgccaagttttttcatagttacaccgaaaagattaaaagttccgccatacacagttgaagaacaaacaaagtgatccccggcttcacaaatattaaatattgaataaaaacatgctgcttgtccggatgaggtcagcattgcagcaactccgccttccaagtcagctattttagcagcgacagcatcattggttggattagccaatctggtataaaagtatccgctttcctccaagtcaaacaatcttcccatttgctcagttgagttatatttaaacgttgtgctttgataaatcggcagaactctcggctcgccattttccggcttatatcctgactgtatacattttgtttctatcctcatatatcttacctcctgtaattaattatcttatctgaccgctgccttctattatatatttggttgaggtcaattctttaagtcccataggaccgcgggcatgagtcttttgagtactaatgccaatttcagctccaaatccaaattcgaatccatcagtaaatcttgttgaagcattaacataaactgcagccgcatcaattttatcaagaaatttttgagaatttttatagctgtctgtaacaatagcctctgagtgaccgctgttataattattgatatgcttgatagcttcatcaatactgtcaactaccttaacacctatttttaggtcaagatactctgttccccaatcttcttccgttgcctctgtggcacctggatatatctcacaaactttttcatcaccaactatttctacacctttatcacttaaagacttcagcattttgggcaaaaacttttctgctatatctttatgtacaagtaatttttcttcagcattgcaaacagatggacgctgagttttagcgtttatgacaatatcatgagccatattaaggtcagcatatgaatcgacatatacatgacaattacccgtcccggtctctatagacggaactgttgcattctcaacaactgcttttatcagcccagcacctccgcggggaataattacatctaaataatcattcagtttcattaactcagttgaactttctctagttgtgttttctaccaaattaattgaacctaccggcaaaccagcattataaccagaatcctgcattacttttacaattgccatgttggatttaaacgcttctttgcctccgcggagtataacagagtttccagatttaatacaaagcccggctgcatcggcagtaacgtttggtctcgcttcatatattataccgattactccgagaggaaccctaactttggatattttaagaccgtttggacgttttatacttgagatagcttcaccgataggatccggcaaaccagcaatttggcgtataccttcagccatatctattattctggcttgattaagacttaatctatcaattagactttctttcatgccatttcttctgcctgcatcgatatcctttttattttcggatataataaattcagaatttttttccaaagcgtctgcaatagcgagtaaagcgttattttttactgaagcggacagactgccaagaactcttgacgcagatttggcgagcttgcctttttctatcaattcttccacaaaaatcactccattttctgccaaatatcttatttatattatatacaacaaactgtgtattgataaaataaatgaagatattaaatttcatttgattataacatatcgatatgctataattgattataacataacgatatgctataatcaagtaaattatttttttaggagaaattttatgagattatttgacacacattcacatctcgatgatgaacaatttgataatgaccgggaagaaataattaaaaagatatgggaaaatgatgtaaaaactgttatggaggttgggtccagccttgaaacttcattaaaagctgttaatatagctaattcccatgactttatttatgcttcggtcggtatacatcctgagtttgcagaaaacgctgatgacgaagattttcaaaaaattaaaactattgctgaaactgagccaaaagttaaggcaatcggagagatcggcattgattattattatgatgactccgccccgcgtgaatcacagcttaattgttttcaaaaccagattttgattgcaaaagagcttgatttaccaataatagttcacgacagacagtcaaaaggcgacacattgaaagtattgaaagatatgaatgttacaaaaggtgtcattcactgcttttcaggcagcgcggaaactgcaaagattttaattaatatgggttttatgatttcttttactggagtaatcactttcaaaaatgcaaaacgcgctattgaagctttaaaagtcataccaattgaaagattaatgattgaaacagatagtccgtatatggcgcctgaaccatttagaggaagacgaaatgacagcagatatgtaaaatacgtcgctgaaaaaatggctgaagttaaaggtatagagttggagcagctgtgtgaaataacatatcaaaacggtttaaaattttttaacattacaaaggaggaaaacatacaatgaaattgatttcttggaatgtaaacgggttacgtgcatgtgtgcaaaaaggatttttagattatttcaaatctgctgacgctgatatattctgtatacaagagacaaagcttcaggagggacaaatacagcttgatgaccttgagggttacagtcaatactggaactatgctgaaaaaaaggggtattccggcgttgcaatgtttacgaaaacacaacccatatcagtttcatacggaatggggattgacgaatatgacactgaaggaagactgattacagcggaatttgctgatttttatataataacatgctatactccaaattcgcagcaggaactaaaaagattggattttagagttaaatgggaaaatgagttacgcaaatatattgcggaacttgaaaaaatgaaacctgtaattctctgtggtgatttaaatgtcgcccatcaggaaatagacttaaaaaatccaaaaacaaatagaaaaaacgcaggctttactgacgaagaacgcgaagagatgacaaaattattaaatcaaggatatattgatacctttagataccttcatcctgatgtaaccggcgaatactcatggtggtcatatagatttaaagcgcgtgaaaaaaatgccggatggcgtatagattattttatagtatctgaaaaattaaaggacagaatagattcagctttaatccatcaagaaattttcggttcagaccattgccctgtagaactaattattaaatagataataggaaaatattcctaaaaataatattgccccaaaaagttatatttttagcgtaactttttggggctgttaaaatatttctgtaagtatctttttaataaacaatttatagaacaaaaatttacattatgagctttctttcaatattattataagttctataatgattttaacatctaatataacttgacaaagatatttatacagctattactttttaaacagcataatatctccgctttttcttaaaatccattatatgcttgattttatatccaaagacttctgctttttaattaaagaaaaaacagtgcaattcataaactgcactgtctctattagttatagaccaattttagtcctatatttattgattataggaacaataacagctgaagctaccacactcatcagccattgaattggtgacgaaattaatgatatggctgctactgacactccatacattggaatttcagctgcaaaataacctagagttacaattgccaaagaagcaaccgcactcataataaaacgagtttttgaaaagtttttatataaaagttttcctatagcaaaccccataagacccttaataataaaagtaggcagagcaaaaattatatgtccggttaatatatctgccaaagaatgtccaaccgctccaacaactgctccgcaaatcggccctaaaaatgctgaggcaacatatattatactatctccgaaatggacataacctccggtacccgtaggaatctgtggtaccattgtcaaaacacaggcaagtgcagtaagcattccgcatcgaacaaaagttttgaaatcgaatctctctttatagtttttcataagtatctctccctcctaataattccccttatttaacttaatattataaagtttatctataattatgtcaagataaaaattaaaattttactttaccctcgaaataaagaaactatttcgttccatgttaaaagatcgacttcaccgtttggcggttctataccggctattttttgcacttgtgttaccgcctcagttgtttcatgatcaaatatgccatcaggattaattaatcgtatacctaatgttctatttaattccctcagcatgacctgcagttcaaatatatttctcatatcatcattaatcgaccacattgtcatcctcctattcttctgataaaacgtaaccgggaaactgaccgggtgattttagattaccatttacgatatcagaataaagactggcaatactatcccaagtaatcggacctacagttcccctaggagccaaaccaaataatttttgatacgcaataactgcctgctccgtctcagggccaaaatatccagttacactaacttttggtatatcagtatatacagttgctatttctgccagattgttctgtaaagttcttactgcatctccgctggcaccacggtataaaaccgttcctccgaaaggaacaaaattttcacctttaaaatccggcggcaggccgtctaaaatcgaaaaataagttgaatataatctattccatgtctcctcatttacaacacctgtctgctccaagccatatgcctgctgaaatgaccttacagaattttcggtagcatcaccgaacacaccatctgttgtgacagcgggtatgaaatcattaaaagttcctataaatctaagataatactgtatcatttcaacgccaggacctgtgtcgccattacgaagtgttcctgtatattgttcctttataaatgccaatgaaattccttcagcatctagttcagacaatttttttacagcattataaatccttataattttataccatgttgcttttcctattattccatctgctgtcagattaaatattctttgaaaatccttaaccgcatcttcggttataacatcaaaatatccgtcaggaaatgcgattttgggaattgacgggtaattttttgaaattctatttaatctaacctgcatgccttttacttcaagactattgtcgccaagccttaacggctgaccaggataagattctcttgcgtccgctacctcagcgtcctcaactaatgtaatatcatcgccataataatattttaatatatctataggagcatatccttgattagcgagatctaccgaaccccattgtgataatcctcctgggcaaagtgatgtagtaccattgcaatatctagcgtaaattggattataatttccttctcttgttatgtagttattaaatatttcgtcaactatttgacttatattttcaaaaaaatccctaccataaacatatgcttgatcataagcttctaaatttgttatgtcaaacggatatccctgcgacctataatgctctgtaaatatcctattaagagtaaaagtaatctgagcataaatattagcaattaatgcattttcaggccaagtagggaatatctcgctggatgcgacattttttatgtaatcaacaaatggtatggtaacattttgcgctgaactatcagtaggcgctccaagatgaacgacgacagttgagggaatttttaactccaaatccacaaaatcacctccaaaaattagtctctgttttcttcgttgggtatcatttctatattttgtattgaggcaatattatcaaacactaaagcgtgttttgcattttctattgtgtaataaccgtcaagttcagacttaacgtcatatactgcatatggctgaactttttcttgcggttgtttagaataataaaccggaggtgcaggaagatcaatcggttcggttcttccgttttgaccagtatatcttacttcatttatttctattgggcttccgtttgtcgaattaactgtaacttttgcattctccaaaggtatcgcctgtcttgctaaagtaacctgtactatcagtttcccattaccagtatatggaactctaatagtctcactgttttcaccgccttccagtgattccacttcagattcggctatgttttcgtaattttgtctatttgatgtttcatttgattgattattaacgtttatactcgctccaagctgttcattaaaacgtgataaatgttcgttataattcccctctgaacctgcattcctctgcaagttactattgttttgaacattattattgtttgcggtcggaacctgatttaagttttgattattttgtgctgtttgctggttattgttttgtctaatactttccggaatagttctaacattattttcagatatagtctgtggaatagtttgtgaattattttgcggactagtttgtgtaacagtttgtggattaattgacgaattaatttgtggattggttctcagattggtttgtggattggtttgtagattggtctgtgaattggtttgtagattggtctgtgaattggtttgtagattggtctgtgaattggtttgtggatttgcttgtggattggtctgtggaacattccgtagattggtttgtgaattgttttgcggattcgtctgtgaaacattccgtggattggtttgtgaattaattgcattatttctgatattattattttctaaactttcattaggtaaaccagcagttttttgtttctgcgtattatcctctttttcatttggcataaactctctgtaatatccattcatgaaatcatcactctcctgaaatattatactcaagataatgaattttgtgtataaaaaagccccgctaaattgcggagccaaaaattatatttcaattagttctttagataaatttgttaaatttcgaattccatcttttttcacgcatactaaatcttcaatccttacaccgccatatccgtaaatgtatatacccggttcacaggatactatcatattttcttctaatataatatcagactttggtgataaatttggaagttcatggatttgaagtcccaccccatgtccgagagaatgtccaaaatagtctccatatcctgcttcgtctataacatctcttgcggctttatcagcagaaaaacctccaattcctgcttttaaaacattcaaacctgtcatttgggcatttagtacagtattatatatttctttttgttttttatctgcctttccaatcataattgttcttgtcatatcagaacaatagccgttatatacacatccgtaatccataagaaggaaatcaccattttttataatcctatcccccggcacgccatgaggtaaagcagttctttctccggataaaacaatcgtatcaaaagaagttttttcagctccattctttttcataaaatactcaagctctgcagcaatatctatttcagaaacacctggtttgatataagataaaatatgtttaaaagcatcaacacctatctgttcagcttttgcaattaattcaagttcttcatctgattttatcattcttattttgttaatatcatcagacataggacaaaattcaatattatccgctatatttttaaatatattgaaaactttaacagaaataaaatcatcttcaaaaaccaaatttttaatttgattttctaaaagtatgttttttaacatatcatctaatggataattaagcccaaattcaaaaatcaaaaagtctttatacgcttcctcttttgctattccggtatatctggaatcaactaatagatatttattttcttttgttattataacatatccttctccgcccgaaaatccgctaaaatatttcatattatatggtgaacatatcaaaactgcagtctcgttactcaacttaagctcttcaaaaatatttttcataataaacacctgattcctaatatattaatcaattttattaattaattctttatatattttttgcattgaacacgcatcttttgtctgtgttcctgcagattcacaaataattcttggagtatagttcctctctgcaataagttcagcaatcggttcaaagtccggttcatattcgatttctgccattgtatgatgtttcttctcgccggctcttgtatactctattcttgaataatgcgcatgaaaattcttagcacgctcataccccaatttattttcgattaaatcaaaaatactttttatactttcttttgtattatatttacctaaagactgagcgtttatatgaccaaaatcaagagtaggtaaaaatctctcatcaatttgacataattttataacctcttcaacattccctaattgattaacttttcccattgtttccggacatatgcgtatgttgccatatccgttctcatcagcggctttaacagccctgcgcagagtatccgaagcaagtttaagagcttcaattctagttatttttccgcaagaacctgaatgaactacaatcctatcagcactcatatatttagcagctcttaacgtttgcaaaatatattctatacttttatctctctttgcttcctcaacagatgatagacttatataataaggtgcatgtatagataatcttatgtgtttcccttctgcaatatcgccgagatcttttgcagagtcatcagaaattctaaccccgtgaccgcattgatattcatacgcactaagtccatttttttccagccatttcggaacatcataaacggatttatttccttcttcaaaaaaatcatctgaatttccggcaggaccaaattgagcaaaactttcactcttaaattccagcatcaaaaccattcctttaaaaaatatttttccaaactgcgtttaaaatgtacaaaccagttttctttatctgagatagctttaaccataatagtatacatacctaatctattgcctccataaatatccgtaaacagttggtcaccaaccaaagctgcttcgtttggagaaacaccgatcacatcacaagcttttattatatattttttctttggtttaagcgcagcataaaaatatggttcatttagcgactttgcaaaattttcaactctctctttattattatttgaaacaaggcaagttaaaatattattttgatgcagcatttcaaaccatttttttgtatgttcaggcgcctttaagtcgtcatatgtaaccaatgtattatcaatatcaaatataagagctttgataccgaatttctttaaacattcaatatctaaagtatatacatcatcacaaaaaatatccggcttaaatttatctttaaacctacccatatacaatcctccaaaaaggtaaataaaaaggactgcagctaagataggataaaatcctgaagttgcagctcctgtactaatataacccaagcaaacttaagtaataaatacaaattaaaatatcctgcaatataaaaaatcacataatattttgcaactatcttactacagccctaaataaatcaatttaattaacattctaaattaactaacaattaattatataacatcgtctcaaagctacagctatgaaaagacaaggaatgtcattaacagaaaaacagattaatacttgcgttttctagcagcctcggatttcttcttgcgtttaacgcttggcttttcatagtgttctctctttctaacctcagataaaacacctgccttagcgcaagaacgcttaaaacgacgaagcgcactatcaagcgactcattttcttttactcttatttctgccataatttcttccctccctccgagtattatacaacacctagaagtcaaaaaaattctactcgaacaattatactagttaatttctattctgtcaagggattttgaggaattttgtaataaatttttgtaggattacaatagatgtgttacaaatagaaaaaaagaatacggaaaactcataaattgtgttatagttatatcaccataatatcacatacaatagcgataggtaatcctttgatgttatctccggattttcccccgccctaaaccgggcatgaacctttcagctcacccggcttgccatcaggaacagaatttatttcatctcaataactctcaacgtggacaaggcttcttaacttattgagtttttctttctgcttttggtcaaggcctaggatttccatatactttctgataatatcagggtttgtagcatgaatcaggtgatgtacatcttcacataccaacaccagattttgataattgtccttgccgcctaaataccgtggcactttgtgatggcaatgaatatcgccaatagaaagcactttgccagatacggcgcattttcccatttgggccgaatacagtgaaagcctgttatcgttgtattcgatagtacggtacagaaccgggttcctcattaagtaatgaagaaccgtcatgtcgattctgtccagattcttatggatttcggctctgccctcgggcatataggaattgattttgcggttcatggactttgggggcttgtgccgtatgtagccaatcgggacaactgcgtgtccggctacatatcggagctgtttgcttttcccataccgttccctgataactttcggaacttcacacggaatcttcctttttctgacctgttttgcagttttaacccgttctttcagtcttgcccgcaggctcttgtggacagataaggcgaatggcgtaaggtcatcgcagacctttgtggctaattgatagtagtcatggattcccattacataaacgttgtagcggcaaatcgcctgatattcagtacgtttgccttgtgacgggaactcaatgtcgtaaatcagccgttttaagtttggttttattttcgcaatagatttctctctgatatggctctctactacatatttggcgcgtccgttgctccgtttcccacgggggataacctttaacttgaaaccaagaaactctgaatactgctctttcaggttaatcaccttcgatttttcaggactgatttcaagagaaagcctttcatggagccagcttttggttgcgtggaataacttcaccgcattttgatagctgttcgtgaatatcttaaaatcatcagcgtatcggacgcaggtgacttctttcagccttgtcctccgcagtgcggcaaatttatggctcttgctcacgcttccgttgtaattgaccgattccttgtaagggaactccgttggtatttcttcccattggctggcaagccaccaatccaattcgtttagaactacattggatagcaggggagagataatacctccctgcggcgtacccacctccgggaatcctatcccggccacctccgcttttagcatagctgatataatactaagcagcttcttgtcttggattcccattgtccagagctgtttcagcagttttccgtggttcacgttgtcaaagaaccccttaacatctatgtctacgacatagtggagattgcttctctgcatatttttgtgaacctgggcgattgcgtgctgttggtttcggttagggcggaatccataactgtggtcgtggaatttcgcctcacatatcggctccatgacctgcaatacgcactgttgtatcagcctgtccataatcgtcggtattccgagcgggcgcttcttcattgggtcatttcctttcggaatttctacccgccggacgctttgtgggacataccagtttaatttgcgctgtatggcgcatataagctgttcatcagagagtgctgataattctgtgattgtttttccatctgtgccgggcgtcgtactcccgtggttcttcttgatgttgcggtatgccagccgtatgttttcgggtaatgcaatgatttcaaccagatgtttgaaaactttgcctttattgctgtcggcatacagcttatcttgaattgcctggaagtcataatactcggcgtgccttaacttatctttcttctttgcctttcctgttgccatagtcggttacttatccccactttcgtttggattttcgcctttcttagtcctactcgaacctatgcgtgtttattgaatatgattttgtttctgttcctgactacagcccgtccctccaccgcttactttgttcacggcttcacaggtagcatggctgctctttcctcccggattaagaacggttataccgcacctcccataaaaggcggcacgattttcccgcccattgcttcatcatgcgtatccactccacatccggggctttccacgttccgatattcctatctttgcataatacccttaaccctgccctttaggcctgtatgcctgatggtgcctgtaacaccatagggaatttcatatcgacaaatcttactttaccccacatacgccgttttcacggctatggcatttctgccatatcccgttatagacctgtacattcgggcttttgtcagcggtagtcagccgcattctggacataggtactttatagacctccggcctaacacccccggccacctctggctcggctttgctttatcccccaaaggggacagtcgcgggtgcagacagccgacttcagcgtgctgtgtcagtcgcgggaaatacgtcccgtttcttccaacgcagtatcaagggaagcgtttcagggcgttaccccgccattccacttctcggaatatcagttagaaaggctatagcctttccgtcacttttacctctttgcaggaaaatcccacgcagagtttatatgcgacaacgtgtcgctgcactgtcgaagggcgcaagccttgcaccgcaggaaatcaaaatcgacttggcggttttgcccgccgccagcttgtatttgcggtattgcttgaccgcgaagtgatccgggtcacgggcttccagttcatcgaacatgacatccacgggatttttgaaggtctcatcgtcctctctggcttccgaggcattgatcatttcgagcagggtagtaaagtttttctcgtgatcgggtgcctcataccagatgtagccgatgagagctgtgtagtagagcttttccgccttgacccagaaatcttcgccggacttatcgccgtctcccttcgtgttgacgatgatcgtattggccagcttgaggatgtccttctcgctgcgaatgtagctgaacgggttgtagtgcatggatttccggaaattgatggtgttcagcgacttgatgacgtagccgcccttttcaagcatcttgccgcactccaccagcaccgtacccttcgggtcagtcacaacgtagctgctgtgcatctgcatcaggttaggtttgacgaaaaagcgcgtcttgcctgagccggaaccgccgatgacgaggatgttcttgttgcgggcgtattttggctgctttggacggctgttcatggtcaggaactccgtctgcgtcagaatgacgttgttggagaactccgggtccatgtacggcttgatgtcctctggcttgccccagcgggcagatccgtattcttcgccctgccggaacttcttgcggtttttgcccttgacgtagactgccagcttgagcagcacgccagccgacagaccgatgagaagatcgacgggatgaaagctgggcagcggatttgcaaaggcagagccgaacacggcaaagccgtttgtcagcttgtcgatgaacgctgcgccgggggcgagacgaaacacggcggcgatcttatccgcgaagtagaaggcgaagacatacggaaggttcagaagaatgagcttcttcacatcgggtttgttcacagctccacaccccgatccttggttttgaccttgaccttctccttgtgctgcgccttgctctgggctttctcctgatccagcttgtgccggatggacggctgttccttctgcttgaccgttttggcggagaactccttgaaggcggcggtcatcacatcaacgtcccgtcccttgaagaagacaagatagctgggcggctcaacggaaacgtctttcttgagcgcaaagtccagaccgtatttgctggcggtccgctcaaaggatttgatgttgccatccgtcacttcgatgttggagatggcggcattctggctcatcagatgcttgatggactgcttgccgcgataggttttaggctgcttcatctgcttctgcgccttctcgatctcctgaacgaacttgtccagagcctttttcagcacctcagcggagattttaccgcccttgatcatgattgcaacaactttggtgttgacttcatcctgcattgctgcgtttacctcctttccttggaatgattatggggactgctgccgacgctaaggcggcacaatccggcgatagatgattttcatttacactgtcctcctttccgagcaatgctcacgatggtattcattaaagagtgtcttcacaaaggctataatcgtaggtcttcggcttctttgaccctgctgatctgtcctgcccgtagaaatcatggttgacgagggcggagtagtaattgtctatcgtcagagaggcgttatacagagcggtcaacaggtacgcccggatattacggatgtctgacgggttcttgttcattgcttccagaacgtactcaatgtggctgctattcagcttgagaaagcgggacttaaccacttgctgcggcatatcctcgccattgatacggatggtcggagcggtagagcagacggcatccagcatgatgtccatgatctcccggaagcggtctttatcgaacttcggatcctgacagagaatgtcgtaatcaagattctctttgataatctcttcatactcgcttcgctcatccatcctgtccatcccatcaagattgatggattgatagttctttgagagagtatttctttcttgggtaattacttgatcagtatttatttgtgcgtacttatccccgcgtggattatccacatctggcttctccacacatggattttccgtgtgtggcttttcccgttctggtgtagactcctgcggctcttcgtatatctcaaagattgtgttgctcatcctgcctttaccgtctctctgccggtgccggacaaggtagccgtgcttttcaagctcacggagcgcggagagaatggcatccggaccttccttgcagattgcagaaagtcccttggttgagaacttccagccatcattaaacgagagcatctttgagagaagaccgactgccttgagtgacaggctcttgtctcgaaggtggaagttcgccatgaccgtatagccacgattcttgtttacgcgatagactgccacagaaatcaccttgccatcttggaaagcagctcttcgccgcactttttctggaacttcattcggatgacatccttgcccttcggcgtgaagtaggtctgagaaccggtgtagcagtacgtcacaaaatcgcggacgataaacagtccggcattgctgtccttgttgtagggaagaagctgaccggagggagatcggaacaggtacttctccctgagaagaaactggacgaacttgcgctccgggattttcagttccttcgccgtcgttcggatattggtgcagtcatccggattgatgaaggcgtcgtagtaatcggctttgggctttgccgtgttcagctcacactcaagagcctttacgcgattcttttccagaatcaacgcctgagcaaactccacaatgaccgctggttccttctgaatacgttccagaagggagtccgtcatgtagccgccggtcttgcggatcatggggatgacatcatgtgtgatccagcgtttgaaggctttggcttcgggcttacggctgctcagaataagcgtgtaaagtccaggttcgttcaccaccgtcatgttgggattgcctcgtttattaccctcatttgaaatgagggtaatcatcttctcgtccgcatccagccgtgaaatggcttgtgacgaattgccgatctccaaagccctgcatacgtctaccgccacaaaccacggctcgttttcgatcagggctgttcggatttctccaaactgttcattcttgaagacttcgattttgttatccatgattgacttcctttccggcagcagatgtgccactttggtttttgagggtagaaacgggattgcagcagtagggacactctgcaaacacgcaggactgatatttccagaaggggcgatgaaagcggcagcttcggcactcagggagaatgccatccgcgccgctgtcaaaatgctcaaagccgggtgtggtctgcatcagcaattccagtgcttgaagatcaccggctgtcatgcgtttcatgcttaaaaactcctttctttcgccgcatcgccagcaaatactccggcttttgggcaacaaaaaaagagggtttgcttcttactccaaattggagaagaaacaaaccctcttcgtttacgatgtagttcagatgatttctcggatggtatgaatgataccgagcagcagcccgatgaagaaggcgagtcctccgatgagaccgcctatgattaagttcaatgcgaaaatgccgactgagccggagatgccgtaaccgcttggaacgagccagaggcacatcctccggatgccgaatggcaagccgacgcagatccacattaggaagtagtcgcatacgccgtcaggcatatagatcggcttgagaaatgacgcgaggcagaacgcaagcgcgattggaagcacaacttccttcaagaagactttgatagcacccactatatcctccttctgccggaagtgtgcagcggcaccctccggcttgcttgattattgtgaaagtcctttgttttcggtcaaaaaaagaagggactaagccagaatgccttggttttcaaggtctttctgatttagtcctattatcgcacaataatcaatagcgataggtaatcctttgatgttatctccggattttcccccgccctaaaccgggcatgaacctttcagctcacccggcttgccatcaggaacagaatttatttcatctcaataactctcaacgtggacaaggcttcttaacttattgagtttttctttctgcttttggtcaaggcctaggatttccatatactttctgataatatcagggtttgtagcatgaatcaggtgatgtacatcttcacataccaacaccagattttgataattgtccttgccgcctaaataccgtggcactttgtgatggcaatgaatatcgccaatagaaagcactttgccagatacggcgcattttcccatttgggccgaatacagtgaaagcctgttatcgttgtattcgatagtacggtacagaaccgggttcctcattaagtaatgaagaaccgtcatgtcgattctgtccagattcttatggatttcggctctgccctcgggcatataggaattgattttgcggttcatggactttgggggcttgtgccgtatgtagccaatcgggacaactgcgtgtccggctacatatcggagctgtttgcttttcccataccgttccctgataactttcggaacttcacacggaatcttcctttttctgacctgttttgcagttttaacccgttctttcagtcttgcccgcaggctcttgtggacagataaggcgaatggcgtaaggtcatcgcagacctttgtggctaattgatagtagtcatggattcccattacataaacgttgtagcggcaaatcgcctgatattcagtacgtttgccttgtgacgggaactcaatgtcgtaaatcagccgttttaagtttggttttattttcgcaatagatttctctctgatatggctctctactacatatttggcgcgtccgttgctccgtttcccacgggggataacctttaacttgaaaccaagaaactctgaatactgctctttcaggttaatcaccttcgatttttcaggactgatttcaagagaaagcctttcatggagccagcttttggttgcgtggaataacttcaccgcattttgatagctgttcgtgaatatcttaaaatcatcagcgtatcggacgcaggtgacttctttcagccttgtcctccgcagtgcggcaaatttatggctcttgctcacgcttccgttgtaattgaccgattccttgtaagggaactccgttggtatttcttcccattggctggcaagccaccaatccaattcgtttagaactacattggatagcaggggagagataatacctccctgcggcgtacccacctccgggaatcctatcccggccacctccgcttttagcatagctgatataatactaagcagcttcttgtcttggattcccattgtccagagctgtttcagcagttttccgtggttcacgttgtcaaagaaccccttaacatctatgtctacgacatagtggagattgcttctctgcatatttttgtgaacctgggcgattgcgtgctgttggtttcggttagggcggaatccataactgtggtcgtggaatttcgcctcacatatcggctccatgacctgcaatacgcactgttgtatcagcctgtccataatcgtcggtattccgagcgggcgcttcttcattgggtcatttcctttcggaatttctacccgccggacgctttgtgggacataccagtttaatttgcgctgtatggcgcatataagctgttcatcagagagtgctgataattctgtgattgtttttccatctgtgccgggcgtcgtactcccgtggttcttcttgatgttgcggtatgccagccgtatgttttcgggtaatgcaatgatttcaaccagatgtttgaaaactttgcctttattgctgtcggcatacagcttatcttgaattgcctggaagtcataatactcggcgtgccttaacttatctttcttctttgcctttcctgttgccatagtcggttacttatccccactttcgtttggattttcgcctttcttagtcctactcgaacctatgcgtgtttattgaatatgattttgtttctgttcctgactacagcccgtccctccaccgcttactttgttcacggcttcacaggtagcatggctgctctttcctcccggattaagaacggttataccgcacctcccataaaaggcggcacgattttcccgcccattgcttcatcatgcgtatccactccacatccggggctttccacgttccgatattcctatctttgcataatacccttaaccctgccctttaggcctgtatgcctgatggtgcctgtaacaccatagggaatttcatatcgacaaatcttactttaccccacatacgccgttttcacggctatggcatttctgccatatcccgttatagacctgtacattcgggcttttgtcagcggtagtcagccgcattctggacataggtactttatagacctccggcctaacacccccggccacctctggctcggctttgctttatcccccaaaggggacagtcgcgggtgcagacagccgacttcagcgtgctgtgtcagtcgcgggaaatacgtcccgtttcttccaacgcagtatcaagggaagcgtttcagggcgttaccccgccattccacttctcggaatatcagttagaaaggctatagcctttccgtcacttttacctctttgcaggaaaatcccacgcagagtttatatgcgacaacgtgtcgctgcactgtcgaatggggctaacctcgcgccgcatgagataagtatgctttttgcggtcttgcccgccgcaagtttgtattttttgtactgcttgactgcaaaatgttccgggtctttttcttccagacgttcaaacatgaggtcaaccgggttctggaaatcctcgtcgtcctcgcgggcttccgacgcatttatcatctcaagcagcgtcgtgaagttcttctcgtcctccggggcttcataccagatgtagccgattagcgcggtgtagtagagcttttccgctttcacccagaaatcctcgccggatttttccccgtcgcctttggtgttggcgataatggtattgactaacttcaaaatgtccttttcgctccgcagataggcaaagggattgtatttcatggattttttgaagttaatcgtatttagcactttgatacggtatttgtaccgctgtaacattttcccggtttccaaaatcagtgttcctttcgggtcagtgacgatatacgacgttggaaaatcctttgacgtacattgcatgagcgacggtttcacaaagaaccgggtcttgccgctgccggaaccgccgattacaaggatatttttgtttcttgcgtatttcggctgcttcgggcggctgttcatggtgagccgttccgtctgcgttaaggggatattgttctcaaataccgggtcggtgtacggctttatgtcgtcagccccgccccaacgcgccgaaccgtattctgtcccgcggcggtatttcttcgcgttcttgcctttggtgtagataatcagccggacaatgaccgcccccgcaatgcctaaagctaagtctgccgggtggaagctcggcgcgatactggaaaaggcggcggtaaaaccgtccccaagatgtagcagctttgcgcttgcgtccgcgccgggggagagccggacagccgcgcccactttatcaaagagccagacaaagagcagatacgggagatttaggataagcagcttcttgatttccggcttcatagcgatacctccctgtccttgttcttgacctttgcccgttccgcgtttctgccctgtgcagcttctttgagggtagagagcagctttcggattgagggctttttctcctgtgtcagcttttttgcggaaaattccttaaaggctgcggtcagtacgtccgcgtcccgccccttgaagaaaaccagatagcggggcgggctttccgtcgcgtcctttttcagcgcaaagtcgataccgtactttttcgccgtactctcaaaggctttgatattgccctcggtaatctcaatgttggaaacgcccgcgttctgcttcataagctgctttaagctctgcttgccctgtggcggttttgcaagctgctttttgccctttgacagtatggctttcattgccttttggagcgtctgcgcggtcagcttcccggtcttgatgtaaagggctatggtcttttcgtttacttcgtcctgcaatttgtcgcgtcctcctttcgcgtttctttatggggcggcggtcagatacgcacccgcagcccgttcaagtcctcggctctgatacccacaagataccagttgtcgccgtactcaatccgggtcggcttccacttgccccgcacgaatacgtcaaagcactcgccgcaatgcaagcccccgtagtagctgtttaagtcaaagcggatgtcgtaacggtcggtgcgctcgtcaaataccaatgctcctgtcattttctgtgccataataaaatcctccttttgtggttgtgggtggttacaggctttcgccctcattgcatgaataatagtccgggtcgccgtactgcggctttttcggtgacagtgcgccgcttgccatgtcatgggcgacaagggaagtgtagtagttgccgattgtggacggggcgttgaaaagggcggctttcagatattgcttgatgttgcggattttggttgtgttctcccgcatacagtcaagcacaaagcggatatgctcgccgtctagtttcataaactttgacttcacaagctctgccgggtagtcgtcccccgcaatccgtacccgctttctggcggtgcatacggtttcaagcatgaggtctacaatctcgtccagcctgtcactgtcaaacttcatgtcctgtttgagaatgtggtagtcgatattgtccttgatgatttcccggtatatatcaactgcgctctgtgctgccgcttccgttcctttccgttccggcggcgcagccgcttctctgcaaggagaggggttaggggaaaggataggaatggaatgggtacttgataaatctgtatttgatttttctttttttggtaagtcagttctttgtatatctttatttaattgcgttggattttccaacgtaggtttttccaatgttggtttttcctgcattggattatccaatgttggattttccaatgtaggtaaatccggcgtaggcggctgcggctgctcgaatatcacatagtccgcgccccgcaagcgtcctttctcgtcgcgctcccttgaacggacgatatacccggcgcgttcaagttccttaatggcttcgcggatagcgtctatcttctcccggttgataagggataagcctttcaaggtgtagtcccaatcttcggggagtgacagcatttgcgacaacagcccctttgcctttagggaaagctccttgttgcgtaggtggtggttgctcattacggtatagcccttgtttcgttccactctgaaaactgccatagttcatagctcctttgctttggatttgttacgcagtagaagcgcggtttcgggggataaggtataaatccctttccgcgccagatacgcgcccggaaaaccgcttgtagcaaggctttttctgcccctactgcgtaacaaagggcatgaaaaaagcggcgttcctgttctcccatgtagagagtaagaaacgccgcttctgcgtcgtattcagtttttagtacaataccctgcttgtccgtcgctcgaaaaaccttgattttccagtgttttcaaaagtatcgttatctaacgtcagcttttgaaagaccggactttaaacgtatggttgcagatatagaaaaaggattaattaacattgttattgtaaaagattattgtgcgataataggactaaatcagaaagaccttgaaaaccaaggcattctggcttagtcccttctttttttgaccgaaaacaaaggactttcacaataatcaagcaagccggagggtgccgctgcacacttccggcagaaggaggatatagtgggtgctatcaaagtcttcttgaaggaagttgtgcttccaatcgcgcttgcgttctgcctcgcgtcatttctcaagccgatctatatgcctgacggcgtatgcgactacttcctaatgtggatctgcgtcggcttgccattcggcatccggaggatgtgcctctggctcgttccaagcggttacggcatctccggctcagtcggcattttcgcattgaacttaatcataggcggtctcatcggaggactcgccttcttcatcgggctgctgctcggtatcattcataccatccgagaaatcatctgaactacatcgtaaacgaagagggtttgtttcttctccaatttggagtaagaagcaaaccctctttttttgttgcccaaaagccggagtatttgctggcgatgcggcgaaagaaaggagtttttaagcatgaaacgcatgacagccggtgatcttcaagcactggaattgctgatgcagaccacacccggctttgagcattttgacagcggcgcggatggcattctccctgagtgccgaagctgccgctttcatcgccccttctggaaatatcagtcctgcgtgtttgcagagtgtccctactgctgcaatcccgtttctaccctcaaaaaccaaagtggcacatctgctgccggaaaggaagtcaatcatggataacaaaatcgaagtcttcaagaatgaacagtttggagaaatccgaacagccctgatcgaaaacgagccgtggtttgtggcggtagacgtatgcagggctttggagatcggcaattcgtcacaagccatttcacggctggatgcggacgagaagatgattaccctcatttcaaatgagggtaataaacgaggcaatcccaacatgacggtggtgaacgaacctggactttacacgcttattctgagcagccgtaagcccgaagccaaagccttcaaacgctggatcacacatgatgtcatccccatgatccgcaagaccggcggctacatgacggactcccttctggaacgtattcagaaggaaccagcggtcattgtggagtttgctcaggcgttgattctggaaaagaatcgcgtaaaggctcttgagtgtgagctgaacacggcaaagcccaaagccgattactacgacgccttcatcaatccggatgactgcaccaatatccgaacgacggcgaaggaactgaaaatcccggagcgcaagttcgtccagtttcttctcagggagaagtacctgttccgatctccctccggtcagcttcttccctacaacaaggacagcaatgccggactgtttatcgtccgcgattttgtgacgtactgctacaccggttctcagacctacttcacgccgaagggcaaggatgtcatccgaatgaagttccagaaaaagtgcggcgaagagctgctttccaagatggcaaggtgatttctgtggcagtctatcgcgtaaacaagaatcgtggctatacggtcatggcgaacttccaccttcgagacaagagcctgtcactcaaggcagtcggtcttctctcaaagatgctctcgtttaatgatggctggaagttctcaaccaagggactttctgcaatctgcaaggaaggtccggatgccattctctccgcgctccgtgagcttgaaaagcacggctaccttgtccggcaccggcagagagacggtaaaggcaggatgagcaacacaatctttgagatatacgaagagccgcaggagtctacaccagaacgggaaaagccacacacggaaaatccatgtgtggagaagccagatgtggataatccacgcggggataagtacgcacaaataaatactgatcaagtaattacccaagaaagaaatactctctcaaagaactatcaatccatcaatcttgatgggatggacaggatggatgagcgaagcgagtatgaagagattatcaaagagaatcttgattacgacattctctgtcaggatccgaagttcgataaagaccgcttccgggagatcatggacatcatgctggatgccgtctgctctaccgctccgaccatccgtatcaatggcgaggatatgccgcagcaagtggttaagtcccgctttctcaagctgaatagcagccacattgagtacgttctggaagcaatgaacaagaacccgtcagacatccgtaatatccgggcgtacctgttgaccgctctgtataacgcctctctgacgatagacaattactactccgccctcgtcaaccatgatttctacgggcaggacagatcagcagggtcaaagaagccgaagacctacgattatagcctttgtgaagacactctttaatgaataccatcgtgagcattgctcggaaaggaggacagtgtaaatgaaaatcatctatcgccggattgtgccgccttagcgtcggcagcagtccccataatcattccaaggaaaggaggtaaacgcagcaatgcaggatgaagtcaacaccaaagttgttgcaatcatgatcaagggcggtaaaatctccgctgaggtgctgaaaaaggctctggacaagttcgttcaggagatcgagaaggcgcagaagcagatgaagcagcctaaaacctatcgcggcaagcagtccatcaagcatctgatgagccagaatgccgccatctccaacatcgaagtgacggatggcaacatcaaatcctttgagcggaccgccagcaaatacggtctggactttgcgctcaagaaagacgtttccgttgagccgcccagctatcttgtcttcttcaagggacgggacgttgatgtgatgaccgccgccttcaaggagttctccgccaaaacggtcaagcagaaggaacagccgtccatccggcacaagctggatcaggagaaagcccagagcaaggcgcagcacaaggagaaggtcaaggtcaaaaccaaggatcggggtgtggagctgtgaacaaacccgatgtgaagaagctcattcttctgaaccttccgtatgtcttcgccttctacttcgcggataagatcgccgccgtgtttcgtctcgcccccggcgcagcgttcatcgacaagctgacaaacggctttgccgtgttcggctctgcctttgcaaatccgctgcccagctttcatcccgtcgatcttctcatcggtctgtcggctggcgtgctgctcaagctggcagtctacgtcaagggcaaaaaccgcaagaagttccggcagggcgaagaatacggatctgcccgctggggcaagccagaggacatcaagccgtacatggacccggagttctccaacaacgtcattctgacgcagacggagttcctgaccatgaacagccgtccaaagcagccaaaatacgcccgcaacaagaacatcctcgtcatcggcggttccggctcaggcaagacgcgctttttcgtcaaacctaacctgatgcagatgcacagcagctacgttgtgactgacccgaagggtacggtgctggtggagtgcggcaagatgcttgaaaagggcggctacgtcatcaagtcgctgaacaccatcaatttccggaaatccatgcactacaacccgttcagctacattcgcagcgagaaggacatcctcaagctggccaatacgatcatcgtcaacacgaagggagacggcgataagtccggcgaagatttctgggtcaaggcggaaaagctctactacacagctctcatcggctacatctggtatgaggcacccgatcacgagaaaaactttactaccctgctcgaaatgatcaatgcctcggaagccagagaggacgatgagaccttcaaaaatcccgtggatgtcatgttcgatgaactggaagcccgtgacccggatcacttcgcggtcaagcaataccgcaaatacaagctggcggcgggcaaaaccgccaagtcgattttgatttcctgcggtgcaaggcttgcgcccttcgacagtgcagcgacacgttgtcgcatataaactctgcgtgggattttcctgcaaagaggtaaaagtgacggaaaggctatagcctttctaacgacagtgcagcgacacgttgtcgcatataaactctgcgtgggattttcctgcaaagaggtaaaagtgacggaaaggctatagcctttctaactgatattccgagaagtggaatggcggggtaacgccctgaaacgcttcccttgatactgcgttggaagaaacgggacgtatttcccgcgactgacacagcacgctgaagtcggctgtctgcacccgcgactgtcccctttgggggataaagcaaagccgagccagaggtggccgggggtgttaggccggaggtctataaagtacctatgtccagaatgcggctgactaccgctgacaaaagcccgaatgtacaggtctataacgggatatggcagaaatgccatagccgtgaaaacggcgtatgtggggtaaagtaagatttgtcgatatgaaattccctatggtgttacaggcaccatcaggcatacaggcctaaagggcagggttaagggtattatgcaaagataggaatatcggaacgtggaaagccccggatgtggagtggatacgcatgatgaagcaatgggcgggaaaatcgtgccgccttttatgggaggtgcggtataaccgttcttaatccgggaggaaagagcagccatgctacctgtgaagccgtgaacaaagtaagcggtggagggacgggctgtagtcaggaacagaaacaaaatcatattcaataaacacgcataggttcgagtaggactaagaaaggcgaaaatccaaacgaaagtggggataagtaaccgactatggcaacaggaaaggcaaagaagaaagataagttaaggcacgccgagtattatgacttccaggcaattcaagataagctgtatgccgacagcaataaaggcaaagttttcaaacatctggttgaaatcattgcattacccgaaaacatacggctggcataccgcaacatcaagaagaaccacgggagtacgacgcccggcacagatggaaaaacaatcacagaattatcagcactctctgatgaacagcttatatgcgccatacagcgcaaattaaactggtatgtcccacaaagcgtccggcgggtagaaattccgaaaggaaatgacccaatgaagaagcgcccgctcggaataccgacgattatggacaggctgatacaacagtgcgtattgcaggtcatggagccgatatgtgaggcgaaattccacgaccacagttatggattccgccctaaccgaaaccaacagcacgcaatcgcccaggttcacaaaaatatgcagagaagcaatctccactatgtcgtagacatagatgttaaggggttctttgacaacgtgaaccacggaaaactgctgaaacagctctggacaatgggaatccaagacaagaagctgcttagtattatatcagctatgctaaaagcggaggtggccgggataggattcccggaggtgggtacgccgcagggaggtattatctctcccctgctatccaatgtagttctaaacgaattggattggtggcttgccagccaatgggaagaaataccaacggagttcccttacaaggaatcggtcaattacaacggaagcgtgagcaagagccataaatttgccgcactgcggaggacaaggctgaaagaagtcacctgcgtccgatacgctgatgattttaagatattcacgaacagctatcaaaatgcggtgaagttattccacgcaaccaaaagctggctccatgaaaggctttctcttgaaatcagtcctgaaaaatcgaaggtgattaacctgaaagagcagtattcagagtttcttggtttcaagttaaaggttatcccccgtgggaaacggagcaacggacgcgccaaatatgtagtagagagccatatcagagagaaatctattgcgaaaataaaaccaaacttaaaacggctgatttacgacattgagttcccgtcacaaggcaaacgtactgaatatcaggcgatttgccgctacaacgtttatgtaatgggaatccatgactactatcaattagccacaaaggtctgcgatgaccttacgccattcgccttatctgtccacaagagcctgcgggcaagactgaaagaacgggttaaaactgcaaaacaggtcagaaaaaggaagattccgtgtgaagttccgaaagttatcagggaacggtatgggaaaagcaaacagctccgatatgtagccggacacgcagttgtcccgattggctacatacggcacaagcccccaaagtccatgaaccgcaaaatcaattcctatatgcccgagggcagagccgaaatccataagaatctggacagaatcgacatgacggttcttcattacttaatgaggaacccggttctgtaccgtactatcgaatacaacgataacaggctttcactgtattcggcccaaatgggaaaatgcgccgtatctggcaaagtgctttctattggcgatattcattgccatcacaaagtgccacggtatttaggcggcaaggacaattatcaaaatctggtgttggtatgtgaagatgtacatcacctgattcatgctacaaaccctgatattatcagaaagtatatggaaatcctaggccttgaccaaaagcagaaagaaaaactcaataagttaagaagccttgtccacgttgagagttattgagatgaaataaattctgttcctgatggcaagccgggtgagctgaaaggttcatgcccggtttagggcgggggaaaatccggagataacatcaaaggattacctatcgctattcgcagagctgcgggagctgatgagctacgatgagatggagctggacaccatcggagaccggaagacggcactgttcgtcatcatttccgataccgatgacaccttcaatttcgtcgtagcaatcatgtattcccagctcttcaaccttctctgcgacaaggcagatgacgtttacaacggacggcttcccgttcatgtgcgctgtctgctcgatgagtttgcgaacatcggtcaaatcccgaagtttgataagctcatcgccaccatccgaagccgggaaatctcggcgtcaatcatcttgcagtcccagtctcagctcaagaccatctacaaggacgcggcggacaccatcacgggcaactgcgactgcacactttttcttggcggcaaggagaaatcgactctcaaggaaatcagcgaggtgctgggcaaggagacaatcgacctttacaacacctcagaaacccgttccagcaacaactcctacggcttgaattaccagaaaaccggcaaggaactgatgtctcaggatgagatcgccgtcatggacggagccaagtgtattttgcagcttcgaggcgtgagaccttttctcagtaacaaatacgacattacgaagcatgcaaagtaccggcagctctccgactacgacaagcggaacgcctttgacatcgagaagtatcggcagcacaagctggtagtcaagcccgatgacacattcgacctctatgatatgggcgaggtcgaagcggattaaagccccgtcgctgcactgcgcagtgggtaaagcctgatggctcccaaagcagaacagcgacggggcttctttttttatgcccattttcaaaaatacacaaccaatctttttcaaatcaaggaggaaaatctatggctttcatcaatcaggctgtcacggttcttcagacgctcgttatcgccctcggcgcaggtctcgcagtgtggggtgttgtcaacctcatggaaggctacggcaacgacaaccccggcgccaaatctcagggcatcaagcagctcatggctggcggcggtgtggtgctgatcggcacgaccctcatccccctgctctccggtttgttcggctaatccacggcaagcccagcttaaccgaagggtggtgaaatattgggcagcattttagaaaagatcgaacaagctctcaaggatatgctgatcggatggatcgagagcaacctgaccaatatgttcaccgatgtcaacgagaaggtaggaacgattgccgccgaagttgggcaaacaccgtccggctggaacggcggcgtgtaccagatgatccggggactatccgaaaacgtgatagtccccatcgctggtatcatcatcaccttcgttttgtgctacgagctgatttccatgatcaccgagaaaaacaaccttcacgacatggacacttggatgttcttcaagtggtttttcaaggcggctgtggcgatctacctcgtgacgcatacgtttgacatcgtgatggcagtattcgacatcgggcagaacgtggtttccggtgcagccggagtcatccacggcaacaccagcattgacattgacgcgacgattgcgcagatgcgtaccggcatggagaacatgggcgtcggagaactgctcggactgtcgatagaaactcttctgatcagcttgtgcctcaaaatcatggcgatcctcattacggtcattctctacgggcgcatgattgagatttactgcaccgtgagcattgcgcctattcccatcgcaaccatgagcaaccgcgaatggggcagcatcggcacgaactatctgaaaggcttgttcgctctggcatttcagggctttctcatcatggtctgcgtcggcatctatgcggtgctgatcaacggcatgatcatcgcagacaacattcattcagctctgttctctgtggcagcgtacacggttattctgtgcttctcgctgttcaagaccggaagcctcgcaaaatccattttccatgcgcactaaggaggtcggcagcatgaagaagtacagcatcatctacgccgatcccccttgggcgtatcggacttactccaagaagggacagggacggtcggcagaaagccactacccgacaatgtgcattgaggacatcaaggcgcttccggtcggtgagcttgccgcgaaggactgcgctctgttcctttggatcacattcccgtgcctctgtgaagcactcgaagtgctgacggcatggggcttttcttataagactgtggcttttgtatgggtgaagcaaaaccgcaggaacgatgatctcttcaccggcatggggtattggacaagggcaaacgccgaaatctgcatccttgctacgaagggacatccgaagcgtgttgacgccggtgtgcgtcaggtcatcctcagccatatcgaagagcattccaaaaaaccggatgaagcgcgggagcgcattgtccggctcatgggagaccttccccgcgtagagctttttgcccgtcagtctcccgaaggctgggatgtttggggcaacgaggtcgaatgcacagcgcatcttccgacggaggaaacaccatgctgcggctaagacccatttctcttcgtgacgctaacgagtacgtccggcagcatcaccggcatcacaagcctgttgccggtcacaagttttccatcggctgtgaagcagacggtgaactggtcggtgtaatcatcgccgggcgtcccgtcagccggtatctggatgacggcttcacattggaggttacaaggctatgcaccaacggggcgaagaacgcttgcagctttctctacggtgcggcggcaagagctgctgcggctatgggctataagcgcatcatcacctacacgctggaaagcgaaaacggtgcaagcattcgggcttccggctggatttgtcaaggcaaagcgggtgggcttcgctggacgggcaagcgtcaaccgaaggaggatcaatatcccgcacaaatgaagctgcgctatgaaaagcagcttagaaaggaggaaacagtcaatggcatttgttccggtcccgaaggatcttaaccgcgtcaaaacgaaggtcatgttcaacctgaccaagcggcagcttatttgcttttccatcgctgcggcggtcggcgtcccgatcttctttctggcgaaggcgcatctcgacttgtctacggcggcaatgctgatggtggtgatcatgctcccgttcatcttcttcgcgctttacgagaaggacggtcagcccgccgaaaagtatctgtaccacatcgtacagtccatgttcatccgggacaaggtgcgtccctatcgcacaaacaatctctacgctgaaattcagcagaaaatcaaagaacaggaggaattgcagcttgaacaacagcacagcaaaggcaaagcctaagatgaccgtcaagaacggcgtcgtttacggcgatgccctttccgctcaggaaaagaagcggatcgtcatgcagaagaaaaaggacaggaaggcaaagaaagtccgcaagtccgcccagcagaccattccctatgtggagatgtgccgcgacggtatctgcaaggtgaacagccgcctctacacgaagtccatcgcctttgaggacatcaactaccagcttgcgcagaacgaggacaaaactgccatctttgagaactggtgcgactttctgaactactttgatagttcgattttcgtccagctctccttcatcaatcagaaggcaagcctcaatgagttccgcaagcgcatcaacattccggcacaggaggacgccttcaacgacatccgctccgagtattccggtatgctgcaaaaccagctcaccaagggcaacaacgggctgatcaagaagaagtacatcaccttcggcattgaggcggactccctccgcacggcaaagccgaagctcgaacgcattgaaaccgatattctcaacaacttcaaaacccttggtgtgaggacggaaccgctgtccggctatgagcggctgaaagtgcttcatgacgtgttcaacatggacaccaatgagccgttccgcttttcctttgacatggtagcccggacgggactcagcacgaaggacttcatcgcgcccacttcctttgacttccgtgaaggcaagtgcttcaagatgggcagaaccatcggcgcagtgagcttcctgcaaatcctcgcgccggaactcaatgaccgtatgcttgccgacttccttgagatggacagcaacatcacggtcaattttcatatccggacgattgaccaggcgaaggcaatcaagagcatcaagatgaagatcaccgacctcgacaagatgaagatcgaagagcagaaaaaggcagtccgctccggctacgatatggacatcatcccgtccgatcttgccaccttcggcggtgaggcaaagcgtctgttgcaggatctccagacccgcaatgagagactgttccttgtgaccatcctcatcatgaatacggcaaccaaccgccagaagctcgaaaacgcggtgttccagaccgccgccattgcccaaaagtataactgtgcgctcaagcgtcttgacttccagcaggaggaagggctgatgtcctctttgcctatcggcgtcaatcaggtggagatcgagcgcggactgaccacttccagcacagcggttttcgtgccgttcaccacgcaggagctttttcagggcggcgaagctctctactacgggctgaatgcgctgtccaacaacatgatcatggtggaccgcaagcagctcaagaaccccaacggactgattttgggtacgcccggttccggtaagtccttctccgcaaagcgtgaaatgacaaacgccttcctcatcacggaggatgacatcatcgtctgcgaccccgaagccgagtattttccccttgtgcagaagctcggcggtcaggtcatccgcatctcgccggtcagcacggattacatcaatcctctggacatcaacacgaactactccgaagaggaaaacccgctgacgctgaaatccgactttatcctctccatgtgtgagctgattgtcggcggcaaggacggcttgcagccggttgagaagactatcatcgaccgcagcgtccgcatggtctatcaggagtttcttgcagatcccaagccggagaaaatgccgatccttgaagacctctacaacattctgagaaatcagaaggagccggaggcacagcgcatcgcaactgcccttgaaatctatgttcacggctctctgaacgtcttcaatcacagaacgaatgtggatgtcaacaaccgcttcgtctgctatgacatccgcgaactcggcaagcagctcaagaagctcggtatgctgattgtgcaggatcaggtgtggaacagagtcaccatcaaccgcgcccagcataaggcaacgcgctactacatggacgagttccatctgctcttgaaggaggaacagaccgccgcatacagcgtggaaatctggaagcgtttcagaaagtggggcggcattcccaccggtatcacccagaacgtcaaggatcttcttgcttcccgcgaggtggaaaacatctttgaaaactcggattttgtctaccttctgaatcaggcatccggtgaccggcagattctctcgaaggcgctgaacatctcgcccagccagcagaactacatcaccaattccaacgccggtgaggggctgatcttctatggctcaaccatcgtgccattcaaggacgatttccccaagaacacgcagctctaccgcatcatgaccaccaagcccgaagaaaccgtacagaattaaggaggattttgaatatgaataagaacttcaatcttgagaacgccaagagcatcatcgcagaagccagcggtgtccccgtaaacaccacgtttggcagcatcaccaagccgattgaccttctgcttgaggtcatcgacatgagcgccgatctcattgccctcatccacgaggaaaccgaactgaaaaagcaccatcgcgcctacctccacgttcatgaggaactggaggactgcgccgaccagatggcagagcgtatgcaggagattttcgatgagaccactgactgtgtgatcaagctgatgaaggatgtccacgagacgttccgagtccgcaagcaggaagcggctgaggacgatgccgataccgtcaccatcgccaaggaagactacgaaaccatgatcgacgatctgctcacgatgtccgaaatcattcagtgcgtcgcagatatgcgcacgcaggatgtgaaggcaatccgcgagttcggcaagttcgtccccgcctttgccgcctttgagaagaaccgcctgagcctctatcgtgaggcggcgaaggaagccgaggaaatcttcgaccgttgggcggacgagattgacgatctcgatgaggactacgagccggacgagttcttctctgactgagccgtccggctctcaaaggaaggagctgatacccatagagcttgacatcattcataccggcgattgccttgaaatcctgaaaactctgcccgatgacagcgttcattgctgtgtgacgtcccctccgtattacgcgctccgcgattacggcatggatgctcagatcggtagagagacaacgccgaaggaatatatctcgcgcctgacggaagtatttaccgaagtcaggcgcgttttgcgtccggacggtacgctctggctgaacatttcggacacctacgccgggaaaggcaatcagggcgattttgttgacccgaagaaccccaacggcagaaacggtcaggctgtggctctcaacaacaaggttgagggctgcaagccgaaggacatgatcggcattccgtggatgctggcttttgccctccgcgataccggctggtatctgcgcaacgacatcatctggatgaaggataaccccatgccggagagcgtgaaagaccgctgcgcccgctgctatgagcatattttcctgttctcaaagtccaagaagtatttctttgactacaaggcaatttccgagccgattgcccctgcaacggcagaacgcctcaagcgcggcatgaaaggcggcaacaaatacggcaagcccgttcccggtcagcctcagccgcaatccatcaaccgcgcgcgtgagcatggcgagatcaaggacgctgacatcaatccgctccgcaacaagcgcgatgtctggaagatcaacaccgtccctttcaagggcggtcactacgccgcctatcctccgaagctggttgagacctgtcttctcgccggttgtcccgaagacggcattgtgcttgacccctttatgggaagcggcacaaccggcatggttgccgcgcagatggggcgtcatttcgtcggcatcgagctgaatccggcgtacaccgagcttgcctacaagcggatcggaggtgaaatctgatgtccaaggaaccggaactcaaagcccgcgacaaggtggtcgtgcggatgacgcgagacggcgcggtcgagaaaaacctgacggctggcaccgagcagcgtgtgtcaaagcggctggaagaagcagagttggtgaagtccgctgagacagtcgcgccttccgaagctctttctgcggaggaacagaaaaaggtgcagatgcgccgtcagcatcgtcagtttcaggcggaacacgccgaggataacgacacacagccgccttcggaaacgtccgtcacagaagagaaaagggcagaaaatccaccccagaatgcacctgaaccgctgccctcggaaacgccgttcaagccccctgttttggagcagcacggcgtttcttcgcataccggcacggtgattgccgaaacggttgtcacccacaagctgcgcaagacctctgcggttgaagccgttgatgcagatgccgttctcactcaagcggcggagactgcctctgcaaagccgctctcggacgatgccgtcccgcccacgaagcggatgcagaagctcgaaaggaagtctgagaaggcacatgagcgtctggatgctgcccgtgaaaagctgcccacgcacaaggttctcaagaaagagcgtgtctttgatgaagagaccggaaagggcaaaacccgccttcattttgaggatgagctgaaaaagcccaagagcaaaggcaagctgcaatttgaggcagataaaaccgtccgcaaggtcggtgacacccttgcttccggcattcacggcaaaatccatgaggtcgagcaggaaaactcggcggttgaggcggcgcataaaacagagattgccgctgagaccgctgcgaggcatttccgtcatcatcgggaaagcagcgtcaacaagccttatgagaaggtttccaagctggaacataaggcggatgtagctgacgccaagctccaatatgagagaaatcagcaggagcatcctgagatgaagaagcagaacatgaacaagcactaccagaagcagaacatcaagaaggaatatgccgctgcacggaatgccggttctcagactgccgggactgccacgaagaataccggcaagaagctcggcgaaaaggtgtccgacaagctcaaggagttctttgagaacaacaagaaggtcttcatctggatcggcgtcggagttgtccttctcgttttgctcggtgccggtatcagctcgtgttcgatgctcacctctaccggctcgtcggttatcgcttcctcttatctcagcgaggatgacgcgatgctcggtgcggaggcgcagtattgccggatggagcaagagctgcaaagctatctcgacacctacgaaagcactcacaactatgatgaataccacttcgatctggacgatattgagcatgacccctatgtgctgatctccattctctcggctctccacgagggcgagttcacgctggatgaggtgcagggtacgctccaaatgctgtttgaaaagcagtacatcctcaccgaagaggtcatcgtcgaaaccagataccgcacggaaaccgacacatggacggatgcagacggcaacacgcacacggaaacctatcgcgtcccgtatgactactacatctgcaacgtgaagctcgaaaacttcaatctctcccatgtcccggtctacatcatggggcaggaacagctctccatgtacgcgacgtatatgtcggtgctgggcaaccgtgaggatctgttcggtgactctccctatgtggacaagtacatcacaaatcctcccgccgactacaatgtcaacccggaatacttgaacgacgagaagtttgcgacactgattaccgaggcggaaaagtatctcggctatccgtatgtgtggggcggctccaatcccgacacatcctttgactgctccggctttgtcagctatgttctcacgaacagcgggcttgtgaacaccgggcggctgggcgcacaggggctttacaacatcagtacgccggtttcaaaggcgaatgcacagcccggtgatctcatctttttcgttgggacgtatgacacccccggcgtgtctcacgtcggcatttacgtcggtgatggggtcatgatccactgcggcgatcccattcagtacacatccatcaactcttcctattggcagcagcatttctacgccttcggaagacccgcctattaaaagaaaggagttttgcatgaatcccaagtatcagaaggtcctctctgacattgagaaggctgaaaagaaaaagaccgaaatcgaaggacagctcaaggagctgtacgacaagaagacagagctggaaaaccttgaaattatcaataccgtgcgctctatggtgatggacaaggatcagatcatggcgtttctgtcttccatgaagggcggcaccaagcccgctgaaaatacggaggtaatcgacaatgcgtaagaagtttcgttttctgaccgtccttgcggtctgcgtcatggttctgtcctgcttctcggtgacggcgtttgcctacgccgatgacactgatcagaaccttcccgtcacggaggcaacccagccggaacagcagcctgaaaccactcccgcgccggaaaagccgatgggtgagccgattgacgatgagggcaacgcctacacccgcgacttgctatacgacaaggcaaccaacaagcagttcatcactgtccagacgaagaacggcaacaccttcttcattgtcatcgactacgatgcgcccatcaacgaggatgaggaacagtatcagacgtacttcctgaacatggtcgatgaaagcgatctgcttgcgctgctggatgaagatactgcggctgcgctgaccacctgtaactgcaaagaaaaatgtgctgccggtcaggtcaacaccgactgcccggtctgcaagaataacatgagcgaatgcaccggcacagctcccgttatgcctgagccggacaaggatgcagaaaccgacgttcctgctcccaagcccgaaaagaaatccaatgtcggtatggttcttatcgtcttcgtccttgttggagctgcgggcgcggcgtattactacatcaagttcgtcaagggcagaaagcccaaggatgaggatatggacttcttcgatgatgaaggctacgaggaagagccgtacatcaacgaggatgaagagccgcagattgcggaggatgctgaaacggatggtgatgaagattgatcttagtcattgctgaaaagcccagcgttgcccagtccatcgcaaaggtgttgggcgcgacgtcccgcaaggacggctacatggagggcggcaattacatcgtttcgtggtgcttcggtcatctggtggagctggcagacgccagctcctacaatgagcggtatgccaagtggcggtatgacgatctccccattgttccggaaagctggatgttcgaggtcacgaaggacaaagcacagcagttcaaggtgctgtccgctctcatgaaggacaagcgcgtcaccgagctggtctgcgcaaccgatgcaggacgcgagggtgagctgatcttccggctggtctacgacaaagccggatgcaccaagtccttcaagcgtctgtggatcagctcgttggaggactccgccatccgcgaaggcttcacccatctccgggacggcaaggaatatgaccgtctctatgaagcggcactcagccgctcgaaggcggactggattgtcggtatcaacggcacccgcctgtttaccacgctctatcacaagaagctggtggttgggcgcgtccagacgccgacccttgcaatgctggtggagcgcgacgggaaaatctccacgttccagaaggagaagtatttcaacgtccatgtcggcaagggcgatctgaccgccgatctggaaaaggttaaaaccgaagaggaagcaaaaagaattgcggcggcttgcgagaaaaagcaagccgtcgtttcttctctcaagcgggagacgaaaaccgtcaatcctccgaggctctatgatctgaccaccttgcagcgcgaggcaaaccgatactacggctttaccgcccagcagacgctcgatctcgttcagacgctctacgaaaagaagctcctgacctatccgcgcacggacagtcagtttatcacggacgatatggaggacactgcccgtcaggtcatttctatcgtctgccgccagcttccgcttttctccggcgtttcggttactccggacattgcccgcgtaaccgacaacagcaaggttacggatcaccatgccattctcccgaccgtccagcttgaaaagcaggatgtttcggcgcttcctcagtcggagcagaaaatcctcaatcttatcgggatgcgccttctgtgtgcgaccggcgagaagcacacctacgcagaaacgcagatctcgctctcctgcgagggctacgagttcaaaaccaaggggaagaccgtcgctcaaaacggatggaaagccatcgaagagctgttcaagtcctccctcaagacgaaggaaaaggacgatcccatgaagtccctgcccgaagtccacgagggcgatgttctggatggtgtatctgccagtgttacggaacacttcacaacgcccccgaagcagtacacggaagacacgctcctgtctgcgatggagactgccggaaacgatcagttcgacgatgacaccgagaagaaaggtctcggcactcccgcaacccgcgccggtatcattgaaaagctggtaaagtccggctttgctgaacgcaagggcaaatccctcattcccacaaaggacggctgcaacctcgtctgcgtcctgccggaacagatcacctctcccgcaatgacggcggaatgggaaaacacgctcatggagattgagcgcggcaatgcggatgcagacgcctttctcagcggcattgtccggatgaccggggatctcgtgaaagcctatccgtttctctccgatgccgaagcccagcgtttcggcacgggtaaggaggaaatcggcaaatgtcctcgttgtggatctccggtctacgtcggtaagggcaacttctactgctcgaacaaggactgctccttttgcctgtgggaagacaacaagttcttttccagcaagaaaaagaagctgaccaagaagattgcaaaggagctgctggacaagggctggtgccgagtgaccgggctttacacgccgaagaagcctcagctctacgatgctgtcattcgtctggatgacagcggcggcaaatacgtcagcttcaagatggagtttgaccgatgagccgcccaaagtatattgcctcttgcagcggaggcaaggatagtgtggcaacccttctgctggctgcacagcacaatgaaccgctggatgaagccgtgttcagtgaggtcatgttcgacaaagacacaagcggcgaagtcccggaacaccgggacttcatttatgaccagctcaagcccttctgcgaaaaggagctgggcatcaagttcaccattctccacgcggacaagacctacgatgaggtgttccatcatatcatcacccgcggaccgcacaagggcgaggttcgcggctttgcatgggctggtatgtgtgcagtcaatcgggactgcaaaatcccgcccgtccgaaagtacaataccgcgctttctccggacactgtgagctatgtcggcatcgcggaggatgagccaaaacgccttgctcgtctggatggaataacgaaggtcagtctgcttgccaagtacggcatgaccgaagcggatgcctacaagctctgtcaggaacacggtttgctttccccaatctacgctcactgccgaagaaacggctgctggttctgtcccaacgccaatgactcggagctgctgcacatggtcacaaagcacccggatatgtttgacagactgattgaatgggagaaggaggataacatctttcatcgtcggctgacacgcagagaaaccccgtctgaggtaaaggctcgtttattgagcaaatctcagacgggggtttcttctccccgaaacaaatccgaaatggaggtttgaaatggctgaaaacaaaaatgcacagcaagtccgcgaaatcacggacaagctggaacagggcatcaaggagctgtttgaatccgagcggttcaaggaatatctccgcacgatgtccaagttctacaactattccttcaacaacacgctgctcattgcgatgcagaagccggaggcaacctatgttgccggttatacctcgtggcagcgtaactttgagcgtcaggtcatgaagggcgaaaaaggcatcaagattctcgcacccgcgccgtacaaggcacaggaagagcgcgagaagattgaccccgtgacgcagaagccggtgatcggcgcagatggaaaaactgtcacggaaacggtcgaagttctgcgccctgccttcaaggtggtgagtgtctttgatgtttcccagacggacggcaaggagcttccggacattatcgtcgatgagctgaaaggcaccgtcgaaaactacgaggcgttcttcgatgcgctcaggcaggaatctcccgtccccatttcctttgaggacattccgggcggtgcaaagggattcttctctccggttgaaagccgcattgccattcaggagggcatgagcgaaatccagacggtcaagaccgccattcacgagatcgcccacgcaaagctccacgccgtcaagccggacgagaaagccgcgccagaagataagaaggatcggcacaccaaggaggttgaagcggaaagcgttgcctacaccgtctgccagcgttacggcattgaaacctcggactattccttcggttacatcgccggttggtcatccggcaaggaaaccaaggaactgaaaagctctctggacaccatccgcaagacggcggctgagatgatcgagggcattgacgccaagctcaaggtgctgctggcagagaagtcacagtccgtcgagcaggaaaccgttccggaggaaaagccggaagtccccatttaccgcgagacagcgaattacgcctatgaagccgatgagctggagtcatatcgtgcttctctcgccgcaaacgtggaatgccgcaaagcgattgaagcggcgatcagctccaactacggagataaccggctggatgcggatgctgccgtaaaaagcgtccttgagcaattctctccggagcgtgtccgatatgtcctcgcaaacaccattcagcagaaagactttgacgggcgcattccccagcccctcaaggaatgggcgaagaccgttgatgtctgccccgaaaacgcctctcgcttccttgtggataaacccaatcccggactgacggcacttttcgtggatgcgttccgtcagcagaccgaaccccagaaggaagtcacttctgagaaaacagaggaaagagacccggaggtcgttgcatgggagaacgatgagattacctctattgaggtaaaaaccgtggaggtcaagtctccctttgctcccttgccggaggaagcagcgcaagcaccgaaggcgcaccgtctgactgcggaagagaaggaaatcaaagccgccgtcatagacacgctcaaggggcagattgcctataacaacgacggaatgcgggcttcctaccgcgcctctaaccactccttcaatctgctggcacggaacggcgtcaggattgagggcaacacggtcacgcagaatggtgagccgctgttcaaaatccatcgccgtcatgcggcgcggaaaacacagggctgttaccgtgagctgatgccgacgctggaatacgtcaagcaggagcagaagcaggaaaagccctctatccgcgatcagctcaaagctgccgcgaaaacgcagccggagaagaagtctccggtcaaattcaaaacgcacgacatggagttgtgagaaaggagacgcatgaagaaatacacagacgttgacatcgttgcggagctgcagaagctcgtggacagtcatgtagacagctacaaggaagacttcgacatcgacaagcgtatcatccgccgcgctgccgaaagccggaatcccgaagacaaaacgctgatgtggttctgccgtccgcatggaacgcactgtctcaacgaaaatcaggtctttattcaggggacgcgggatcacaacaccttccgcttttatgcggaacagacctacgacgagtgcgttgcccgcgtcattgtcccgaaatccgtcaagcgcggcaaggtcttcggagatgtctttgagatcaactaccgggaacaggctgcaaatgtggcgcagaacgcggttgcgccggatcatgaccggctgaccttcgcagacggctttgtgctggaagccccctgccgcagcagcttcgatgcagcaatggctctggtcggtgagcatggcggcgtcaaaacccaccagacgctcccgaaggacgcggatgctctggtggaagtgctgtctaagcagaaaagccgccgtgacagactgccggagactgagaggacggaggcgctttcgcctctgcccgttgcagaactccgcaagtacgaggcagtcaaaaaggcacatccggacgcgctggtctgctttgcccagaacggctatttcgagctgtacggcaaggacgcggaaaaagccgcaccgcttctcggcacaaagctccttgaaaagaaggtgcgcggtaagccttccatgccggtcactggcttccgtgaagctgcatgggtagccggttctcacaagctctggaagtccggtgcagatgtctttctcagcaaggacggcgagaccttcaaggaactcaaaggcgcagattacattcctgtcggcgcgacgctgaatatggatggcatcaagtgcagaatcgacgcggttgattttgctgccgatgaagtccaactgaccaatattgaggacaagaacagaccgatccgcttttctgaaagcattcagtatgtccgctcgtatgtggaggatgccggaactgccatctacgacaccatccccaagaaacccgctgcccgtgaatccatccgcgacaagctgaaatccgcacagaaggcacagccgacccacacaccgaaaccgcagaaatcgaaaggaaaggatatggtactctgatatgaaaaactttactgtggaagaaatcaacctgatgtgctgcttcaacacgtccagccggaagcggctgatcgacgatatgaagggcgtcaccctgaacgacatggacggcgagatcgcagagctgatgtataagaccatacggaagctcgaagccatgacggacacggagtttgaggaactgtatatcatgccggacggcatggtggatgactgaaaggaggatgcctatgcccgtattagacggtgattttgaagccttcgtcacgaacctcggcaagtacaacgagggtatgctggtcggtgagtgggtgaagttcccgacaaccgaagaagagatgcagaaggtctttgagcgcatcgggatcggcaagcaggatgagttcggtcagccctacgaagagtggtttatcaccgactacgaatgcccgatctacggcgtgcagaagatgcttggcgagtacgagagccttgataagctcaactaccttgccgctttgattgacgagctttccctgagcgatcaggaaaagctcgttgccattatggaagccggttgcgatgaggtcagcgacatcgacgatctcatcaacctgacgttcaatctggactgctacgacatcatgcccggtatcaacgacgaatccgacctcggctattattacgcccacgaagccggtatctactccgaaaaggatctcggtcctctggcaaattacatcgactatgaacgctatgggcgtgacattgcgatggatgagcagggacacttcaccgatgaaggctatgtccgcgtcgcaagcgagaggtgggacagacagttcaacggcgatcttgatgatattcccgacgaataccggattaccggcttaggggaagccgccgagcgtgacagcaccatcgccgttctcgtcgttgagccgggaaaggagccttatgtgaaggagattgactccggtctggagtccttgcagcatgaggtcggcggctgcatcgaggcgatttacccctacgaagacccggttgccttagtctgcaacgaggaaggcaagctggaaggtctgcccctgaaccgcgctctgcgtgatgaggacggtgacatctatgacgttgttgccggaacattcatggtagtcggcttgacggatgacagcttcggttctctgaccgtagagcagatgcagaagttctctgacctcttcaaagtgccggaacagtttgttaagttgggcgataagattgttgcgatccccatgatctcgaaggagcagcagaagcaggaagtcgcccagcagaaggactttgagatgaacgccgatacctccggtctgacggttgccggtcacatcgggacgtggcacaccattgaccagcacgaaatcggcggtcacagcttttacctgatggagcatgacacctacggcgatgaggcggcttgcatcatcgtcgatgagcgcggtaagctcgtccttgatgatgtctacaacggctttgacgatgacacgctccgccttctcgaccttgaggtcaaggaagtgccggaaatgcccgatcccgcgctctccgttcaggatatgaaggactacggctacgcatgggctggcgttcttcccgccggtcaggaggcggctgagaaggctttggagaaggggtgcgaggtttaccgtctatattccgataataccgagggcttgtgcgtggatgccaaggagattgccgatcatgcggcaaagggcggaatgctcggtatcagcaaagaaagctggatggcagctcttgagaaggaaaactacctcaaggcagcggagatgtcgatggaggatgactacggcatgattgacgggatcatcaacaacggtccgaaggaggacaagaccgcagaggtcaaagcccccgaaaggggcgagaagtcttccatcatggacaggctcaagtctgcaaaggctgaaaagcagaaggactgctgccctcccaaaaagcacaaaggagagattgagctgtgagcagaagtcagaagtggcggcaggagtggtcgttcttcatcggagatagcggacgccggaagtataaccgcttctgcgtccgctgcgtccatagctgcaagcagagcttccgtgcggatctcatcgcctgtccgcacttctcccgcaaggcatcgcggtgtagacagttaggggtcgaaaaagtctgtgattgcaagcctcagagcgacgaggaatgaccgcccagtgtgattatattccccgcacagttccagcaatagagcgagaataagtgtcgatttcggcacttgtttgaatgcccggaaaacgaaccaaaagcctctgtcgatgcccagtttgggtgtcggcagaggctctttttttatgacatattatgacatattcaaaatagcggacagcagctcttgaacctgttgccggtattccggctttatatccgaaatacgtctggcaagcgcaagggcttccgcttctggctcatcggtcccaaagataattcggtccgcactgacgcccagcaaacggcaaagacgctgcaaggcttcaagagaaataccggaagcaccacgctcaatagcgctcaggtgattcggcgtaatgccaagcatttctgagagcgtgtcctgcgtatagcccgcctgttctcttgccacttgaatattgccgccgatttcaatattgatgtccttcttctctcgcatagcctcaccacctttgcatttagtgtacctaacggcggtgtcattatccacggcacgccgtcgttaattttactaacgacaatgcgttgactgtccgtgatgagggtgatagaatggagttacctaccaaaagagtgaaagaaggggtgtcatgtcgcgcattattgagtttagaaagtctgctcaaaaagctgaaaagcaatccgttcaaggcaagacttgtgcgtttaccggtcatagaccgcagagtcttccgttcggctttgatgaatccgataagcgttgtacttctttgaaatctgttatgcgggatcagattgtagcactcatcgagaacgagggcgtcacgcattttattaccggcatggctcttggcgtcgatatgtacgctgcggaaattgtactcgatttgaaatcaaaataccctcacattactctggaaagtgcaatcccttgtgagacacaagcgatcaaatggtctgtggcttcacgggaacggtattataatatcgcggcaaagtgtgacaaggagaccatgctgcaacgggagtacacgccggactgcatggacaagagaaatcggtacatggtcgatcacgccgattatattctcgcagtatggaatggatgtcccagcggtaccgggaataccgtgagatatgcccacaaaaagggcaagaccgtcatcgtcatcaatccggtttcccttgatgtcacgcgggaataaggcaaaaaaatcccttctgaatcaagcgttgtgaaaaccgtgaagtatttcccgatagcgaatactcattgcactgctcagtgattattggaaacgtgtacggcgtatgctgcccagtgaacatctccatggaacacatcgaattttcgcggcatcgcaaaacggaaagtgtcaccttatggacagtccattgccgagggaaaataaatcgctggaaacgggaacgcccccggcactgtgcgtctggcacagtgtcgggggcgtttttccgtgtcttagttatgagccagttcatttaggagcagctttcgatagtccacatccaagatgccgcgatggaagtccatcaaacggtgttcgtcgaacagcttttcacagagcttggtcagcggatgattcattagctttgcagaaatgccagtctcgttgaaaaaccttgcccatgtgaagacctcttctaaatcctcctgcccaagcgtggcaggaatgatagcgttgcagagacggacaatggggctgtccgcaaatcgctctgcgacttcctccggtgtgcattcatagcggtcacagtcaaaggaaagcgcatcctcaattttaagataattttcggtttcatcccgcgtcaaggttatggtgtagtctcccataccggacggcacatcaatattctccatgacatcaagctcgaaacgggagccgccgatgatcgcttcaaaggagaaggactgacagattactgctgggtttttgtctatcttgtcctcattcagaaatgacagcggattatactccgtcagttcccagccgattttacctctctctgtttgctcggcaatctgctggatcagatgttgttcttcttcgtgcagattttcattgtacaacatgatacacctccgttttctgattgtcgttttttggggggctgctctatgtttccgaagagactgccgtttgtatcatcattccttggctgagggcagaccttcgtaaaacttcctaagttcgtccaaactgcttgtccgatttttgataggcagggagtcccatgtaatgtcatgatagcgttccggcggctcgtcccgcagtcttcggtcgataatgcagacaatgccggtgtctgtgaaattgcggatcaatcgcccgataccttgcttgagcttgataatcatttcgggaacgcggacatccatcagggcatcctttgcgacggaacacttatactcgataattggatcggggacagggaacggaagccggaaaatgatgacattggaaaggctttttccttcaatgctgattccttcccaatatgcacccgtccccagaagtacggagttcgtatcttccttaaactcaagcagcaccttgtcctgcgacgatcccggctgctgcatcaggattttgtacggaagatttttctcactgagaatggagtagacctcttccatgtcggtctttgccgtaaacagcacgagtgcctttccattggaaatgctcaggatctcaagcagccgctccacacccttttcaatgaaggcttcatgttctctggtcgggtgcgggagatcgtcgcaatagtagatcatggcgtgttcatcgtatggatatggggaaggctttggctcggataagcagccgcgatcaccagcgggaaagccggtattgctgataaagtaagaatactgttcttccagagacccgctcgtggcgttcgtcagcgtggcagaggtcaagatggttctttcatcaccattgaagtataggcggctcacaatttcttttgtgtttttagggcaatagacgagttccgtgttgctgccgtgctgctcaatccagatcagcatatcatctatccggtcaagaagctctgaaagggactcgctgacggcatccagatcatcagaggcagcaaaggaacggttgtttctgaaatccatgctggaataaatctgaatgctggacgaaaggttgtgtatggcggcgttcatctcggtaagcagttcaatcgcactgccgctttggtcaaagaaaaagcggtcagcgtagcgcatatcctgatctgcatcgtcgatctgcttttgaacttgtgctttcaggcagttatagaaggcgatgattgcgctctctgcctctcgcttttcaccggacacactgctttggtcagagggtcgcagttcatagaatgcgcttttaatcattccaaagagcataccttgcccgaaacgctccgttgtggcactccgcaccttatcatccaagttgtgcgcttcatccacgacaagcagatcagcggcggcgttaatcagtccgtcctgcccgcgtcgtagtttcatgagatgctgggtaagaaagtcctgattgcacagaacaacaccgtccgtgtattttaacgatgcacggaccttgtaatacttgcatttcttttcgcaggagccgcaattcttcatgctgaaccgctgcacgtttaccttgtcccagacgccttgcggcaaaacctccgggaaatccttgcgttcctcatacccctgctggattccttctttgagcgcgtccggtgggtctgctttcgggtcacacatatactcatctgcgcgtttgttgcagagataatgggtctgtccttttgcgaggatgacatctctgttcagcccaagaaggggcattaccgcgtggacatcgcgccagagctgttcttgaagcgcaatggtcgaggttgcgatgatgaccggcttgttcatgcgtttgctgtacagcagcaccggcacaagatagccaaaggacttgccaatgcccacgccagcttcaatcgcaaagtgctggtcgtttatgagggcgtccacaatctcaaatgacatatcctgctgcccttcacgcatttccaatccatgctgcggggcttcatcccaaaagaaggtgctgacttgctcactcatggagtacagctctgcttttctgcgctttttccgttcctccgatgtattgaatccaaaatagaatctgttgtccatccacattcctcccggaatagaaaccaaggctatccgcgtttcagttcaatgctgacgtttccgttctcgtcgatggtcagcgtcatgtgcttgatgtgcttctcatagaactgccgccgttctgccggagacatttcaattcgagtgttcctcagcgcggcatcaaacatatcgttgacgttcaggtgaacggagttgtcaatccagcggtacatctccttaaacagtgcgtttttcttgatgtcctcgctgttgccggagtagaagtcatccagatagcagtagaatatcccggattctgcaagtgccgccttcatatccggtccgcatttttcccgctcaatcatgacaaggaatctggcatccggtaaggaagagatcagcccccagtagtcggaatcgcttgagacgatgacgaaggaatccacttgcttctggtagtgttcctgacaggctcttgcggtgagcttgatgtctaccagtgatttgttctgcttgatccgctcaatcatgatatgctcaacgggaatgcgggtgtagttttcaagaatccgccatgccgtagcggtgtgtacgtcatcaaagagaatgatcgccgtaatcttttgcatgacctcataatcaagatttttgagcgtggcacacagtttgtacgggtcggagttttcgcagtccaccacaaatacggttttctcgctgtcatctatgaagtcgtagatattgttttttacaaaagcccctgcatcagagactttactgtattccgtgaaggcgtcgcaatgccattgataaagcagggtagcaaacttcttatcattatagaggacattaccctcgtccatcggtacccagttgatatacatttgataggggtagtaggagagacttgcgtaataaatatcggcagcatctttcgttccgtcctctgtcaaaccgtttggcatgatgaacagctcttttatgtacgcccagttaatccagattggaaagaggctcttgcagttgttaatgcggtctgaaatcagccggttgatctcgataatgtggtggcagagctttgtactcgacttttttataaagctgattccgtcatttgaaagctgctgcatactggaagccgggatgatctctggcattgaaagcagccctcgatactccattcgcatgatgtcatttattttccggtagttgcgctcaatggcggtgcggatgatacatagattacgaatgatacgggcatttttatcctgttcaagccggttgtatatctctatcttcggcggctcgtgttcattttggaaaatacgaagcgggacgccgatcaggtaagcgacctttgacacaagctcataggtgctgtctttgtaggcaatctgttctccggcatattcgattccattcaacatgactgaattgcccatgatctactcctttctcgtaggggagttaagcggtcattacattgtccgtccacatctcacactggctcatgacagtctggacagcatcatccataccctctggcggatatttgtgttttttcagcaaccttttgaccaggcggcgcattccagctcttgcgctctctttcttttgccagtctattgtctggtttttgcgaagcaaatctgtcagttctttcgtgatagcaataagctcgtcatgctcgtaaaagtccttgattgcttgcggctttgtgagggcatcatagaaagcaagctcgtccgctgtcaatccgagtttttcaccctcggcggcagcagcggcaatgtctttcgccagcttgagtaattcttgaatgacttcctcgttggtcagcattccgttcaaatagcggttcattgcgctctgaatgatttcggagaacttttcagacttgacaatatttgttcgacggtaaacagagacctgttcggaaatcagttttttcaagagttcgactgcaagattcttctccttcatgtttgccacttcttcaagaaacttcggatcgaacaacgaaaactcagtctggacatcggagaagaggttgataacaccttcgctcttgatgctgtgcttcaaaagctcgttaatgcgctcatttacttccggaagcgtaaacttctttccggtaccgcctgaaaccaagcgcacggtcattgttcttacggactcgaagaaagctgcctccatgcgagtttgctcgtctaccaagctgctgcacagcgaaagtgcctgcttgagaagcagggcttctttgataaacacattctgtgtcttctcatggtcgggaagctcgtactctgcaacactcttgccgagtatgaagttcactccgccgctgatgagcttcgccctgtcgaggtcgcttccggtcatgaatttctcataactgaatccgtggaacaaatctctgcaaatagagagcttttcaaggaacttcggatatgcagccttgcttacatctgtatcaccatagttcttcttgtctctggcagtatagtcgttcattgcctgtttcagtgcagccgcaataccgacgtaatcgacaaccaaaccgccttctttatctttgaagacacgattgacgcgggcgatagcttgcatcaggttgtgtccagccatcggcttatagacatacatcgtagcaagggagggaacatcaaagccggtcagccacatatccacgacgatggcgattttcagcggagagttgttgtctttgaatttccgcgccatatcgtccttatgagctttgttgccgataatctcacgccattcttcgggatcgttattgccttgcgtcatgaccactgcaatcttttccgtccacgctgggcgtagctcaagaatgcgcttataaatcttcattgctatgggacgcgaataagcaacgatcatcgccttgccggttaggatattctcacggtaattctcgtaatgatcaagaatgtcatttaccaaggaattgatcgtctggtcggcaccgaggactgcttccatctgaccaagttcctttttgctcttttcaatgacatacggatcggcgttgtcagccataatgtcatactcattatcgatcagatggagggtgttctcgtcgagtttcaggtgaatcacacggctctcgtagtagacgggtctggtcgcgccatcttcaactgcctgtgtcatatcatagatgtcgatgtaatcaccgaagacctctcgtgtactgcggtcttttgtggagatcggtgttccggtgaatccaatgtaggtcgcattaggaagcgtgtctcttataatgcgggcagtgccgataacggttttcgcctcgacttcgccgttgtccttctgcttgaccacaaccttctcattgagaccatattgcccacgatgcgcttcatcagccatcacgataatgttccgacgctccgaaagagcttcgttgctttcttcaaacttctgcatggtcgtgaagattatgccgtttgcctgtctgtttgcaagcagttctttcagattcttgcggctctcagcgtgctgcggcgtttgccggaggaagtccttgcagcgggcgaattgtccgtaaagctggtcgtccagatcgttacggtcggtaatgacaacgatagtggggctttctaacgcttcttgcagataatgagcatagaagaccatagacaacgattttccgctgccctgtgtatgccagaagacgccacccttaccgtccgtcacggttgcgtgttttgtagactcaatcgcctttttgactgcgaaatactgatgatacccggcgagtatcttgaaagtattctgtccatccacattaaagcagatgaagtttttcacgatgtcaaggaagcgggtcttctcaaacagtcctacaaagaatgtgtcaaatgatgcgtgttgcgtattctcatagctgccgtctgttgttttccactccataaagcggtcttcgccggacgtgattgtaccagcctttgaagtggtcaagtcactcatgacacataccgcattataaatgaacatagaggggatctcatacatatagttccggagctggcggtatgctgcggaagcatcggtttcttcgcgggacggagacttcaactccacaatgacgagtgggagaccattgacaaagagaatcacatctggtcttttttcggagttctcaatgaaagtccattgattcgcaactgtgaactcgttactggcaggatttttgaagtctacaaggtaaacaagggtagagcgttcttcacccttgtcatagtattttaccgggactccgttttggaggtagtccataaagaccatgttcttctgcaaaagcgttccggtttcaaagttcttgagcttatagattgcctccgtcagagcgtccataggcaggctcttgttgatccgctgcaaggaaggtagcagaacatcctcataaagcggcgagtgataatcgcgctccacgtccggtccatagatatagttatagcccagttcttcattgagaagctgcaagacagcgttctcgtaatttgattctgtaaaatatcctgccatagtttgtcactcccttttacgccagactcgccccgaactgatccagcgtgttttctgcatctctgtcagtgacgggcttattcatcgctttttcaattaggtttagaaggctttttgctctgtcgatgaaatagccattgaagtcatctgccttcaattctgcatagttgataaagtgcgattccacccgtgcttgcaactcattctcggtcagtccatcaaccttctttagaattgcccccagatactcactcggcgcatttccgccaatcgagcggttggtggctggaagaatcggggtcttgttaatgatggaattataccgttcgcgcttgatgcccattttctcgcaatatgcttcggggaatatatggtgaatatccggagactcaagcatactgtttacaatgtcaatcgtcgtgttgttcataaagtcacgacacttctccttgtaaagaagagccattatacctttatatgccgcgctcaagcgagtttgaagggttagcagccgcgtagaagaaaagactgcgctgttaatcgtgtgcattgcattcggacgtccattgacctcttcaaccatgtcctcaatgtcataggcatagcgggtttcgttcgcaccgccatacatctcacccaaaatcccgcaccaataccaccgagaaagagttttgattgtgtttggctcattgcatttggattttccgagaacagcgcagattgccgcaagtggaatcaactgcgttgtatagggcaaatctctttgacggaaaacgcactgatcacgaagaagaaactcctttgcgattttgaacccagacagcactgcatcccggttcgctatgtacgattcataaggaagtcccagaacatctttctttttgcaggagattgtgtttgtctttccagactgcttgttcaaatagcttgtatagagacaaaccgttgtcaggaaggtagtctcatcaatcccatcgaacaagtctgttctcagcgtgtcaccgaaaccgcaaattgtatttcgacactgcacccagtcttttctcaggtcaaagtctcttgtggcataagttgcggtaacaagctcaaacaccgtgagaggaacaccgccagtattgacgttctcaaacaccttgcacactgcctctcgcggcgtggacttgtccagtgtaatcacaggcagcttatacccggaaattgtattcagcacatccgcttggaaacgcttgaactcgtccattgcttccggcttcattccgtagtgcgtcatgtagcccatgaaccagtccataactgcgttgctgtcgaatacgatattgaccggaaacagcttgttctcgtattcatattctctggtggagagatcgagcttcacatcccggtcaaagttctctttaatcttacggtcttcggggatggagaggacagcatcaaaacgatcctcatcatcgtcgaggcacttctccattgagagatagtaataacgcttaatagccttgcctttttctgttttggtcgagaccggctctttagaggatgttgcctgataaattgaagtaagccgctgctgaccatcgagaatcaaatgctccggcttcacagaaacgccttttacgcccgtaattgtacggtatttgaattggatgtccggattgccgtattgcagccgcatgatggcacccataggataaccctgtgataagctggcgataatgcctctaattcggctatcatcccaagtccagtcgcgctgaaactccggcaactgcattgagccggacttaacttccgctaaaagctgacttaggtttgtatcaagagattgtggtgaaataatcacgtctgcgcctccttcattgagtcttactgatcggacgagcccagtctgctttccaaatctgaaatatcactgcgtatggaagagatgtccgactcaatatcttcgattctcgaagttaatgttatctgctgaaattgaatatcctcgatctgcgcgtataagccacgcattgccaaaattagctcaaccatcagccccttgtcatcaagggagagaaggcgttctttttcagtctgtatcttttgagcctcctgttgaagccgctcttcctcacgagctgcttctgctgcggctttctcaagacgaagccgttccttttcaagccgctttttctggcgctcgtctttgcttcttttcaagctctcctgaactttatcaaacatggtatatcctccatatcaggtaaacgataatttagagcagcaagcacagtcctattttcaagaattatttgttgataatgccagtccagaatggactaccggaacaattagcgatcttggtactgttgttggaggcagtacaccttcaaaagctaaacctgagtattacacggagtccggtatagcatggataaccccgaaagatttatctatcaacaagtcgaagttcatttctcatggcgagaatgacataactgaactcggtttgaagaacagcagcgcagcaatcatgccagaaggaacagtgttgttctcatctcgtgcgccaataggttatattgctatcgccgctggtgaagtaacaacaaatcaaggtttcaaatcggttgtgcctaagccggaaattggaacaccatttgtttacttcttcttgaaaaacactctcccggttattgaaggcatggcatccgggtcaacattcaaagaagtatctggcagcactatgaaaaatgtcccggcggttattcctgacgctgaaattcttgccaaattcagcgacttttgcgcacctatctttgcacagcaacgtactttggaagagcagaatcaatcgcttgcgaaattgagagatagtttgctgccgaagcttatgtctggcgagatcgatgtctctgccgtccacctctaagcagctaaattatcgtttagcttttggttgttctcaattttatcatccagtgatgagagaacagcggctatccgtttctggttgttcagatccggtaaggcgatttcgacctctccaagaagtttcgtattgatagaaggcatggtcgcgcctactgcaatattccgaacaaactgcttggtttcttctaaacagaaataataatataggtacagagaatcaaccagttcagttgggcggactcgtaagcaacgtcccgagaacatccatccgtcgtgtgatttatcaacataggaacagcggtcaacagacccaactcggctgaatacaatatcgccagttgaaagagtatacttaatcaaccgcgctttatcgctgtcggaaactctggggagattttgctcggtgaatactcggttcccaagatgttcaacagtgacaataggggttccggtttcaacgtagtcttctttgtggagttggcttccgaacggaccagtctgtatgtctgcgatggttttaagttgcgtcatcctcattttcatcccatcctatccaatgtattttctatgtgccagcttcacattctgttgtttcaccattgcatagtgcatggtggtgtcgattttctgatgccctaagagctgctggacttgctctatgggcattcctttgtctatggcagttgtagccagtgtacgcctgaacttgtgagggtgaaccttcgggatattcagacgctttcccagctcccgaaggcgtgtctccactccgccaatcatcaatcggtcaaagggcgctttcagtgaaacaaacaaagccgggttttcatcggttctgccctcaagatagttttgaaggtgtatcttcgtccttgcatcgaagtagaccaatcgctctttattacccttgccgataacaacgcattcgcgttcgttgaagttgatgtcttcgcggtttagcgtgacaagctcaccaacacgcattccggaggatgccagaagatcaatcatcgccaagtcccgtgctgttgtgcagttgtcacgcatcagctctaacgcttcatcggtgtaggtgtccttgaccacctttgcagtcttgactttgtgaatccggcgtaccgggcttttcaagataaagtcctcatcctcaagccaagagaagaagctggacagaatccgacgaatgttgtctatggttactttgctcgacctgcgctgaacctgatagttggtcaaatagcggcgcaaatcatctgtggtgatctgttgcacagcctttccaactctggaaatcagagcctcaatcgtcttccggtagtagctcagggttttctccgaacagccttcgatccgctttgccgtgataaatgcttcgactgcatctgtttcttctgctgggattgagccactatcataggtgatcgttgccccaactaatgtcgcagtcattgcatcccgaaggtgcatgagctgttcgttgttgagatacggaagcattttttgctgtatctccgtgatgagttgttctgtcattgtcgtgtctcctttcgaggtaagagaacgacattcagtggcagtcccttttgtaaaactctcgccactggtgagagctattcaggcggtaaacgataatttagcggcttagagctggatggcagagacattgatctctccggacatcaactttggaagaagggtatctcttagtatggacagccgtttattttccgctctattagaataaatctgctcaagaagtggtgaagcaatggtattaaacccagctaactcttcttccgatggtagaacaacagggtatgtcataatctgctgcttatctccacggggcattttcgttcctttcgatccagcaaccataaatgcgaagaacttgtcggcatatagagtgctgaataggtacgccgagtaacacggctggcttggcgtaaagcaaagaacatcggttgagcagccacatttgtcctcacagtagacaatcttcttaaagtaaggacgaatgttggaaatcaacgtatcacctttatggcaagcggttgtctgtgatgtagttggtaggcttgtcgcctcggttgaaccagcttttcccgacagcatattttccgttgagaagtaggttctgacgttcaactcagagacagctactttgtctgttgaatatgagcaaatatccgagaggactccctgatttactgccaaaatgtcattgccgaaccgcccttgatatatcgtttgcaggagatcagctaaattatcgtttatctctttgtttacaatcaacttcctatcaatagattcaagcgtacctacgatggcgttctgctcatcaaatgacacggggtagttgatcataatttcatctaacaggcggtcacggtttagttcagtttgtcccgtagagccttcatccaactgcaagacttcccattggtgcgctttaagagcgtaaccaaggaacttctgcgttacctttccgtttgaacggataaggatcatgtgtccgtctattgtagttgcggacggaacatcttcaatttgcgcaattctcccagcagttcccgcacctgtcgaattgatcagaatatcatcaggtttgacatatcgttcaggagggactttctttttcagggtatcatgcaaccttgaatctccatagcttattcggaaattccgattgcacttttgattgagaactctaatggttgtctcggatgcttcttctgcatacgaaggagcaattcctttggaaatatacccaaccagctctcgtaacggtacctcatgccactcagatgtcatatccaatcgcccccagtcgttctttgatctgagcttcaatttcatgagacttagtgaaaagctcagacagttcagaagtcaggcgtcccattttctcttcaaacggctcaccgtcatcttcctgttcctcaatgccaacatagcgtcccggcgtgagaatgtaatcttgctttgcgatgtcctgcgtagtaacaaccgcgcagaagcctttttcatcttcaagcgttccttctacaaaggcgttgtaggtgtcggcaattttcttgatgtctacatccgtcagttcgcgcagcttccgcgtaaccatagtgccgagtttccgtgcgtcgatgaatagtgtcttgcctttctgcttcttgttctttgcaaggaaccagagcgataccgggatctgcgtcgtgtagaatagctgcgtcggcattgcaacgatacagtccacaaggtcagcattgataatgttcttgcggatttcaccttcaccgccggactgcgaagaaagcgaaccatttgcaagcaccatgccgatacgaccattcggagcgagatgccagatcatgtgctgcaaccacgcgaagtttgcatttccagcgggaggcgtaccatactgccaacggacatcatcaacgagtttatccgcaccccagccggagagattgaagggaggattcgccataatgaagtctgccttgagttgagggtggcaatcgttaaagaacgtgtccgcattaaacttgccgaggtcggcttctataccgcgaatggcaagattcatctgcgccatcttccatgtggtcgggttggagtcttgaccaaagacggaaatcttgttgatgttgccgccatgattttcgatgaactttgcggactgaacgaacataccgccagagccgcagcacgggtcataaacacgtccattaaacggttgcaacacttcaacaagggtacgtacaacgcaagagggagtatagaactcaccagcaagtttgccttcttgctcggcaaacttggagagacagtattcgtatgtccgaccaagaatgtccttactgtttccatgctcgatcatctgaatgttggtgaagagatcaaccacttcaccaagacgccgcttgtccagctctggacgggcgaagttcttaggaagaatatctttgaggcgcttgttttctttctcgatactgcgcattgcgtcatcaatcaccgtgccaatttctggcgtgtgagcggcagcagcaatcgcactccatcgtgcattctcagggacaaagaagatgttttcggcagtgtattcgtcctgatcctcttcaaatccatcgccttcttcaaccagttccttgtactttgcctcgaagcgatcagaaatgtatttcaagaaaatcaatccgagaacgacggacttgtattcggatgcgtcgatgtttccgcgcaggacgcaagccgcgtcccagatttgtttttcaaagccgatattgcttgtgttattctcagccatttcagcaacctccaaagttatagtttcacacttactatcctacaaaaagagctgtacgaaaaaccggacttagttcttgtccgttcgcacagcctcacatatatctccgatgtcacagttcaagtaatcacaaatgcgcagcaaaatagagagggacacttcttcccccttattcagttttgtccatgttccggcagacaaccctacttcatgtcgtagagaagccctctttatgtcgcgttccagaagaagcatccatagtttcttatagcttatgcgcacggcaaccatcctttcgcttgcttgcattcaacatcgtttctaatattataccggatttcattctcaaaagcaatccgttgatgcagaaattaaagaaatagtttcaacttctcgaaccttctctcaaggatgcagggcatctccggtcaacagaagatgccctgcttttgaagagattattcgcgctgtgtgccgcgcagatgatcacggtcatggtcagcagaaggagcgagaaacgtatcaacattagacttgattgtctctatttgctttacttcttttttgagcttcgcacgttcatcatagagtcgctgctgctcgtcaagaagtcgctgctgttccgcttgcagtgtcttcaagctcggcagtttttcatcgccctgcatggcaagcagcgtactccgcgccgcctcaaagatcacaagttcggcttcatgctttgccttgaagctcggcttgtctttcgccttctggaaggcgtcatatacgggttttaggcgctggtagttggagatgtttttaataagcggctggacttcccgcagacgtgcttcaacgactttcagttccttgccggtacgatcataggagctgtgaacatcctcgaccttcttctcaagatcggcgtattggagcaagttgttttccgtgagatagttgagcgtccgtgccgcttccttgaggatcgtgagcttggctttatactcatagcccttgctgtcgataagtctgatccgctcctgaatatctccgatgagagagatgcccttcggcacggtctgcctccggtttctgcgcggcgtccgtccggcaatccgctccttgatgcgttcctcggtgtagttctctccgatggttttagaccgggtaaaccgctcctgtccttcagcgcgaaaggagatatatttgccggtcttgatttcataaccagcttcctgcatgagccgcagaaaatcatcgtaatccttcgctgtaatgacaagccggtcgatggtctgcttgagtttctgcttccagctcgtgccgcgtttggcttcggtgtactccttgtagcccatgcctttgttctgagagggagggataacagagagaccgttttccttacagagccggtcgctgacctcgcgcatatcatagtaaatccgcttgtagctcttgtatgcgtggtagtccacaaagtcaaccgcattgaaaatcagatggttatgaacatggtctttgtcaatgtgagtggtcagcacatactcatattttcctccgaggatttcgtctgcaaactgcttgccgatctcgtgggcaagctccggtgtgacctctccaatttcaaaggactggatcacatgacgggctatgatcctgaccggattcatccctttttgctcggctattttccgcgtccattcaaattcccgcgctgcggtctcgctggcacagccgtaggacgagaccagcagcttctcgtcagtcttttcgggattcagaatgtacgcgattgccttgctcaaagttcctcggattgctttgattttagtaactgccataccgcgtccatcttttctttcagctcgtcaatatcgtcctgatagaatcgtcccgtcgagttgatcctgcggcagacggtattgatgttcacgccgatcttgttgatttcggcggcgagctttttctgctctgtgtagtctacgacaatgatgtagccgtcaatcagcatcttccttgcatacgcaccgaagttctccgttccgatcatctccatcttctttgcaatcgtccgttcttcctgtggtgtcagccaaatcttcttctgaatgtctcgtgttcttcgtaccatgctgtgccctccgtcgtaaagattagaagggtttgggactatcccaacaagcaaaaatctgatgttaagggcagggtctccttaactgatttttctccggtgggtactcaccggatttgcttgctaatctcccaaaatcgtattccccgaagattcctccgtgaaatgtcccttcactttacaacggacacaaaaagggcgtttgttgagtaccggatttcaaaaaagttaaaaaatcattggatttcccatgtgaaagccaatgtgtctgtcacatcaatatcaaccggctcaatctcaggtgcggcgcacttgctcatcgccatgagaggctgaatgcagtcttcaacatcgtagcttgttctggaaaaaacattgagttcgccccagttgtagtcgatgttgagcaactgcccaagcgtactgcctgatgctttgcaaagaatctccgcctttgccctggcgttctccgtcgcattgatcagcagctcttcgcagactcttgccgggtttttcacggtgaacgcaatgctgagttctggttgcgccccacaatccgcaatcgcagaaatgacctttgcaagctgcttgctgtcaaagtcaaaggcaagtttcaagcgatagctgcaagcatatccggcaaactctcgcttgtaatttccttgccgatccttgacattctcgtaccttgtctggacatcaaagctcgtggttttcaggtcttccttgcgatacccaacgcggactgcggcaccttgcagtctttcgattctctcggcagcttccgacattgcgcggtcataggtttcagataagacttcaatgttcagggataggatgatgtaatccggtcttgtggagacattgcctgtcccttttacggtgattgttctcattactttctcccgtcctttctggaattgaagtcctcatcaatacgttttttccaattcgtacccagcggtacgctgcatcggacagcggaaaccgctttgctcagaacttcatagttgagttgcgttccctcgcggtcagagtggtaattgaccgctcgatctgctccaattccaaaatgctttgccgtctcaactgcatcaatgtttgcaccgaggaaaagaaactcccagccgtacttttccttctgtcgctcaatcatcttcttgaccttctcgctgtcataacggcggcttgcattctccatgccatccgttgtgatgacgaacagtgtgtgttcagggacatcctcttttcttgcgtacttatggacattcccaatgtgatgaatcgctccgccgatagcatccagaagcgcggtgcagccgcgaacggaatagtccctgtcggtcatcggctccaccttctgaaccggcacacggtcatggataacctcgctcacgttgtcaaagagaacggtagagatcaatgcctcgccattctcttttttctgcttttcaatcatggagttgaatcctccgatggtgtctatttccagtccgctcatagagccgctgcgatcaaggatgaatacgatctccgtcaagttctttctcatgttttgtacctccgtatataaaaatatgactgcttggtgtctcaccttacagtcatattgtacttcggtattcacttcatttggtcgcatggcaagcgacattattctaaggacaagaacagctctccgtcaatgcttaggatgtcatccatcggaatcttcgtgccgtcctgcatggtaatcaggcgctcaaagtcatcaacctttatgactgcgccggttgcagttacatacgcaccgccagctttgcgctcatcaggtttgaagtaggttatttcaacctccggctcttcatcaagggcatccatgagaagctgatacctcatgttcaaagcggtcaaggctccctcatcaagctcaatcctttcgtcggtcagacgtccggtttccttgattgcagaatcatagccggtgagggcggcaaagggcgcaaactgcgctgcacgatctgacatcggcatttgtggtcgcgttttggaaacgtggtgaggaagtcccatgatctcgtcgtattttccgttcacgccttatgccctccaatctgcgcattgcggtctttcgcggttgcaccttcttcaagattcattgccttgaggatggcgttctttccatacttcttcttgatggcaagcgtggcggcttgtatcttccgctcacgctccaaagcggcatcttcggctttctgtttttcctcttcggcggcatagtcggtaaagaggtcgagctggactgcaccgtcgtttttcttcggtacatcagcttccggcaggacatgatttgcaacaacatacatacggcggacaagcagattcttatccacgatccggtcgaagagttctgacacagcacacattattttgcgagtagatgatgtgtgaccgtcgagattgatagagccgtgcgcctgtttcggaatctgcctcccataatgatctgtctcaaccgcgccgtgatactttgcccgtcgtgccggatcggtcaggttctcaatgtcgtagccgactgtgagaaccatttggtcggtgacaagccccttgtccaccaagtccagcacaagcaaatccgtcatctctcggacaaccagctttgctttatccgtctcgtatgggcagtgcaatacctgaccggagctgatgctgttggagctgggacggtacgccttgatcgcttcaatggtcgtaggttcccaaccccacgcatggtcgatgagcaattctgcattcttgccgaacagcttgtaaagcaagtcctcgtttcgctctgaacaaagtgcaacatcgcccatcgtaaacatcccgttttgctcaagtttcttggcaatgcctcgacctacgcgccagaagtccgtgaggggctgatgcgtccaaagctcacgccggaacttcatctcatccagctctgcaatgcggacgccgttcttgtcggcggggatgtgcttcgccacaatgtccattgccactttgcagaggaaaagattcgtgccgattcctgcggttgctgtgatgccggttgtttcaagcacatcgaggatgatcttcatggcgagatcatgtgctgagagcttgtaggtgttcaggtagtccgtcacgtccatgaacacctcgtcgatggagtagactacgatgtcctccggcgcaatgtacttgagataaacctgatagatgcgggtgctgtactccatgtagtacgccatccggggcggcgcgatgatgaagtcaatcgccagagacgggtttgcttgcagctctgagaagaagtgcgatgtgccgtccagcctgtgtcccggcgcgtcgtgctgccgtccgacattcgattccttcacgcgctgcttgacttcaaacagccgtccgcgtccggagataccgtagcttttgagggagggtgtaacggcaagacagatggtcttgtccgtccgactttcgtctgcgacaacaaggtttgtgtccagaggatctaagccgcgctcccggcactccacggaggcgtagaaggatttcaggtcgattgcaatgtatatgcgctgcttcatcttctgcgcctccgatttcttctcagattagctctaatgacatttcattggagtttttgatgttgaatacgatacgccattcaatatcaccctccaccggctcaaagtgtagagcggaacaagctgcatggagtttttctttcgagctgcctccacatacgattgcggttggaccgtccgcgccgccgataatgccgatacaagccatatcgtttcgtgcctccggtgcatagcggtcagagcatggcgcaatttccaaaggcttgtccccctcagcacaatcacagatcgaaatatcgctgtccggttcaggagaaagcgtatagctcatggcggtaaaatgcgtcggataaaaccagcggtcagagccgaaacgcttttcggaaattgtctgccgctccaattcctgtacagttaatgtgtattttgtgccgctgaccggatgggtgaaagaaaacgaatcgccgggagcgtgtgtcttaaaatgtggtcctgggacacggcatgaccgctgctccatcgtaaaggagagagattttatttcagtacggcgtttgcttgcccacggaaaagctgcccgaaaaatcatccatccataggatatatccaagtcatagtgttccaacgcccactttgcttccaattcattgatcatcccatccggcaaacacggattataaaccaccgagcagccgtgggagattcgcattgttttcccgttcaattccaaacgaggaataaagtcaaggcaaagcggattgtctaaatcaatttgcatttgctgctcctgcgtgaagtattcgcaggagtcgttttcggggtgcaaatcccatttcgtcatgaacttgcggatgtcatcctctggggtgcgcatacaaaagtccatgacgagtcccttgctgcaagaatacgccgcaggaataacccaatgatgtcctgcccagtcaaattgcttattcaaccggagttccgttccggaacggtcttttcctgaatgtccccagaagtctccatcaaagtagaccttccattcaggtatggtcggttctgcttccgggttcatatcaacatcataatagtcctcggtgtacttgatcttgctataatcaaaggatgcttgcagctttttgatgtatgcccacggttgttccataggcgtcaatttcattttctcggcaagctctgatagcgcttttttctgttcatgcgttggagggttgtcccgcaaaaaggcttcaaattgggctttatcccacatccacgcctgttccaacgctgccgaatcaccgcaagcaaggagcagcctcagaaagtctgcaaaattgtttgccagcggatgaacgaaatccggagccgagttcgtggggctgacggaaaataccatactgccgaagcctcgaacaaagcagaagtgaatgccatccacgccagcccagccaaaaatagatgcacctttgggcgtgcaaaagtaagggttgttatcttcacgacactccactcctacgacagagagttcaataccacttcgcaaaaatttctgaaatactttatccatagaccttatgctcctattaaactctggtcaaatgcaaacagagcctcgttgatctcaaagacgttatagttcccgcgctccacgaaatactccacgatgatgtcaaacttattggaatgggagagcgcaaagccagccttcatgagcatatccttcatttccacaagcggcagctcaagggcgatggcaaatgcaatgaccgtgggcttagaaggcttataggacttgtccgagcggatcttcgagaagagcttccggtcaatattcgccttcttatagcactgcgcgtccgtcatgccgcgctcatcaatctttcgcagaagcatctcggaaaaactctcgtcaatctgtcccagcgcgtcatcaagggttgccgcctttttgggggcagccgccgcaaagacgggaggcatgagctgttcgattgcctcttcacaaacggatgcctcgcaaggcatgggttcttccatccggaaggcgttcatcctgcgcagccgctcagaacgaggatcggtatgctcatccacatagcggtcgtctatgtacgctgcaatgtcggcaaacagcttgccgctgatctgataggctttgcggtcgaaaataacgatgtacaccgtcatttcgttttcaagaaggaaactgctgatggtgtcaatcgcaaccttgagggcttgatcctttggatagccgaaaatgccggaggaaatcagcgggaacgcaatcgattcgcatccgtattccttcgccagcatgagcgatgtccgatagcaggagatcagcagttcgcactcaccgtgccgaccgtcataccagcgcggaccgactgcgtgaatgacatatttgcagggcagcttgtagcccttcgtgatttttgcgctcccggttttgcagccgtggagcgtttcacattctgccagcagttctggtcctgcagcgcgatgaatgtagccgtccacaccgccgccacccagcagcgactcgttggcagcgttgacgatggcgtccaccttcatttttgtgatgtcatttctgacgatttgaagcggcatgattcaatcctccgtcctatcaaagcggcatcggtgtccgggcgatcagaatgaccgccagaatcgcgcccacaaatgccgctgcccctacgaccgccaacacctttttgtcgagcttcttcttcgctgccttgccaatcagcgcagcgcaagccatgcagacagccgcagcaacaagcgcaatgcccagcgtttcccatagccaagaaagttcatgtaggattttcatgcgatcatcatctcctgttcgttaaactggaatttatagtcctctcaaaaccaatttgctttttcttctcgaaatacgggaatatcactatctcgatatggattgtaattatgaagattgcaaccaaactcttttaatgattttattttgttatcctgtgtccatacaattaaagatattccgtcaaattcttcaacatttccattattcattttgtttttaaaataccactccacgattgtttgattgccttgatgaaaaaattgcttaatctcccagacaagaacacttccgcgtgtattccattcgtcaaaccagtgctttaccgttttgcggttttcatatttaggactccaactctcagtatatacaacatcatctgtaaaaatattgtcaattcctaaatctgctttcttaatccacatatcaaaccataatcggataattttttctctctcgttcataaagcacctccacaacttccgatttgtctgccccttaaagtccaagtccttcaacccacgccgcaagctcctgatgcccgacgcagcccttgaaaaccttgccgtccatcagctttgcgcctttgcagctcggcgcaaggcgttcgttcgtcttgccaatgtcgcttcctccggaggttgcaaacgggatgatcgtcttgccagtcatatcatagctctcaaggaacgtattgataatcgtcggcgcaacgtaccaccagatcgggaagcccacaaaaattgtgtcgtagtccttcatgttgtcccgctttatggcaatctctggacgggaaacaggatcgttcatctcaatcgtgctgcgggctttcttgtccatccagttcagatcggcttccgtataaggcactttcggctcaatctcaaagatgtccgcgccgattgcctctgccagcgtctcggcaacctttgcggtcacgccggacgcagaaaaatacgctacaagtttcttactcattgtgttcttcctcatcaatcttttcatttccttcattcagcatgaagtatagcagagcttccagcaatgttgccatataatgaagcgaccagttttcttccggctcttttgtcatcttatcaagcacggctcgaaaagccgtggtacggtcaatccttgtttcatcatcaatgcggtcaagtatgcccttcattttcagggcgagttctttttcctcgtcagaaagctccggtatgccaagtaactcagatagtttcttgtcctgcataatagcatcgtattcgatgtatgacttgtgttcggctgacatcaattcttcaaagtagttgataaaaatatgaacgcgaatgccaccttcttcgtccggggagaagcagacggtttgcgatttttctgcaatttctttcaaaaatgcaaggtcttctgagtcatcgaactccgcaaacggaagaaacatattgatttccgcgtgccaacgatgatagtccacgattcccttgatatacccgcggtgttgcttgacaaacgcatcacagcgttccagaagatactcgtagttcttcttgtcctccggtacaatgatctttggtatcttgtccattgcttcggagtacgctttcagcataccacaattaactgcgcggtcaaacacctcatcgcaccatttatcgtattcggcagactcggtttcccggtaatccttctcaaagataatatcgtccattgcgttacccctttatgattttctcaagctgcatttcggtcgcgttaggcagacgtgattgcagatgttttagaatgcgttctttggattcctgcgggtctcgctgataggcagatgtgataaggtcgtacccgaaaagttcttccggcgtcgcatactctgcgacaccccagccataaggtcttccgtatctgtcctgcatatagacgaaatccgcgatgcagacatagctctgcatttgcagccgcgtgatgcacgtctcaaaaccggtgttgccgcccttgcggtagttcagagcctctttcagccgtttggaaagcatcctgccttcaccggctatggcttcataaagctccttgtccttgtaggacgccaagccgtcatcccaacgggcgtcaaagtcatagccgtcacgccggaagttcgcaaagtccggaatccactcccgactcacaaatccagccttcttgttgaaaagtttgccgtaaagacatttgccgctccgcgcagccggtcctttccattcccacggaccatctacatcatccgcaaaccataactcaggtgggcaaagttcctcgatggagaagccgtgaatctcgttccgaaagaagggcagaaagccgtattgttcgacggcggcaatcaaaccatctgcactatgtagttgtctggcatatctctttgacattactccgcctcttcaatcacgccataatcaatcaggatgttcttctccgcatactgcgggtaaacaacacccatcatctcatactgataacgtcttacgcggcgatgctcctgaattggttccggtgcatacgcagcggtttcacagtgcgcatactccggcatttccgcaagatcatcccgaacatcacggataagcgcttctgccacatcatcaatgttcttgccggtctccacggcaaccagttcgtgcttccggactgccttgtccagattaccgggggagcgaaacagcttatatttcatatcgttgcccgtcctttctctctttcggtctgcctattcttcctgaaatctgttctttagggacgcaatcatcgcttgtgcggcaatgctcagatacaaaactccaatttcatagataaagtcgcggtcgatcacgataaagtattctctaacgtgtgtaaaaaccagttccagcaagtccctgtacagcggatcatcaaagggcttgaaccgcgtaaacttgcttttggcagcgtcccatgtcatagacgcttcgccctcagaactggtcattgcctcacagagaatcatgctgacgcccatttttccgttgccggtcaggagttctccttcgtaatagctgagtaggtctttcttgcgtcgaagcggaactacatcgcagttgtcatccagctcaaatgcaatcagctccgcaatcagttcccgccagaccgcataaccggcgttaatggttccgtcctcttcgcggctgatggtatcgtccatgcagtatcgctcaaagaaattatctccgtcaatctcgttgcgggtgcagaagatatgcgccagctcatgcagaagaatgtgcttcaactctgccggatgacgcgctatgtctgtgcgcagaaggattccgtccgcgccgtctcctgtgccgacgaatgcagaggcgtgaaagtcaaaatagccgtcctctgtatatcggtcttccagccggtcagggaaatactgcttgcagaactgctcaaagacttcctgctggttttccgtctgaaagcagcgcagtacaaggttgtcctcactgaactctgcccccaagcgttcgttaaagatggaagcggcatagaaaagggcttctttatagtcgtcgttgttcatctaattactatccttcatcctcattcacccctccggtctgacatttttcaggaagtcagagtgcggtacataaggcaagttgagctgccagcccatgcggttcagttcgttgagcttgatcagcatcaggttgatgtttgttcccattgcagccgagagctgcaccacatcgtagtcctgcttcatcaggtcaatcagctcatcatcgtcaatgatcaggtgtgaggcaaacgcattcgcctcatattcgtgttttgtgcgcatatcgaacagcacgaactccgggagcggttcgtttcctttggcaagatcacggtgaaaggtatcatgcccgatctcgtgaccgcaaaccatttgcatgatcagatactccatgttggagttcagaagaatatgccgctctttatggcggtaggtgtacattccgagcagatcgttcagattgtcaagaaaatggagatgaatgcccagctcacgggcaatcttcaaggtatctcttgttccacagcttttgacaatgctgttcgcctttttgtatatttcctcggagcgaattatcacgggaccttcacccctttcatgttgaaaacagtcaaagtaaatccgtcaagaaaccgagacgcagacagttattcctctgcgtccgtaccggtcttcttgtatttcttcggcgtgtatttctcaacattccgggctttggattcccaatatatatcctgcaacgccttcatcaccgcatccttgtcctgctcagacagcgtaccgcccgcaaacaagccggacatcccttcaatcaggtcctttgcctgtttcatgccacgggagccgtactgctcggatgcctgaaccacaaactcttcgtcctcggtcagcagatagttcacatccaccttgaagtattccgcgatttttctgtaagcgtccttggtacggggaaaggaaatgccgttctcgtaccgggtaatcatacgcctgttgatccccagtgcatcggctacttcctgctgggtcagcttccgcttctcccgttcagccttgaatttctctccaaacgtcattttggtaatcactcctgttcacaaaaagtttgcgacatcaaattgcgcaagtctattgacaaaggcacttgaagtgcgtataataatgactgagcaatccaactactcatagtatatcctgaattgctcatcctgtcaaggggcatgagtagttgtacacgaaaaagttacatcttttgagcagttcaaatggacaggcatttatgctgccgaagatcatccgtaccggcatacaccggtatgagggaacaggagtgagaaaaacagaaatggctacacagtacagaaaagcatacgtcccggttacgctggatgtggacaaggagggggcaatcctccctcgccttatctggtgggacaacggtgtaatctttcaaatcgaccagattctatacaaatgccgcgccacatccaaaaaggttgggggcggaggcatccgttacacagttcagattcgcggaaaggagtcatttcttttccacgaaggagacaagtggttcgtcgaagcaaaggaggacaactgctcatgattttatcccagcgccaacttgaagaaattgcagcctcaacaacgaaggacttcaaccggttctttttcggggatgaggcggacaagcccgaccgatcagctttgccaacacccattgatcagtttgcaaagaactatctcggtcttcgcgtatcattcgcccgtctctcgccggacggaagcatctgcggtgtcactgcctatgccgacactgagtacaagatcacggaacttggtattacgcgcacactggctttgaagcgtaatcaggtcatcttggacgagagcttcattcgatccggcaacgtgcagcggctctgcgccaagcgcagatttacccttgcccacgagtgcgcccatcagattctcttccaactggaatcggaagaggtaaaggcttcctgcgaaatgaaatattccgcacggacagcctatacgccgcgagagctgaaaacccgcgaggactggaacgagtggcaagcaaatgtcttgggcgcggcgatcctgcttcctcaaaaagaggttgacctggcaatgcgtcggtttgcagaaacgccgctgatcaattacgaggggaggtattcgtatggtgatcacttaacgctgcgccttttctgccggttgttcggtgtctccaagacaacggcgtctatccgccttcgtcagctcggctacatggtagatcgtccattcagtgagtatgttgacccattggaggtgtggtaatgaagagagcatccattcgggttcaggaaccgacgccggagctgatcgaaaaaatccgcagggcaagagttgccatttcccagcagaagccccgatacctgaaatgtccctattgtcagcataatgccattgctgtctacgaagacacgagaggtcatgtagaatccaagtgcaagaaatgcgggcggatcacagtctttgatgtgctgaatatgagaagactgcgaccgcgtaccaagtaagaaccggaggacaagcctctgttctaaaataaaatatatgtcatagctgagctgtggagccgcctgataggtgaagtcatcctaatgccgcatgagacagagtttaattgctctgttttatcggcatgggattcaaacctcaccgtcatgcggctctttttctgtcttcacccttcccgctgctcccgcgcagcggaaaggatgaacaatgaaaatccctaagacccctatcgcgttcgattacgacctatggactacggaggacgacaagtgcatggtgcgcgtgaaacgaaccggcgaagtttccgaggttgaccgcaaggttatgagaatccttcgcgcagaggaaaagcggatcagacgctcgtatggctctgacaacacctctgaggatgaggacggcgcagagaaaatttctgataccgtgctgtcccttgacgctatgccggaggacgatgtgaagtccgctgcatggctggcagactcccgcgactgcatggaggaactgatcaccgccctcaaagagaaggagcttctttccattctgaccgagaagcagcgcgaattgtatcttgcgatgacccgtgaaggactgactcttcgagagtttgcccggaggaaaggcattggcatcagagctgcatttgacctcaaagcagcggtgcagaaaaaatttcaaaaaattttttgagcggtactcaacaaacggcaaaaagatgtccgttgtaaagtgaaagggtcaatcagaccacttcactgctccttgaaaactgaatagttcagtgctgcggatctttccgcttctgcgaagcaacacagcttccgacgccaagacctcccgaaagggagtgagcgacctccggagagctataacagtcgtgtggtgcggctgcttgcgacgatgcagatgccgggtataatgatacttccgtcttttctttgaatgggcggctcggagcgatcctcggaggggtgagagtcccatgataccgattgaccattggtagtccgcagcattcccggaactgcaaagttcttctggcaggggcgcgagctgcaaatatgccggacaatgaaacaaacccaaaagaaacttactatatagtttcaggatgaaaactatgtggcagggtatcttcacaagatgctctgccatatccttttgtcctgaatatttcacgaaacaggaggtgcttagaatatgatgggcattgaaacaatgaaaagcgtcagtccgaaaacggttgaccgaagcacactcgttcagagaagcagcatccggcttgatcctgcggcaccgcgagaggacaggctgagggagttcatcaagcagatcagaaatccctattgttatctggacgggaaaactgtggtgaagatcagcttcgccgcgacggacacgacaatggaagattgtctggaacactatctgagaggtctctgatttatgaacagtctgaatcttttcacccggttctatggacaagcgattgagcctgtggtataatgaaatcggtcaaaaaagaagaatacggattaagctgcttgccctgatggtcatgtggcgttttcgtgttcctcttcataagagttgaagcaagccttcgtctttctgatttgatgtaccacaccaaacagaaaaacggaggttatttttatgccagacaaggtttaccgcacggcgatctactgccgtctgtcccgtgaagatggagacaaagtagaaagcaactccatcgccagccagagagccatctgcgaggactatatcgcaaggtatgaggatttggagcttgtctgtgagccgtttgtggatgacggttacagcggcgtttccttcaatcgtcctcagttcaaaaagctggaagaggcaatccgcaagggtgcgcttgactgcatcgtggtcaaggatctcagccgcttctcaagaaactacatcgacggcgggcgctacattgaaaagattttcccgcagcttggcattcgcttcatcgcaatcaatgatgcgtatgacagtctgaccggtgatccgcagtccgactcctttgttatcccgttcaaaaacctgattaacgattcttactgcaaggacatctccatgaaaatccgaagcagtttggaagtcaaacagaaaagtggtgagttcgtcggctcgttcgcgccttacggctacatgaaatcgccggagaacaaaaaccagctcatcgtggatgaagcggtcagcgaatatgtgcagatgatcttctccatgtacaaggacgggttctccattgggcgcattgcaaagcgtctgaaccagatgggcgtcctgtccccgatggaatacaagcattccgccggtgtgaagttcgataccgtcttcaaaaccggcgataccgcaaaatggacgtacaaagccgtccagcgtattctcaccaacgaggtttatatcggcgttctggctcaaggcaagcgcggcactcccaactacaaagtccgcgtcgtgaagagcaaggatgaatccgagtgggtcaaggttgagaacgcgcatgaagctcttgtgtcctacgaggacttcatggcagtcaaggtcatgatgcagcgggatatgcgctgctcacccgatcaaaacgaagcacacctgttttccggcttcttgttctgcggagactgtcagcagccaatgatccgcaagaccgtcccgtcgaagacgaaaaagtatatctactacgtctgctccaccaataagcacagccggacgtgcagcccgcatagcatcgccgcaaaagaggttgaagagaaggtcttccgtgccattcatgaccagattgagcttgtcatcaatctggaacacgcgcttgcgatgatagaacggcttccatctcagagccgtaaggctttcaattacgaagctcagatcgccaaaatcgaggaagagattgaacggtaccaaaagctcaagctggggctttacgagaacttcatcggcggcgtcattgataaatcggaatacttcgagttccgcaacagctacaccaaaaccattgagaacaagcaggacgcgcttctgcgggtcaaaaaagaaatgaagcagacggtgacaaccggcacgactgaacggaactgggtaacgctttttaagcagtatgaaaacgtcgaagagctgaaccgccgtgtgctgatgtcgttggttgaccgcatcctgattcacgaaaaccatgcaatcgaaattgtcttcaagtacaaggacgaataccagcagacacttgaatacgttctcggttatgccgacgagctggacattgccgtataaaggagggatgagcaagtggcaagaaaaagcagaaagcaaattgcagtcgaagatccggttatcgaatctgcctcctccgaggtcttcgcaacagccatctatgcccgtctttccgttgaaaacagcggcaagtccgaaaaggtggatgtcatcgcaaatcagattgagatttgcaagtcctacattgcagagcgtccctacctgaatctgatagatacctatgtggacaatggacgaacgggtacggtttttgatagaccggagttcaaccgtctgatgaacgacatccgcaccggcaggatcaagtgccttgtggttcgtgatctcagccggttcgggcgagactacatcgaggcaggaacctatctggaacgggtctttccgcagatcgggcttcggtttatcgccatcaaggaaaactacgacaactttgatacggacagctccggcgaaagcctcatcatccctctgcaaaacatgatcaacaccctctactcgaaggacatctcccgcaaggtttctactgcgctcaaggcgcagatggaaagtggagagttcaagaagcgcaatctcccgtatggttatcgctgggatgaagaacacagcaatatggtcttcgatgaggaaaccgcaccgattgtccggaagattttccaatggaagattgaagggctgtcccttcctgcgattgcagaccggcttgatgcaatgaacgcgcccaatccggagtttcagaagtatcaggtcggcgtccgcacaggcaatgctacggcaaagaagatttggaacaagtcttcactgactaccattctggataatccccattacgtcggagataccgttctcggacggacgctgaacgccatctataagggcgtcaagaatcagcatatcgaccgcgaggaatggattgtttttcccaatactcacgaggcgattatttcccgcgaggacttccaaaaggtacaagagctgcgcgacgctgctgcaaggacaaggattgagaagatggagcgcacggagaaaatccgtgctacactgatcaatctctttgaagacaaaatcatctgtgcagattgcggcaggaaactctatttccatcgaaagcgcgttgacaagcgtaaggacggcgcatggtacgccttctatgagtgcagctcatccgtcaagcgcggcaatctctgtacgccacactatacgcggcaggacaaactcgaagccgatgtgcttgcggcgatccagcttcaagtcaaggcggctctcaattacgacaagctgcttgccaaactgagaaacagcgaaggtgaacgcagcatccgaaatcagcagaatgcgctcattacaagcctgaatctgaaactcagcggtatttccaagaagcgtacccgtctctatgaggacttcacggaaggcgttctcgatgaagaggaatacgcctttgccaagaaagcctacgatgagcagtatgtcgatctttcacggcggttggatgaagcggttcagcagaaggtaaagtttgccgaggcaatgtccgaggacaacaagtggctcacgctgatgaaatccgtcagcggtgcagaaaagctctctcaggagttggttgacgagtccgtagagcttgtgaaagtccatgaggacggctcaatcgagctggtcatgaaatacggcgatatttacgctctgaccattcagagtatcaaggaagtgcaggaggcgatgtaaatgagcaaggaatacaacatcggcatctacatccgcctctcaatggctgatgaagataccggttatggcagcaaggcggaaagtgacagcatcggcaaccagcgtatgctcatcaatcgctttctcgacaatcatccggagttgtctcactgtcagcggtctgagtttgcggatgacggttataccggcacgaactttcaccgtcctcagttcacgcagatgatggagaaggtcaagcgcggcgaaatcaatctgatctgcgtcaaagacttttcccgcttttctcgtgactacattgaaacgggaaactatctggaatgcacttttccattcatgggcgtccgctttatttccatcaacgacggctatgacagtgacgattacaaaggcacaacgggcggcctggaagtggttatgcgcagcatcatctacgccgcatacagcaaagacctttccgtaaagaccacatcggcaaaaatccagatgatgaagcagggcaagtatgtcggtggctacgccccatacggctacgtcctgcatcccaccattcggaacaaacttgccgtagacccggaggcggctgatgtgatccgtcgtattttccgcgaggcgctggaaggcagcaacacctctcagatcgcccgcagcctgaatgatgacggcatcccgacgccggggcaatacttcaagagcaagcatcccgacaagaagaagttcagtaacatgagcgagaaaatcagttgggaaaccgtgatggtctataacatcctcaaaaaccttgtttacaccggaacactggtcagccgcaaaatgaagtcctgcggtgtcggctcaaaaaagcgtgttgtcaatgagccgattatcgtagaaggaacgcatgaagctattatcagcaaggaagactttgagcttgctcagaaggtcattcgaggcggaggacggaatcccacgcgcaagcagcatgactatccgctcaagggactcgtccgctgcggtaactgtaaacgtgctatgacacgccgaaagaacaaggctggcattcggtacttccagtgcattcactcggtcaacaacggaaacacagactgtccggttggcaggagctttccggaaatggatattgagaaggttgtcttccatgcccttactcagtttcttgctttggcacagaaggaagcaatacagaaccgcgaagtcggtgatctgcggaaatctgccatcaaggaatgtgctgataaaatccgcactctgcaaaagcagaacgagcagaacaaggcgtccaagctgaggctctacgagaagtatgcagccggaagcatcacgaaggaggcgtacattcagcagaaggcggcagcggatgtgaagattgctgaaaacgatggagcaatccagcgcggtcacgagcggatgaaggagcttgactccgagaccgcctgttcagatgaaaagctggatgcggtctgcgaacagtacgccgactgcaaagctctgacctatgagctgacccacgcattcatttctgcggtctacatttacgatcttgacaacatagaaatcgtctggaagttcaaggacttcctcactacatcagaaggagaagccaaatgaaagtatttctttatatccgcgttgcctgtgcggatcagcttgcggcagcagaccagtgggaagagctggaacgctatgcgaaggacaaaggctatgaggtggctgctgctgtggcggcagacggcatctccgccgtccatacggaaggtatcatgaacttcctgctgaacgaagccaagcgtcaggacatcggtacgatcctcacccgcgacacctcgcgaatcagccgggacacttcctctttcatgaggtttgagcgaaagttccgggagaacggcatccggttcgagtatctgtccaagcctgacaacgagcttccggtcactccgatgttggaggcatttgcggcggcgtataagaagcgtcgcacaaagaacggcacaagagcgtagagaaaactcaagccgttcatgggtggttgtccacctatgaacggcttgtaaattctcaaaatttttttagtccctacttgacacaagaagatttttcaagatttgggcgcaacagtctagagacaggttactttatagaacgggtattcccgatctttcatacccgttttatttctgtgagtgatgattttgatacgaaaaagctcaaaggcgataccggtggtatggaggttgccttcaaataccttatcagtgaatattacagccgggatatgtctgttaagaccaaaaccgcaaagtatatgaagatgcgccgcggtgaatatcaaagtaagatctgcccgtatggatattgtaaaggtgacaataaccgaatggtccctgatccagagacctcctgcgttattcagatgatttttgaatatgctgcgtccggtatgaacagtgcgcagattgccagagagcttcatagtcaggcaattcctacaccgggcgaatacaaggctctcaaaggccaaaagtatcacgatgtatcaaggacaaatggtgtatggtctaattcaaccattttgagactgttagcagacgaacgttatatcggcacttatgtgataggaaaaaagactgtaacagaaatcggcggaaaccgtatgcggacaaaagatgaaagcgaatggatcaagattccaaatcatcacaccccattggttagcaaagaacttttcgagaaagctaatgcttccattaagcggtttaaaattccaaaacgaaaacagcatagttatccccttcgaggaaaggtattttgcggctcctgcaaacatgctatgcaccgttccaatgagactatttatcgctgcaggttttcctatatggattcttcacagccttgctatggtatgacgatccgggaaagcgaattggaatccatagtatatgaatttctttgtaaacagtttgaagtatctttggggattgatgggccgaatgaattaaaacctgttgataaggttgcagtgagacgagctgaatttgataatcagatctttgagctgcaggaagaaaagcgtaaactgtatgaggcgcttgtaataaagcaaattgatgttaacctctataaagaacagaaagcacttattgaacagcgattgcttgaagtagagaatacaaaggctgttgtaatgacacgactggaggctgaacaacaggaaaaagaacgtcagcaccagcaaaaagatgtattacagtctttggttgaaaacaaaggactgacttctgaacttgttgatatgctgattgaaaaaatctttatttaccctaacaagagggttgagatcgtgctaaaaataaaaaatgacctggcataacagctcagggtatattgataaagccagttaggaattgcggttcttaactggcttttagaagttgaaaaaaatctccatatttttttgtcgtggacttgacataagggtgccggaaatcatgaatccttatggtttttagtcctgctgatttggcaagctgttcgttcatttttgctaagctggtatctctgagcggacgtgtgctcccgcaaatcctgaaattgtcgttgaatcctttgtactcagaccagcgttttttatgctcttctaagattttaattaatggtataggaagttgaagtgtgcgaatcgagcttttattcttaggagcagtttctctgttttcgacccttagtttttgcgatatgctgcgtgttacgttcagatattttccgtcaatatcagtcaattttaaagcgtgaattttgccttttttaagtccggtataaaatgcgatagaagaacacataaaaattccagccattcaaatttgaacaagtttcagcgtgttcaagtgcagatttggtgtatagtttatattcatccgccgtgtaaaagtccatttccttttttgttttccgtttttcgactccttcattttgtatattggcatttttcacctttcttacattcgtgatacttttttatccatgcgcttatgtggatggtgaggcctgtttgttgcaaaaattgcaacaacccattgttttaacttgtcctgcagagtaattcaacgcatccaggcggacacaccattacatcatatcaatatggcggcgataacgtcttggtatatcaataccaaccatataaccgatttcgtttaacgctaatggtatgatagaaaatccgtctttgtaaaatctttggatacgttttaatttgttggacatattttcataattacttggacatacaaaggtccaatcagcaccatctttatttactacaagtctaaaatatttgtctaagtctatatcttcaaatcctgctaaacgtaataatataagatgtttggataggctacaaaaaactggataaaaaaataaggtcatgtaaaatagaaaatataaaaggagaaactatgatgaccaaaagaagaaagccccgatcctatacggatgaattcaaacaacagttagttcagctataccatgatggaaaacgaaaatgtgatatctgccgtaaatatgatatagccacttcattgctggataaatggctgaagcagtcagcagctagcggcttttttcacgaaaaagataaccggtctgcagaagagcaggaaataatagaactgcgcaaacttaaccggcaattgaagatatgatgtttaaacaaaatgatgttattgacaatcttaaagatgatttaattgaaaaaatggatgcaagtcaaaaatgaattattggtattacaattgcaagtattttgggtatcgctgctatggtaataggtgttttgattgcgtagtaattctattgttaataatattagaaaattaaataatataaaagatgggttttaatggtattgacagaaagatggcagacacaaaaagtgcctaccatcttttttattcacttatcatctaaatacttttttattgatctccgaataaattcagctttagaaataatattatcacctttaaattttagttcaaactgttcaattaaatttttatctaaatcaacagatattcacttatgattttttgtattatatcgttgttttaattgccacgatatgttgttttgttattgtatataactaaaatttacttgtaattaatttcctaaaaaaataaaaaatatgcaaaatcttgttgacaagtgaaatgcgttatggtaaattttacctatacggtatttagtgtatgtttgtgctgtgtggtagtgtatatatcacgatagcaaataaaatatataaaaataaataaaaaataaggaggaaaagttatgttaaaaaaagtgacagcgtcaattcttgcagcagttatgctatgctgtggttttgtatttgttggttcggcggaagagaattatgcagatcagattgcagaatatttctcagatgacccaatggtgattaggagtagatattctgatacagcggtgggagaaaatgtgagcatggtggagtgtggaaacaaggtatattgttttggctgggattctactcaaatatatgatactgcagcaaatagctggacaagcgcgccggttatgccttcattgagatcagaatattcagcagttgaaaatggaggaaagatatatttagtcggcggtattattggaaacgaagtaactgataaagtagatatatttgacactgagaccggtacttggtctgtgggacaagagattccgtttggatttgttgatggtgaagcggtgtctataggtgataatatatattgttttggtggctatgatgatgttaatcatagtgtaaaatcaagagatacatatatatatgatacagtaaatcaaacgtggacacgtggtgaatactttcctaatagtggatcgtatacgggagttgctgtaggaaacaaaatatactgcactgcaaaatacagtggagatggcaattatacatacgtatatgatacaagtaataatgtatggtcagagcgacagatacgcccaagctatagttacggttctgtttcgaatcaagaaggtaaactgatgaaactgggcgaatttttaatctttattaattatggctcagacagtggcagcaaggtgagatacgcatatatgccggataaagatatatgggtggtgctgccggatacattgccggaaatggatttgccggcaggaagaacagcgataataggagaaaggatatatacaataaaagatagtatgcatgatggggtaatgcagggaagactggaaataacatacatatacagtaatcaaaaaatatatacaaacagaaataacgtagcagtgggacaaagacatatacttgtgtataaagacggggtattgatgtctaagggcaacaatgattatggtcagttaggaaacggaagcactgcggagtctgatgattttgtggcagtcaatacgccgtggacagaaaagggcgaggcggtaatgagcgtagccgcatcgggaaatatgagttacgtaataacggacaaatataatctttatggctggggacagaatgcaaacagccagctaggaaacggaagtatggaaaatgttctgacgcctgaattgctggcagaaaacgtggttgatgttgacgcaggtgaagcgcatacaattatcttaaagagagacgcaacggtttgggtgagcggaaataatacttatggccagctcggcaacaattcaacaagtacgaagagacgttttgcaaaagtgtatgaaggagcgtcagccatagccgcaggagattatcagagttatataatagacagtgagagaaaattgtattcgtgcggaaagaacacatcgggacaactgggaatcaattcaacagaaagtatgaaaaaaacatacacatatgttatggacggtgtgacaaaggtaacggcaggtgcaaatcatgctgttgcagtaaaagaaaatggaactgtgtatagctggggaagtaacagttatggacagttgggacttgaattgacagttgaaaatgccatagcgcctgtacagtcaaataatttagtcggcacagaaagtataaaggcaggaggtaatctgacaagcttccttaacggcggatatttgtatcagtgcggttatatgggatggagtaaaaattatcttcctaaaaaagttatgtcagtcaccggtgtaaaagagtttgatgctgatgaattatgtattggtatggacagtgacaataatttatggcagtggggaatttccacatatgaccaaaaatatatggaaacaaatactgcactggagcctgttagaatcggaggactaaaaaatattgaaaaagtagatgcgaatcaggatcaggtattggcggttaatagtgacagaaatttgtttgtgtggggaagaggctggtttggaacaggcaagagcggagaggaagtatacggatatccgaaaaagagtgataaatatagcagtgctgacgagatagcaagaggtaaaaatcataatgttatcatttcagcggaagttgttgaaggatgggggagtaattctaacaaccaacttggaaagttcttgccgaagaacgtaatagaaaacagcagagttatagaattaagcggttatacagaagagggagataattataacgcgtcagattatcttgagaacgaaccgctcaaaatagcggcaggaaatgactttactttagtagttagaagacattgtattggatttgaaggatataatgctatatttgaaaagcagcttgtaggaataggcagaaattacttgggtcagcttggaacaggagaaagcagtgttagtgaaagtgaaccggttgtaattttgcagaaagatatagagactgtttcagcaggagatagttttgcggtagcaacaactgaggatggggaatatgaaagagatacttatgtatggggagcaaatgaatatggacagttgggacttggccatacagacacagtatatacgccgaccagattagaaaatccgcaggatgaggaagactggggagtatttaagcaagtatcggcaggcccggatttttgtgttggagtaacagaggccggaaatgtgtatacctggggaagaaacagtgcaggacagctggggcttggacataaacaaaatatgtcaaaaccgacaagaatccgcggacttacaaatgtaagagaagtagcagcaggatataaccacgcactggcaataaaaaatgacggaacgttatggacatggggataccaaaatgacggacagcttggcagagcgctgggtaataaccgtgttccgggacaagttttgggaatcccggcaataaaaaaagcggcagcaggacgaggatatactgtagcggtagatgtggatggaaacgtatacacatttggcacaaatgaacgttcatctttgggactataccgaaacgtgcctgagaatatctatggaggaatcggagaggagccaaaagttaaatcgcttatgaccgccaaaagcgtagaaaatacagaggagggagaaaacaaatgagtagactaaaaagaataatatcggaattaataataatatcaatgctgtttacatcaataccaatggtgtttgctgatgttgaaaaaaacaatgaatcatcagtatcagaagaacaagtaataaatgaagaaacagagaataatttaatagaagaaaatgctgatgaaaaagacgaagatactaaagaagaaccgttagataataacgcggaaacagaagacaaaaatgatgaatcaacagcatcggaacaggaaactgttgaaacgccgtctgtggaacaggaagaaggtgcattgcctgaatcagaagaatcagaggagcctgaaacaacagttatacctgaagcaacagaaactcctatgcctgaaataaatctagaagaaacaataaataacggggtaaaatattctgaactgagcgatgatgagaaagcggaagcacagaaacaatacggaatacgtgacgatgtgttcacagattgtgaaaatgaaggctttgacatacaaaacacttttgaattcggtgtgcttattcagaatgccggtataactgcaagtgaatataagataatgctcaataacttcgaaagtaaagaacaagtgtttgatgagcttaaatcatttgcaaatttcaaatattctgttccagctttaaaaatccaggaaaatgctgaatatagaagtcttttcataagcggattaacatctgaaaaagttttgcagacggcagcattatccgctatgcttggaacagccggcacagcttcatatgctgatatgagttatgaggagatagaaactaaactcacagaagaacagtttttggaatatagttcaatcatgtcttgcttaagtgaagtgatgcctatggaagatgaagatgaaacaatatatgatacatctaaataccctgacgcaccgtttacgtttgacagaaacaacaatgaaacctttaatgaatcctcaggagcattgggatataacttaagcggactgtcattgccgggtaaaaatgggcttgatttgaacttaagcgcaagctataatactgcaaactcatctcccacagatataggcagccttccagcgacaactgtagggtggtataaatatgaaactccattagtaaactttgcggcaggatggagttttaacggtattagctctataaacctaataaacagaaagtatggttcgtcatatagaacagattcgatattgactgcttcagacggcagtacgcatacgatctcatacaaaagtctcagagattcttctgtaattgagttaacattggatggaagatatagctatgcagatttaaagttcgaaaaaaatacagaatatattgattctgacgggggagttgtctctgcctttaaattgtattacaaagatggaagaatagaatacttcgatgcagacggcaaagttatgaaaacccaaaatcgttttggtgacgctatatattatagatattatacaaacggtgatgaaataaatgatgattttacaaagctgggacaggaatataataaatgtgtgattacagatacatgcggcagacaggtaattgtagagagaaaaacaaaagaaaattatattcaagaaataacagtaaaagtgttaggaagcgatggttccgaaatagagggaaccactcaaaaatataatattaggtcaactatgaatacagccaatatggacacatatgcccaaatactggatagttacacaaatcaggagggattacaaacaacatttaaatatcaggaaggaaataacgaagatgaaatatatagcgtaacaaattttataaatagaaatttttatattttgaccgatgttatacatccaacaggtgcgtcaacacattatgaatattcaaaaactatgtatagttataatagcttaagacaggaatcagcaagacttatcaaacgttatgatattgttaacgggatagaagaaaatgttattgcatatgattattcagggtcttttatgtataacaacgcttattcaacaaccgaaacaacatctgacggtgtaataacaaagcataattatgcaccatgttatgaatcgacatcttcatattatcctaatgacaagtattacagttataaaagcagtaatgctagtggaaagtttacgttaaaagaatcagacgaagtatattatatgaacggagagaattcggtatatctgtccaaaacaatttatggcggagaaacagtaagatactacaaaagaacatacccggaaacagtaacaaacataatatatgataatgaacaaaatagtattgaaagtacaacgatttcggagtataatgaatacagagacctggtgaagagctgggacgcatatgcaaacggagataaaaccaatacagagcatatgacctcgtatacatacgatgatgtgtatcatactcagctgacaaaggaatacaaaagagacggaagcacaacggttaaagaggaaacagtgctgtcggcggattcaaaagttccggctcagagtctcacctatgagaacggaaatttggttgcaaaagagacatattcctatgatgacaataactcagccaacccaagtacggtcagaagttataagaccggaacggagtatacggagcagaatataacgtatctgaataagtcgctgccgctgacaaaaacggttgcaggtgtaaccaccagttatacgtatgatgagctgggaagagcagtaagcacaacggacggaaaaggaaatgtgacatatgcggaatatgacaatttgggcagacagatatccacaaggaatcctgacggaacaacagtaacggttgaatatccgaaagcgacagtgcagcgacacgttgtcgcatataaactctgcgtgggattttcctgcaaagaggtaaaagtgacggaaaggctatagcctttctaactgatattccgagaagtggaatggcggggtaacgccctgaaacgcttcccttgatactgcgttggaagaaacgggacgtatttcccgcgactgacacagcacgctgaagtcggctgtctgcacccgcgactgtcccctttgggggataaagcaaagccgagccagaggtggccgggggtgttaggccggaggtctataaagtacctatgtccagaatgcggctgactaccgctgacaaaagcccgaatgtacaggtctataacgggatatggcagaaatgccatagccgtgaaaacggcgtatgtggggtaaagtaagatttgtcgatatgaaattccctatggtgttacaggcaccatcaggcatacaggcctaaagggcagggttaagggtattatgcaaagataggaatatcggaacgtggaaagccccggatgtggagtggatacgcatgatgaagcaatgggcgggaaaatcgtgccgccttttatgggaggtgcggtataaccgttcttaatccgggaggaaagagcagccatgctacctgtgaagccgtgaacaaagtaagcggtggagggacgggctgtagtcaggaacagaaacaaaatcatattcaataaacacgcataggttcgagtaggactaagaaaggcgaaaatccaaacgaaagtggggataagtaaccgactatggcaacaggaaaggcaaagaagaaagataagttaaggcacgccgagtattatgacttccaggcaattcaagataagctgtatgccgacagcaataaaggcaaagttttcaaacatctggttgaaatcattgcattacccgaaaacatacggctggcataccgcaacatcaagaagaaccacgggagtacgacgcccggcacagatggaaaaacaatcacagaattatcagcactctctgatgaacagcttatatgcgccatacagcgcaaattaaactggtatgtcccacaaagcgtccggcgggtagaaattccgaaaggaaatgacccaatgaagaagcgcccgctcggaataccgacgattatggacaggctgatacaacagtgcgtattgcaggtcatggagccgatatgtgaggcgaaattccacgaccacagttatggattccgccctaaccgaaaccaacagcacgcaatcgcccaggttcacaaaaatatgcagagaagcaatctccactatgtcgtagacatagatgttaaggggttctttgacaacgtgaaccacggaaaactgctgaaacagctctggacaatgggaatccaagacaagaagctgcttagtattatatcagctatgctaaaagcggaggtggccgggataggattcccggaggtgggtacgccgcagggaggtattatctctcccctgctatccaatgtagttctaaacgaattggattggtggcttgccagccaatgggaagaaataccaacggagttcccttacaaggaatcggtcaattacaacggaagcgtgagcaagagccataaatttgccgcactgcggaggacaaggctgaaagaagtcacctgcgtccgatacgctgatgattttaagatattcacgaacagctatcaaaatgcggtgaagttattccacgcaaccaaaagctggctccatgaaaggctttctcttgaaatcagtcctgaaaaatcgaaggtgattaacctgaaagagcagtattcagagtttcttggtttcaagttaaaggttatcccccgtgggaaacggagcaacggacgcgccaaatatgtagtagagagccatatcagagagaaatctattgcgaaaataaaaccaaacttaaaacggctgatttacgacattgagttcccgtcacaaggcaaacgtactgaatatcaggcgatttgccgctacaacgtttatgtaatgggaatccatgactactatcaattagccacaaaggtctgcgatgaccttacgccattcgccttatctgtccacaagagcctgcgggcaagactgaaagaacgggttaaaactgcaaaacaggtcagaaaaaggaagattccgtgtgaagttccgaaagttatcagggaacggtatgggaaaagcaaacagctccgatatgtagccggacacgcagttgtcccgattggctacatacggcacaagcccccaaagtccatgaaccgcaaaatcaattcctatatgcccgagggcagagccgaaatccataagaatctggacagaatcgacatgacggttcttcattacttaatgaggaacccggttctgtaccgtactatcgaatacaacgataacaggctttcactgtattcggcccaaatgggaaaatgcgccgtatctggcaaagtgctttctattggcgatattcattgccatcacaaagtgccacggtatttaggcggcaaggacaattatcaaaatctggtgttggtatgtgaagatgtacatcacctgattcatgctacaaaccctgatattatcagaaagtatatggaaatcctaggccttgaccaaaagcagaaagaaaaactcaataagttaagaagccttgtccacgttgagagttattgagatgaaataaattctgttcctgatggcaagccgggtgagctgaaaggttcatgcccggtttagggcgggggaaaatccggagataacatcaaaggattacctatcgctatttaaggaactcagggacttaatggaatatgacgaattggagctcgacaaaatcggcgacaggaaaacggcgttgttcgttatcatttccgatacggacgatacttttaatttcatagtcgctatgatgtacacgcagttattcaatctgctttgtgataaggcggacgacgtttacggcggcagacttcccgtacacgttagatttctgcttgatgaaatggcgaatatcggacaaataccaaaatttgaaaagctgattgccacaataagaagccgagaaatatcggcgtcaataatcttgcaggcgcaaagtcagctaaaagctatttacaaggataacgccgacacgattataggtaattgcgatactaccctatttctcggaggtaaagagaaaactactcttaaagagatttccgaaacgctcggcaaagaaacgattgatatgtacaatacttccgaaacgcgaagtaatcaaaaatcttacggacttaattatcaaaaattaggaaaggagctgatgacgcaggacgaattatcggtaatggacggcggcaagtgcattttgcaattaaggggcgtccgtccgtttttgtctgaaaagtacgatataacggcgcacccgcgctataagtatttatcagacgcagacaagaaaaacgagtttgacattgaacgatttttgaaccgcagaccggcggttgtaaaggaaaatgaacaattcgacctttacaatgtagatgtgccggacgaagaaaaaaagacagattaaaatttaggaggattttatttatgcaatttttcacagaagcggtcaatgttttaaaaactcttgtaatcgcgttaggcgcaggcctcgcggtttggggtgttgtcaatctcttggagggatacggcaacgataatcccggcgcaaagtcgcagggaattaaacagcttatggcgggcggcggcgtcgtgctgattggaactacacttgttcccttgctctcagggctgtttagctgatgaactcaataattgataaaattacacaagcgatttgcgattttctgatttcgcttattgagggtagtttatcaacaatgtttaatgacgtaaacgagaaagtcgccacgattgcggcggacgtcggacagacgccgcagggctggaacgcaagcatattttctttgatacagaatatttctcagacggttattctgccgattgcggggcttattatagcctttgtcttatgctatgagctaataactatgattacggaaaagaacaatatgcacgatatagacacgtttatgttcttcaaatatttcttaaaggctggggtagcaatttatattgttacccacacctttgacattactatggcggtatttgacgttgcgcagcatattgtaacgaacagcgcgggggtaatcggtgcgaacacgaacattgatatatcttccgcgcttgccgacatacgaactactcttgaagctatgggaatgggcgaactgttcctattagttttggaaacctcgcttgttagtttatgtatgaaaattctatccgtttgtattaccgtcgtaatattcggacgtatgatagagatttatttatattgctcggttggagctatcccgtttgcgacaatgactaatcgcgaatgggggcaaatgggaaataactatttgcgcggacttgtggcattaggctttcagggatttttcattatggtatgcgtaggcatttatgcggcgttggtaaacggttttgttgtaaccaataatctgcatactaccatatttacgattgcggcatatacggttgtactatgcttttccctgttcaagacaggtaatctgtcaaagtcaatatttaacgcacattaaaaataaaaaaatgaaagggggaatttttattccttatgttcccgtaccaaaagatttaactaccgtaaaaacaaaggtagcttttaaccttacgaagcgtcagcttatatgctttggacttgcggccgctgtcgctgttccgacatactttcttacgcgcggcgcgcttggcacaaccggcgcggttatgacgcttgtaatcgcggccttgccgttcttcttcctcgctatgtacgaaaaggacggacagccggcagaaaagattttaagaaattatatacggtcaagatttttgacgccgagagtcagaccgtataaaacaaataatatgtattcggcaattatgaaccaaattaaacttgataaggaggtcaaaataattgccgaagcagaatacaaacacaagaccaaaacaaaagaaaaagcacataatatcagcgaataagccgctttcagcacgacagaaaaaggctattgcggcagctatcagaaaagcgcaaatgcagggcaggcgcgcagcgtcagcacagcagactattccatataaggaaatgtacccggacgggatatgtaaagtcaaggataattattttacaaaaacaattcagtttttcgatataaattatcagcttgcaaggaatgaggataaaaacgagatatttgaaaactactgcgattttcttaactatttcgaccagtcaatttctgtacagttttctttcctcaatcagactgtcgatatggcggagtatgaaaaagccgtacatattcccgaacaggcagacaattttaatgacatacgcattgagtatatgggtatgctcaaaaatcagttgtcgcgcggaaacaacggtattataaagcgcaaatttatcacattcggaattgaagcggataacttaaaggcggctaagcagaagttagagcgtatcgaaacagatatactcggcaacttcaaggctcttggcgtacaggcaagaccgcttaacggattagagcgtttagagcttttacactgtactttcaatgagggcgaaaaagacaaattcggctttcattgggatttggtacataagacggggctttcctcaaaggattttattgcgcctacctcgtttgatttccgcgacagccgcacgtttggaatgggcggcagaattggaactgtatcatttttacagatactcgcgcctgaattaacagaccgtatgcttgcggatttcctcgacctcgatatgggaataggcgtaaatattcatattaagtctatcgaccagtcggaagctataaagacggtcaagcggaaaataaccgaccttgacaagatgaagattgaggaacagaaaaaggcggtcagaagcggttatgatatggatattataccgtcagaccttgcgacattcggcggtgaagcaaagaatttattagagcagttgcagagcagaaatgaaagaatgttccttgttactgttcttgtgatgaatacggcggataacaaacaaaaacttgataatatgtttttcgcggcgcagggtatcgctcaaaaatataactgtgcattaaagcgtcttgacttccagcaggaacaggcgctaatgtcaagcgtgcctatcggattaaatcaaatagagatacaacgcggattgactacctcgtcaaccgctatttttgtaccctttactacgcaggagctttttcaagccggcgatgaagcgttatattacggtttaaacgcattatcaaataatatgatacttgttgaccgaaagaagctcaaaaatccgaatggcttaattttaggcacacccggcagtggtaaatcattcagcgcgaaaagagagattgctaacgctttccttgtaacgcaggacgatataattatatgcgatccggaagcggagtacgcgccgcttgtgtcaaggcttaacggtcagattatacggatttccccgaactcgcacgattatatcaatccaatggacattaacctcaattacagcgaggacgaaaatcccgtacaattaaaatcagattttatactttcattgtgtgagcttattgtcggcggcaagaacggacttgaaccgattgaaaaaagcgtgattgacagagcggttataaatatataccgtccgtacctcgctaatcccgaaccgtctaaaatgccgattttggaagatttatataacgagcttaaagctatgccggagccggaagcgcagcgtatcgcgtcggcgcttgatttgtatgtaaacggttcattaaacgtgtttaatcaccgtacaaatgtaaatgtaaataaccgtattgtctgctatgacattaaagagctcggcaagcagcttaaaaagctgggtatgctgattgttcaggatcaggtatggaacagagtaacaattaaccgcgcggagcataaggcgacgcggtattatgtagacgaatttcatttactgttaaaggaggaacagacggcggcatattcggttgagatttggaaacgctttcgtaaatggggcggtattccgacaggcataacgcagaatgtcaaagacctgttatcgtcaagagagattgagaatatttttgaaaattccgattttatctatatgctcaatcaggcaggcggcgacagacagattttagcgaagcagcttaatatatcccctcaccaattatcgtatgtaacgcagtcgggcgagggcgagggacttttattttacggaaatgtaatcattccgtttgtagaccgtttcccgaaagacttgaagctgtattcgtatatgacgacgaagccggaggaaatacagaaagatgaatgatttaacgcatttaagcctgtttacaggtataggcggaatagacctcgccgcagaagcagcggggtttaaaaccgtctgccaatgtgaatgggcggatttccagacttccatacttgaaaagcggtggcctcgcgtgccccgatttcgtgatattacaactctaacaaaggaggtattttttgaaaaaacaggacgaaacagcgttaccctcattagcggcggatttccctgtcagccgttttcaagcgcggggaaacaaaaagggtttgaagatacccgctacttgtggcctgaaatgtgccgcgtcattacagagctcaagccccgctgggtgcttggcgaaaatgttgctgggttcatcaatatggggctcgacaaaacgatttttgacttggaaaaagcgggctacactgttcaaacattcgtattaccagcttgcggtgtcggcgcgtggcatcagcgcacaagaacttttatcgtcggcgttgatgtttcccactccgcttgcctccgacaacaacaaaaagcagacggcggctgtaaatatgaatgtgtatctttcagacaacgggatatttcggaagaagaacaaaaacggcgcaatctggagccttccgctgtcggcggcggtgttctatatgacgccggtagcgtcggacgggataaggtcaaaatttccgccggaggtaatgaggaaaagcaaggacggggcgaaccttgcggcgcaggtgatattagaggaacagccgcagtcggagacggcggcgctcaatcccgattgggtggaatggttaatggggttcccgaagcaatggacggatttaagttgtgggaacgggaacctgtcggcgttccgcgtataacggacaggacggacggcagagccgacaggctaaaagccttaggtaatgccgtatgtcctccgcaggtgttccctatacttaaattcatttcagatattgaaacgggaagatgtaagaaatattgtgagtttggaggtgagcagatataagcagagaaaacaaggattttcttaacggcagcgggtgcaaggattttacggcgtatgaagcaatcaggaatatagagcgcgcggaacgcaaaaagctgattgccgatattgccgagcttgccgcaagacgcggctatgagattgtaagccctatccgattaaaggaattagaataaaaaatgtcaggaggtatatatgtacaaagattacgataattaccgtacttatgaaaatgacgatttatcagccggcgccacacttaaagttgagcataccataatcgttaatgaaaccgatatattgaatttgatttcacaaccgcttgaaaaaatacaggctatgcgtgataataacgtcaaaaaagaaacagccgcctttgaaaaagtacggcagtcagcgcgggattgggaaaaaaaagcggcaattacaagacaatttgacagggctattgagtatttgcaagtaccggaggtttcgcattcttcaaataaatgggtaaacgacagagattgttataactacgattgtacatctatcagtaatatggtatataaaatgacataccgtatgtatgattacacaagctggcgttcagaaaaaacaagacgctgggaagtgaaatggtctattggcacaaatagtccagttggtcataataactgtattgcagaacaagaacgctcatttaaggataaggcggaagcggaaaaatatatacaaggcagaataaaagcctattcacatttattcacggaaatttccccgcccattccgaaagaatatgaaaaatcctttatggtacacgaacatcttctacccggatatgttacagagaaaatgcaaaaagctcaggaagcggcaaagacggaaaatatcagccgaagcgcagataaaaagccgtcaatccgcaaggagttaaattccattaaggcggcagagaaaagcgtgccgaagccgacgcagacaaaaaagcgcgataatctcgaactttaacagcggaggtaatgaatgaaagacaatgaatttaaggcgcggaataaggacacggatttttcaaaaaaggttgaagccgataccgttctcggacggcagagcgcaaaaggcagcgcgaagccctttacttcttcagaacataataggtatcagcagaaatttttagataccgaaaagccgcttgatacttctaccgtacaaaatccgtcagacagtcaggaaatattaaagcctaccgaaaataatacagaacagcaagaggacttagagaatattaaccttgatagtcagccggatataccatattccccgccgacaaacgagccgcccaaaagtggcggtttttctaatgccgtaactacggcggcaagaaataaacggtatcagcgcaaatttaatcaaaagaaatttgatgttgatattactgaacattccgcagatagtacggcggaagaaacgcagccggatagtgccgaagccttaaaagataacggaaattatgactttaccgagcaaacacataatcctgatgaagcgtttgaccgtgtaaacggcaattcggattttcagctcggcgcggattccgaaaaggattccgcagacggcaatccgaagcagccggataaaaaccgagcctatcagaaaaagcgcgtcaagaccgaaaaaacagcagagtacaacatcaaagaagcggttgacgcaggcgatacggtttttgacagagtaacggaaaaagaggattttgtttttgaaacgcgggaaagcaagacggaattttcattccgtccgtcagaggataaaaccgaaaaacagacagccggaagcaaaaaccgcttatatcaggaaaagcaatccaaaacagagtcggcggaaaacgccgatactgttttagatattcccgaaaagggcgattttcagtttaagcgagcggaaaaggcgcaggcgaaagccgataagctcaaaggcaaggcggaaaaagcacaaaacaaattacctcataagcgcaaggttaaaaagcagcgtgtttatgatgaaaagaaaaagaaagctaaaacccgtctgaaatttgaaaaagagattaagcctcaatccgatatataccaccgttcccctgtaaaaaatgcggcggatatggcaggtatgaccgtattaaacaaggcacattcaaaagtgagcgaaacagaacacgaaaatacaggaattgaagccgcgcataagacagaacagaaagccgaaagcattttacggtttggaaaccgtacagggcgtatgattatacaaaaccgcaaaaacgcgccgtataaaaaagcggcgcgtctgcaattcagagcagagaaagcggaagcaaaggcctttgttcaaaaaacacttgcggataatcccgatttcaagaaaaaatcagctttgaggaaattttttcagaaaaagcagattaagaaaaaataccagcaggcgaagcgcgccgaacagaacgctaaaaaggcaaaacgagccgcaaagaccacaaaggacgttacggtgtacgttgttgaatttataaagcgtcataaaaaggtattcggcgtcattcttgctattgctttaataattgcttggatagcaactacaatttcatcttgcgcggttatgggtacaacgggctttaactcaattatggtatcgtcatactttgcggaggacgaagatatatacgcggcggaaaactattacaaagaccttgaaagcggtttacaaagtgagataaacaatattgaacgcgattacggaggttatgacgaatacaattacgatttggcgcagataggccataatccgtatgagctcatttcctacctcacggcgttgtatatggatttcacttttgatgatgtaaaacagccgcttgatgatttgtttgaacagcagtatatattaacgcttacatctcagacggaaacaaggacggacgacgagggcaacgacaaggaatataaaatactcaatgttacgcttgtaaacaagaatattactatgcttacaaatacgaaccttacggacgaccagcgggaattatacggtatatatcttgaaagcaagggcaaccgcgattatttatttgcggacgatatttattctaatccggcagcgccgccgagttataccatacccggcgaagcattaaacgacgctacattccgacgtcttataacggaagccgaaaaatacttaggttatccgtatgtatggggcggttcttcaccgtcaacgagttttgattgcagcggttttgtatgctgggtatatcaggcgtcaggcgtatatcctctatcccgtacaacagcgcagggtatttttaatcaatgcgcggttgtgtcaagagcggacgcaaaacccggcgacattatattttttacaggcacatataacgcgggcgagcctgtaacccacgtcggaatatttgtcggtaacggtatgatgatacattgcggcaaccctattcagtacgcgagtattgatagttcctattggagttcgcatttttacgcctttggcagacttgggggcggttgatatgcgttatctttacagttggagcggtggcaaggacagtacggcggcaataatacttagtcatattcataacttgccgccgtcaaccgtcattttcagcgaggtaatgtttgataagaaacgcggtatttcaggcgaattacccgaacatatagactttatcaaaaacagagctattcccgtttttgaagaatggggttatacggttgaaatattacacgcgacaaaagattatttagattgttttcatcagataatcacaaaatctaaaaatccgttaagaaatggaagaaaaagcggttttccgataggtggaatgtgtacaattaacagccgtataaaaataaaagcaattcaggattatttgaaaaatgtaaatggcggatttgtacaatatgtcggaatagccgcagacgaaccggcgaggcttacaaggcttgacggtacaaataaaatatcattacttgccgaatatggctatactgaacaaatggcttatgatttatgcagcaagtatgatttgctgtccccaatatataagtatcacaaaaggggcggttgttggttctgtcctaacgcgacttacggcgagtttgcatatttgaagcaataccaccctgacctatggaatgagcttgaaatattatcaaaggacaaaaaccttgcaagtcaaaagttcaaatatgggaatacattttccgaagtcgataaaaagattgatgaatttatcgcaaaacaaaaaatttaattttatggaggtattttaattatggcaacacttgaaaaaatcgaaaaggatattataaggacaaaagcaaagataagcgagtatcagcaaaaattacgcaatcttgaagcgcagaaagtcgaagccgagaatttgcagattgtaaatctcgttaaggctgttaaacttagcactccccagcttaccgtacttttaagcgcgtatgcaaagggtgatgttcttcttcccgaagagtacgaggaggaattaaaggctattgaggaaaacgagcagcaggaggacggcacgaatgaagaataaaattattgcgatattatcagcagctttattatgctttggcggaatgtgcggaataaccgcacacgcaaactatgacagtacagcagcagcgccggcggcaacggaaacgccgaagccggcgcgtaccatatcaacagcgggcgcggggcacgttgtagacaacatttccgacagtgataaattgcagtttataagcgtaaccgcaaaggacggcagcgtattttttatcgttatcgacaagcagaatgtaaacgataatgtgtatttcttgaataaggttgatatatccgaccttgaagcgcttgcaaaggaaaacagcgcggcagtacccgcagcagtaaaagcaagccctacaccgcaggcgcaggcgtcgccgtcggcggagccggacggtaagacgaaaaccgcgccgaaaaccgataaatcaaagtcaggcaattcaagtataatgcttattctgattgcgattataggtataggcggtcttggcgcgtactatttcaaggtttatcttccaaaaaagaatatggaaaacgcccccgatttggaagattttgaatttaccgacggcgaggacgaggaaaccgaaaacgaggacgatacatatacagaagatgaataaaatatattgcaatattactttgtttatgatataatatttattcaagaaattttatacttactaacaagtagaaaggagattgtatatgagtaaggttgatgaatatacaggtaatggaatgattgtagttagtgatggtgaagtttgggcggtagatgatagcggactacctgatgtaataggagaaataggacgtgttgaattatccatagaaatgccagaaaacttaattggcatatatcgagttgagcatataatgttatttgatgaagatgatgaggaattatatgacgaccaaacattagtggataatacggaataccattcagaaagagcgttagtaaaagcagttgcaaaaaaatacggtatttcagaggatattataactgttttataaaggataatatacaaccacaaaaacagcactcattgttgggtgctgtttttgtatgtaaaaataaaggaggaatgattaaataaatgaaattagtaattgcggaaaagccgtcggcagcccagagctacgcaaaggctttgaacataaccgctaagaaaagcggatattttgagggaaacggatatatcattacttggtgtatcggacatcttgcaggcttggcggacgcagcggcgtatgatgaaaaatacgcggtatggaaatatgaggatttacctatcctacctgaaaaatggcagtttgccataaacaagggcaaggaaaatcagtataaggttgtcagcggtttaatgaaccgaaacgacataaccgagattataaacgggtgcgacgcaggacgcgagggcgaattgattttcagatttgtatataatatgtgtggctgcaaaaagccgtacttccgtttatggatttcctcaatggaagaaagcgcaatccgcgagggatttaataacctcaaagacggacgcgagtatgataatctttataattccgcgttatgccgcgcaaaagctgattggattatcggtataaacgcaacaagactgtttacatcactgtatagaaagcatttgaatataggacgcgttcagacgcctacccttgctatgatagcagaacgggacagcaaaatttcaatgttcaggaaagaaaaatattataccgttgaaattgacggcggcaatattaaggctgtaagcgataagatttccgacaaagacgaagcgcagaatttacaagcggcttgccacgaaaggcaggccgtttgtatttccgctgttaaagagaaaaagaaaacaggcgcgccgaaactgtttgacctcacaacattacagcgcgaagcaaaccgaatattcggatatacggcgaaacagacgcttgactatgctcaatcgctttatgaaaagaagctgattacatatccgagaaccgacagccgatatttaacggacgatatgcacaatactgttattaaaatcgttcatatagcgtcaaaattcgcgccgttctcaaactgtacggattttaagcctgatacattctgcttattcaataatgaaaaggtatcagaccaccacgctattattccgacggcagaaattgaaaatatcagcttggcggaaataccaaacggcgaaagtaatatacttcaccttattatgtgcaagctgttatgtgcggttaattccccgtatgagtatgaaacgattaccgcagttttggagtgcggcggcgtacagtttacggcaaagggtaaaatcattttatttgagggctggaaaaatatcgaacagctttttaaaagatatattcattcggacacagaccgcgccgaagatgtattttgtattacaaaaggcgaaaccgttaccgtttcatcagaagtcaaagagggttatacctcaccgccgaaagcgtttacggaggacactctattatcatcaatggaaacggcaggagccgccgaaacaacggacgaagcggaacgcaagggcttgggaacgccggcgacaagagcggcaattatagaaaagctggtacagacaggttttgcagagcgtaagggcaagtctattgttgcaactcataacggtataagtcttgtcagcgttcttcccgaaaagctcacatcacctattctaacgtccgattgggaaaataaccttgccgagattgcaaagggcaattatccgccggagcagtttatgaaaggaattgaggatttgacaagggagcttgtaaccacatattcattcatcacagacgaggacagagcgatattccgcgcgccgcgtgaggttatcggtatatgtccccgctgcggttcggacgtacacgaaagcaaaaataacttttattgcgctaataaaagctgtaaattcgttatgtggaaaaatgacaggtttttcacaagcaagcgaaaagagattacaaagaaaatggcgtctgatttgctcgcaaaaggcagaacaaaggtaaaaggcttgtattccgagaaaaaggataagacctatgacgcggacgtggttttaatcgacagcaacgataagtatgtacatttcaggctggattttgacggaaagtgaggttgatatatggcagatacagaaggcacaccagattttcacttggccgcttatgttaccaatcttggaaaatataacgagggatatttagtaggcgaatgggtgaagttccctgttactcctgatgaaatgcaagatgtatttaggcgtataggtataggcggaaaagatgtattcggttcgccgtatgaggaatggtttattacagactatgattgttatattgacgggatatatgatatgttgagcgaatatgagagccttgacgaattaaattatctcgcagacaaattagatgaaatgtcggacgcggaagtacagcattttaaggctatcgttaaaatgggcgaacattcagacagtgtacaggatttgataaatctaactgaaaatcttgattgctacgaaatatatccagatattacagacgagtatgatttgggatattaccttatcaatgaattgggctgttatgatatgaacacactgaaagcattggaaaattacattgattataaggagtatggagatgatactgcgctgaatgaaaacggtgtatttacggattacggttatgttgtgtgtaatcaaagtgattttaaagagatatacaacggcagccgtgatgatattcctgacgaataccgtataagctctatacccgatattgaagctgaacagaaagacgctgtaaaaacagaagaaaaaaagccgtcaattcgtcagcagcttgcggaaaataagtcaaaatccgaaaagacgcaatccgtaccgttaaggcaaaaaaacgatttgagcctatgaggtttggtatctgatgaaacgtattgacataacaaacggaattatgcggattgatactaatacggaaacatttgatattcagaaaatccaaaaccgccgttttatgtataatccgcagacaggcacgttgattttgggaatacaaacacaatgcaacgatttcttttataaaaaggttacggaatatcggcgtataggtataaggtcaaatttcaacgagtttgtgagtggctgggttggaagcggtaaaacgggcgtaatagattttacgccctccgttccgactgccgcaaaatctatttttaataaagcgcttgatacgcttattatgttttacagaaataacgcaaatatgaaaacagaaataagagggttcggcaatacgaagccgcagcctttggaaaatattataactgaaagagaggttgagctaatggcaaaagcacaagcaacaaaagcgcctgaaaaatcggagccgtcaagggcttctgtacaggcgatagaattatccggcgaaacgccctatgaaaaattgagcgagattttgaaaaagctggaggacggagtgaaagacatatttaacggcgataaatatgcggaatatcttgcgtgtatgtcaaaattccataattacagttttagaaattcgcttttgattttaatgcaaaagcccgacgcttctatggtggcgggatttggcgcatggcgcgataatcacaaacgcacagtaaaacgaggtgaacgcggtattaaaataatcgcgccgtcctcatacaaaacaaaaaagcagattgagaaaataaatccggcaacaaacaagccgattataggctgggacggtaaaccgcttacagaggaaaaagaagtaactatccccactttccgagttgctaccgtatttgacttgtcgcagacggagggcgaaccgctgccgagtttgggagttgacgagcttacgggcaatgttgcggatttcaaaaagttttatgccgcacttgaaaaaatatcgcctatgcctattgggtatgaggatatagatacgggagcaaagggatattgtaattttgaagaacagcgaatagccgtaaaaaacggtatgagcgaggttcagcagttaaaaacgctgatacacgaaattgcacacgctaaactacacaatattctcaaagaaaaatcaacggaattgacgcccgaagaacaaaagaacaatcgtacaatggaggttgaagctgaaagcgtcgcctataccgtttgtcagcgatatgggattgacacttccgattattctttcggatatgttgcgggttggagcaaagataaggaattaccggagttaaacgcttcccttgacacaatacaaaaaacggcgaatgaaattatattaggcattgacgagtattataaagagcttgcaaaggatattgagcagaccgaacaggaaacggattatacacaatttacgggctgggattttaacggcggatacgctgcaatcaatacagacgctaattatctgcaagtattttttaatgaaaagccggacgataatatccgcgccgaattaaaggcaaacggttttcattgggagccgaaaataaaagcgtggcagcagccattaacaggcgaagtccttaacgctgctgacaaggtggagtatatcagaccattagacggtacattaccgtctgaatttcagaaacgaaacgaggaaccggcgaagatagccgaacaggacggattttctgaattgtcggacgcagacgcggcagacggcgcaaaagtatttgagccggaggacaattccaaagacacacctaccattgacgagcttgaagcaaaggcgaagaatggcgaacctgtcgctattatggatattatcgcggcaaatgaagcggaaaaagttaagaaaggcaaaacgccttccaaaaatgagacatctaagaaaaagccgtcaatcaaaaagcagttggcggaagcaaaggcgcaggcagataaacagccgcaaaaatccgaaaaggtcaaaaatgcggctttggaggtttaagctatgcgtaagtttgaaaatgtggatattataaattcgctgcgccgaataatgaacataaataccgagcattacaaaaatgatttttttcttgatgttgatacaatacatacggcagcgttaagcgacagtgcagaagataagtatttactttttatgtcgcgtctgaacggtacatactgttattgtgaaacggacgtctttacaaaagatacatcagcatataatacttggacatactatggcgaacaggcacacgacaatattattgcctatgctattaaaataacgggttttgaaaatgaagtcatcaagggcaatctttatgaattagattatccgaagcattttaaacacgttataaatgtttcggtgtgtgccgatagtgtttccgctgatgaagaattaaaatttactctatcgtgcgagcataaacgacttgaaaagctgaaatgcggcaatattgacaatcatattgcggatttgtcaaaaaagaaaatcaaggcgcagcttgataaaatgacggaagctgaaaaggaggatattataacccacgtcgaattaagcaaagattttggcgaagcagatttactaacgcaggcagatattgatttatacaatgccataattgcagaacggacagcgaaaaagccatcaatcaaaaagcagcttgcggaaaacaagggtaaatccgaaccgatgaaatcaaaaacacaacaacaaaaggaggatattttactatgacattttcacaggacgaaataaatttgatgtgtatttatgatacatctgataagacggagcttttaaaagagctccgtttttctgttccgtacattgaagatacggaattaaaggaaattacggaaacggttattgacaagctggagcgtatgacgaatgatgaattttctaagctggagcttgaacctgatattgatatggaggattagcctatggcagatgaaaaagattttagagagccggacggtgctactcaggattacgaattagacgaagtatttgaacttgcttttgaaatagacgcatttttaagagcgcataatttgaaatacaggacaaaatttcctatggaacaaaggcagcgtgaaatacttgcggataaaatgttagaaagcgacacattttatattaaacatctcatatcttccgtattgggacacgagggcgacgcactgatgaaccgccttaatgcttatgaaacggaatttagaaaaaatcaatattctgtctatcatctgaaatcggattatgacaaaaaatgcggatatagcttaaagtctgaaagagaaaaaggaaattatataaataaggatatgtatgagattgttcgttccgaaccgcttgaacagtataaaacgcctatggaaatagacgtaggcttaatgataaataaagccgccggcgctgctgtttatcagcctgatttaagggatattatcgtcataaattatgacggtcaacaaaaggcatatttcaaaggattaaaggaatatacagaagctcccgaatttacaggggttcatataacatcggcggcattaaataattataaaggtctgacggcttttctcggaaaagacggtaatgtttatttgggaaaaagtgaacgcaatctatataattccgaaaaaaaatcattgccgttttataacaattcggataattccttaacctttatttccgataataaaaaaatgttctctttcctatgcggttctggctgggtattatctcaatctgaaatgatagaaaacggagcttttacaaaaagtgattatcaggaatttgcggaattgcaaaaaggtgtattatcaaaatttgagcccatacgggaaataacctttaatggtgaaccgttcaattatcccgattacaaccgtaatattgaacagacagccgaaaaacaaaaaaatgaaaaaggagtgttaaaaaatatgaatgactataaatttgcagcttttatcgtcaaccgttccgaatatgacaacggaaacagagaaacaagcggtacggaactgtctttcccgacagacgcggaaacggtaaagcggacatttgcagaaataggcttacctgaaaacgcaagccctgatacatacttttttgatgattacgcttgcggcaatgatgatttaaaaaagtgtttaactatgtatgaaagcgttgacgcgctaaattattttgctatgcgtatatcggaattggaagatactgaaatgaccgtttttcaaaccgcgcttaaagccggcgaatgtaaaaatataacggacgcaataaatattacatacaatatggagtattataatattgttgacaatatatctaattgggcagattacggaaagtatattgcacaccgagatatgcttgatgaaagaaatatgaattatgaagaatacggcaaacatcacgcatacgatcatggcggatatttgcttgacggtattgtcttagaaacaggctggacggagtttgacaaagtgtatgacggtaaaaacatacctgacgaatatcgcgttaccgtacctacggagccgcaaaaaatgaccgttctaattgtgccgcctatgcaggagccttatataaaggaaatttcgacaggtcttgaagccctccagaaagaggttggcggcagaattgaagttgtatatccgtttgcggagcctgtcggtcttatttgtaatgacgagggcaaaaatgagagaatggaattaaaccgtgcgctttatgacgcagaggataatatgtacgatattatcgcaggaacatttgtattagcaggattatctggcgacaacttcggcagccttgataaagaccagataaagcagttttcagagcgttttgctaaacctgaaatgtttatgagaattaacggaaaaataacggcggtcgaggtcaagccctcaattaaagcaaagttagacagattgcaaaaggaacaaaacaatactgataagccgcagccgcagaaaaagccgcgtgaggaaacgctatgagtgatattatacgaatgacgcccgaacaggcgcggcggagccgagcattgataaaaaatcaatgctgtaattatgacaacgggaattgtattttacttgatgacggcgagccttgcgtctgccctcaaagtatttcatattcacttaattgtaaatggttcagaacagcggttttgccgaatgataaggaattgtacataaagctgatgaagccgaagaacaggaaaaaatgtacggtttgcggtaatgaatatacgccgacagggcgcaattcaaaatattgtgataaatgccgccgaaagatacgattgcgtaaagacgctgaacggaaaagaaataagcggtctatgtccgcattttaagggaataaaaccgcataaaatcaagtgtttcaaagcctaaaattgataaagtaatgatagcatatcaaatacccttaaaataggattgaaaacgcggacattttatattaaatatagataggaataactgttatattagccgttattcctgtcttatttttttgatgtaaaaaggtatttacaataatagtaatttatgatatatttataaatgcgaaaacaatttttatatttatagctttttttgcatacaattttttttggcacgaagaaaaacatttttatcatatgataaaaatgcgtactctttttaatactttgtgccatatgttacaacgtatattggaaagtataaaaattgttttcgcagacaatagagtatcgcattttttgtgcgttgcctctattgaagcgacgcacttttattatgcaattttatttaatgaaaagagttgttacatatggatttaaaatctaccctatatcaaaaattatcagaacaagataaacaaaacataaaagaattaacgaataaatataaaacatctgattatacattagcagaaatttttaatgtaaaatccgaaatctacaaaaacattccgctctcacaactttgtttgtctgcaagagtcgtgtctgctattatacgatttaaaaatattattgatttagaaaaactactaaatttgactttgccgcaaatatggggaataaagaatttgggtgaaattgggattaacgaattagtattacttattcaaaaatatataaatgaccatactcctaaaacgaagaatagtgtacaaaagccaacaaacgaagaaatccaaaatttgctcaatgccatacattcacaaggacgtagcgtaagagaagttaccgagttgttagaaaagaatattatatagtcaaagagaaaaaggaagcataaccgctttggttatgcttccttttgtaaatcctttttgcataactctattgctgcgtctttttctgcttgtgtaaaagtataatccaaccaatgccaattaccgttaaaatccacataatacagttgtttatcatattcggacgatataacatatttgtcctcgtcagcgtgatatgaaatctctattccaaaacaatcctctttataatactttccgtctattttctttgcttgggctacatatttgcttggaacatcagtaaccaatattgcgaaaacctttatatcgtctaaatcatcacaattatctatttcttcaattttcattttacggcagcctccaataacaatttccttgcgactgtaaacatttccattccgacagcgggaatatctcgataacaggtatcaagtgaaaattgctcgtcataattaaatgacgtgtctgctgattgatagattttctcataagccgtttttgttgcagtgtcaatatccataccgttctgaaccgctgtaatcacatctgcaatcaatacctttaattcttcctccgcttttgcgtatgcgtcaggtcttaactgtttatccctcataacgcggattgcgttctgcgcgattggcgataagataccgtaaccgttaccgtctgtctgatttgccattacagccttgcggatttttgtattagcatatccggcagctaatgtgtaaccgagcttgcccgtctgcacttcatcaagaatatcacctacaatattttcagtgatttggatttgtgcttctgtcgcattaagcggcgcgctttctcttggaatcggggcggcaaacgctgttgtcgctgtcgctgataatgcagcgattagtgttagtgtaataattttctttttcatagtgaaaacctcctgaaattaaaatatattttctctatactaattatatcacttactatatgccgcgcccagccggaaaagcgcacaaggttttaacatcagcctgtataaaacgccgaatgactattctatctgattttctcttgtcggttcgctcctttgcggagtgtgcagcatagcgtcaacattagcttttacaatatcaatttcggacacctcttttttcgcttttctgtaatcggtatataatttctgccgctgctcctctaattccatacgctgaacatttacgctttcaagcgtcggtaattttctatcggtctgctcctgcgataaatatttatgagaagccttaaataaaataatttcccgttggtgttccttttcaaactttgccttgttattcgacttgacatatttatcatatacaggacggagcgccttatatgtgcttatatgctttcgtaaaatatttatgtcgttcaaattccgttcaactgatttgaacttgtcggcggtatcgtcaaactgtttgcacgtttcatcaatacggctttccaattccgaatagctgtttatattatgctcggtcaaataattaagcgtctttgaagcctgtttaagattattgattttagcccaatgctcgtagcccttgctttcttgcgccttaatgcaattctgaatatcaataataaggctgatacggttatcacgaataatcggcttgcgtttgcgcgatttttcaatccgttttgtaattccctcaacactgtatctttcgcccagcgtttgagctttcagacgtataaaccgttcctgccctttggcgcggacagatatatattgacctcgttttatctcatagccctgtaattccataagacgcaaaaaatcctcaaaatcttttacttgcggaattatcttgtcaatctcggttttcagtttcgccctccagcttgtcggtttattctcatacttggtatttttatttttcctttcagcgtttggttcgacaacggataatccgtattccttgcatagtctgtcatttatgcggcgtgaatggttataccacttttcattgatgtggatatgcttgtaatcaacaaaactgacgtcattacaaattatatgattatgaatatgtcccttgtcaatatgcgttgtcaaaatgtattcaaatttaccgcccagcagttcatcagcgaaacgctttccgatttcgtgagcctgttcgggtgtggtttcacccggcgaaaatgcctgtatgatatgacgcgcgagatgttctcccttattatatgcgtgttctcttgtgcaatcaaattcaatatctgcaatttcaggagtacaggcgtatgcgtgaacaagcagctttgcgtctgtcttatcgggatttaaaatatagtcaatggcttttcttagggtagtgtcaatagtatggttcgttgtaattgccatattttatttaacctttcttgaatttcctttatatcttcctcataaatggagccagtttcatttacgcgctttgcaatttgatttatattaacgccgatagaatgtaattccttgttcatttccttaatgttggttgtgtcagtataaataattaaaccgtcaatcgccattttccgtaaatacgcgcctatctgtcgtgtcggtagctgcgccattttctgctcaattaactgtttttcttcttctgttactctgaatttgatttgaatatttctttttcgcttttccatatatttacctccgttttttatctgggtttgggatttgttcccaaaatattttttgtgacttttgcaaggcatagacaaacaaaaaatcgccgttcgggtacccggcggctttgcttgctggtagcaaaaaccccttatatatgggtaacaaataaaaataagtttttctgcacatctttaatgaaaatatagcaaaacagtgtaaaaatcttgacaatttatagcttttataataaaatttatttattgtgattgtgttgtaatatacataaagatattacgaatttactgaaaaatatttttaatttacattgaaagtgagatgaaataatgacactgtgtatagctttatgtgatgatgataaaatagccttaaataatgagttaaggcttataaaagatgttttaaatgaaaagaaaataaaacactcaatcgacatttttagttcaccgcaaaagttgttacagtccgacactgtctatgatattatatttttagacattgaaatggctgaaatggacggtattagtttagctgaaaaaataagtataacaaataaaagctgtttattcttttttgtaaccaattacgaagcatattttgataatgcgtctaatgtgcgaccgttcagattttggacaaaaccaatagacaggcgccgcttggtctatgaaattgactcagctatacaggagctatacaaaaataatcaattcatcaatgtaatggtaaattcggaaaacatacaaatatttatcagtaatattatttacatatatgttcaaaacaagaaaacacatattataacgaccaaaggtgaaattattgtaagtattccgtatcagacggtttttgaacaagtaaaagattacacaaatttttttgagccttttaggggatattgtataaatttcagttatataaaaagatatggcaaagataaaatctattgcggatatagggagacagaatatgaaatatatttgtcgcggcgtaagcaagaggattttcaaaaaaactttgctaaatggattggagaaaaataatgcggattgatttaggaatggtattagcaataatatttgaatatataatttttatttattatgctgacactttattttacagaaaaagaaataagtatctttgttatgcaataattgcattagtttatattgctgatttgtttatatgtgcacgcggaaagatagttgtaaatactttaacttttgttgtaatacaccttgttatttttggcgtatgttatcgcattagctggaaaagcgcattgtttcaaagtattttactcgcggctataacttcggcgtgtgaatttttagttatatttattccatatattagaattatacctgacaataccatagcaatgacatcttcacagtcgcttatattgacatttgcaagcaaactcttatatttaattggaataatgataataagccgcgtattctgcaaaaaacagaaaaatgtacaagctacctctcttggacttttatctattcctattttgactgttattataattatgcttgtgatgaaagtcaatacaacatcacacttattgtcattggtgtgcttcatactaataataatgaatattattatttttgcaataaatcaaaaattgatgataatggaaacagagaaagcagagttggaagctcagcaattaaaagaaaaatttgattatgacgaatatatgatgttaaaagaaaataatcagcaagcctcaatacttaatcacgatttcaaagaacatataggtgctttaagctctttaatcggagctgataatgaaaccgctcaggaatatataaaatctatttgcggcaaattttctcagcctaaatttattgaatattcagataataaaatcttaaatgtgcttttatctaagaagaaagaagaatgtgaaaatcaaaatatacaatttttgatagatcccatacgagccgagctgtcgttttttaacgatatggatattgtaactatattttctaatttaataaataatgctatggaaagctgcgcccattcatcagagaaaaaaatttatttgaatatacatactgaaaatcaaaattttatagttataaagatagaaaatacatcagatatagagcctattgtaataaacggcagactaaaaactcacaaggataatgcgaagctgcacggtataggaatgaacagtatcagcagagcattatcagcttataatggttctttggattggaaatataacaaagaacaaaagatattttccacaacgataataatacaaaatttaaccgcttaggcaaatatacgaccgcttaggcaatttgggttgacttaaataacattatttgctaaaataatttcatcaaaagagaaggaggaatttactatgctattaagtagagtaaaaaagttgtgtcaaaaaggagcgtcatttgcaatcaaggcattgcctgttattgtacctgcatttcttctttttcacacaaactcaacctgctgtattgtaaacggtcagccgacgccgccgaacagcataaaaaagtacagaaagttttaagctatgatacataaaatttcagagaaagcaattatgtatgcaatcctcaataactacataaaacaggaacaatatgacgaatatgtatatgcccttgaaattatcttaaatatattgattacagatattactatgataattataggacttgctatgggtatgatatgggaatgtattttattctggctcgtatataaaatcttgcgtaaatattgcggagggtatcatttctcaacatcgctgaaatgttatttatcatcttgcattatgtgtccggttgtattggcagttgtaaggtatgttccgtacagtatgaccgtatggggcttgcttaccttaacagcgctgataatactttctattctttcacctgttgaagcggcgaacaagccgcttgacgaaaaagaacagcggatattcggaataacggcgagaattttaataatcataagtgcggtatgctggagtgtaacagccatagtctttcgtcagcttatattatctaaaatcatatcgcttagtattataagtgttgctgtgtttgttatagccggtaaaatgtatttaactgtacgaaaacacaattaagaattacccttatccaaaaaaggataagggtaattttttgtcaaattttaaccgctggggcaaatatacgaccgcttaggcaaaagctattgacatcaaaattttcctgccgtataatgcagatataagcaaaacagcttattatatatcccctcacaaccaatcacaatatagtattcaatactatgggatatatggtaaattgtttatgatttataaacagggattgagtacatacgaaacggtgcattgtctgatacggacagtttgtaaaatctgaatatgcgcgataaatgctatttctcaatgttagtttagtgagcttatcacataggggcaaacccgatattttgatgttgcagaaaagcatatatcaagccggcaaaatgatacgcgtatcggcataggacggtcttatggattttctgtatggataatgcaaagtttcaaaaacaaaaaaaacaaatataatgctgattttatgttagacataaaacaagagataccctcaatcttaaatctacgcacgcaagcctgattaaagataaatagagtacctctaaatagaagagagggtacaattcctcacgctgattcttctaattgggctattggaaggtatttctatccggcgagcggttctaatgcagttgcactatgcttagaagatatacagtctcaggttgaaagtgtaaatgtaagacttagaaatgaatcactaaattccgactcttatacgactgaaataaacattcaaaataacggtttaacggtaattttagttaacaattcatttatggaacacggaaatcaagtaaaaattagcagtaattacagatatgccttctatgttagcacatattcttcaccgggaacagcgaaagctacggtttatacaggtgtatataactaagcattataaagacggggtataatccccatctttatttcatacaatcaaaaatttcatataaccattcttttgataggagcaaataattatgaaaaaaatatatacatttatattgttgataagtatatgttgtagtcatactttatcagtgttggcagattataatgatatagaatatgttaattacaaaaaagaaatagatactttaatatcatataatattatggttggtaatgatgataataaattcaatccgactaaaacattgacaagagcagaaatggcgactataatcacaaatttattaggtaaaatagaatatgatataaacaatataaccatttttcaagatgtacaaccaacacattgggcatattctaatataacacaggtatcttcgagaaatattatgacaggtgatgggtatggtatatttcgtcctgatgacccaatatcttttggtgaaatcttaaaaatatgtgttgaaataacaggatatgacaagtcatatacagatgttatatggtataaaccttatgttgaaaaggcaaaagatttgaatatttctgaaggcattgaattagatgcaacacaatttattactcgtgaacaagctgcaaaaataatttataatactatcaatattcctattagagaacttcacggaataaaagatgaaaaaggtgttataatttgtgaatttgttatatgtgatggaatacaaaatgaattaaaaactttattaaatcagtttaataatcaatagtaacaactgtatttaatatgttatcaattaaaatactttcaggtggtgactgacatatgacagagataatgcaagctgtaccgctacaagcgacagagatactataaacattttttatgacgctgcatatgaacaataataacaagataagttaagagaaaggaatgttttactatgaaaatcaaaaatttaataacaatagctttagctgctattatgtcagtttcagctatgagtattccgacatttgccgagaataatacaacgattgacgaacagctttttatcgacacagcaaaggacgcaatatatgattatattgtagaacgcggtgaagaatattatactatatcagacgtatcatttaatgacggtgatataaaatatgaatccgataataaagtttcgtttgaaacaaccgctactattagacagaagttaaaggcttctgacgttgaagaattaccatatattcagggttatttgaatgcggcgggcatatcatcatatgcggatattcaaaaaagtacagatgtttcatctgtattaaatgaaaatgcaacagtattaaatgcagaacgcgttttaaaagtaataagcgacagagtagacgcagtaaatgagtatatcggcgaagaaacagaaataagtatggatttttatgtttcaataaatccgcagacagcaattacaaaagataatatacagcttaattgtatagatagcttgggtaatatagtcagcacagatgaatacttacttccaacatatgaaacaatgtaccaatcaggcgcagaagaattaacagcaaccatagaggaaatcagctcaacagttgaacctatgaaaaatgttgataattggagtaattataacagaatagcagcccgtgattatgctcggaaatggtggggcccgtacacaagtaattataatccggcatataataattatgtaggtaagggcggtgattgtgcaaactttgtttctcagtgcgtatatgctggtggagtgcctattcacggtggctggagccctgactctgttgcgtggataaacgcagcgtctttaaaaaataatatgttgcagtatggatatgcaacaaaagaggacgcttgggaaactaatgctggaaatttcgcttatactacggcgggacaaggacatattgtattggtaactcttaatgacactgtaacacttgcatatacagcgcacacaacaaattgtaaagaccaaccatttactcaggctaatatcaatggcggatattcattctatattataaagaatttttaattttatgataagttataagtaaagaaagagaggtttttatgaaaaaggtaattttaggtttaataattggtatagttatatcgacgggcacaatatatgcaaaacagataaatgacacaatagagattgcgtataataacattaaaatatcagttttcggacaagagtgcattccgaaagatacggacggaaatattgttgaaccattcatatatgagggtacaacatatgtccctattagagctatttcacaggcctttggaaaacgtgtggattggaatgacgaaacaaaaaccgttgaaatctgccaaccattttcctatcaagaagttatgaaagctcaagatgtaattaaaacattttttgatgattttgcagaaaataattatactgaaatgaaaaaagttcttagcgagccattttctcaatatgatatttctaatggtgtatatggtatgaaatcagccacattatcgggaattgagtatatagaagaaagttcagattggtctactgatacattgatttttaattgcactttcgataatgtggagtttactcctaacgcaagtaataataatgggaataacaaaggagcttgttatatattagttcataaagatagagatacatacactataagtaattttgtttctggactttaaaatactttgaggataaaacctcaatatttttcttatacagaataacttatttacaaaatcaatataatatggtacaatatggttacttttataatgtttttgtaataaggagtgaacagcgtacagccacaatgtgtggattgtcaaaaatttatgcgctattataggattatagggactaataaaaagtcggacttgtcaaaaaaatttgtttgataggttcggcttttttagtttctaatgcgaaaaatgaccgtttaagactaaataatatagaaagcgtaatattatgtgtatttatgacagatagtattatgcttttttctttttatacggcaatgctaaatatatatcaaaatttttttgggtatctttacgaaaaatcgttcattcaatattataaatcgtttttttgttttattatatcaaaagtgtatgaattatatctttttgtttcgataaataaaatgatatgtttttttataagacctccgcccgatatgcttgatttttcttacaaactttttgctaaaatacagagaatttttattaaatgttttttctgaaaacaagcagaaatttatctaattatttgttccccatatgagggataaaaaatcagttttcggtgttaggagttaaaactatgagagaattttcagaacaggacaagcagcgcatatcaaaacaattttgttccttttgttgcagcgtcctaaaaaatgaagcaaacaatataagagctgaatataaacactatgcagatttggaaatggattttagtttcctaagtgacaaggaacaggcagaattatatacatttgattgctattttgtaaccgataatgttttcaatgtatgtgatattcgtatcatagtatctaacaatatgttggcagaagctataaacaaacttccttgtgatttaagagatattgttttactatcatactttgcaaatatgcctgatatagaaatagcaaaacagcttgatttaagctattggattgtttttcgggcgcgcatacgcgcattaaaacgattaaaggcaattatcagtacggagggcattaagtgaaaaaaactttatcagacattcctttttcaataatcgaaaaagcaataaatgaagacatagaagccattgattacatacttgctcattatagaaattacataattcgtttgtctacgagagttgcccgtgatgaaaataataatgaatatatgtatgtagatgatgatatgcgttcaagacttgaaagtaaactaatttatagtattataaaaaagtttaaaatcttgtcttaaaataatgcggggtgctttaagcactccgtaaagtacacgatttatccgatataaacgcattatatctctaatgcgcttatatgggctaaaatcccctttgttctttgacaactgaataatccaatcatcaaatactttctttccgagcaggagccggcggctcgccgtaatgaatgtaacagcttctaccatacaaacagtatgccgagtacggacgttttacattttagcgataagaccgtcaataactatcggcttgcaaccgatacggccacgattgacgaaaagtataatgatactcccgccttgaacgcgtcactgcattgggtggctggacgagaaccgtgcaggggtgaaattcccgtgatactgattagctatcagtagtttgatgattgtttgagtgattgggttattactctcggtaggtggatttaacataaaatatttatggaggttcactatttatgaatgacactactcaaaacttagaacacaaaaatatttgtaataaaaaatcccttgacgctgaaattacatatcaagtcaatggaacctcatttgttgtacaaccgatattcaaagagaaatctttcgaaacattaggctctgttttattacggcttatgacatcaagcgaataaaatttttaaaacaggctgacagacggttaaaagcgcggtataatataaatgtaatactgtttatttgactgtctgaaaggaggaaataatgaagcggtcaaataacaaacaaaaagaaatgacagcggctttatatgttcgtttaagccgtgatgataacttagagggcgatagttacagtataggcaaccaaaagaaattactaaccaaaattgcaaaggaaaaaggctatacaaatttattgatattttgcgacgacggtatttcgggcgttacaatggaacgtcccggatataaagctatgattgaagcgatagaaaacaataaaatttcagccgtctttgtaaaagacctttcaagattgggacgtaattatattgaggtcggcagacttacggaagaatttttccctgaatatgatatacggcttgttgctgtttctgataatatagatacacaagagggcgaaaatgagcttgcgccaataaaaaatctttttaatgaatggtatgcgcgcgatatttcaaaaaaacgccgtatcagtaacaagataaagggtaatgcgggcgaaccgctcggacttcccccgtatggatatatcagaaatcctgacggaaagaattggattgttgatgaagaagccgcaaaggtagtcaaacatatttatgatatggcgcttggcggtttaggtacagaccaaatcgcttgcaggctggaggaagaaaaaatccttactcctgtaaactattggtatagtaaagggataagccgtccgggcttgaaaagctctcaggaatatccttataaatggcaccactcaacaattatcaatatactttccaaacaggagtattgcggtgatgtgataaactttaaaacctattctaagtcatacaaaaataaaaagcgttatgagaatgacaaagagaattgggcgatatttaaagatattcacgaaccaattatagaccgtaccgtttgggaaaagatacaggaacgccgaagcagacgaacacgcaaaaagccagtaacaggcgaagataagaatatgttttcgagattgctggtatgcgcggactgcggaagcaaactcggttatcatttcaatcaggctaatcacgatataacctattttaattgtatgggatataacaggggcagcagaaaaatatgtacctcaacacattatatccgtactgattttttagagcaggttgtactcggtgaaatcaaacgcttaatgaaatttgccactctatatgaaaatgaatttgctaaaattgttatgggaaattcgattaaaacggcagagcaggaacgacgctccaaacaaaaggaacttaactccttgcttgcgcgtgataaagagcttgacttactttttgaaaaaatttatgaggataacactcttggacgcataagcgacgacagattttcaaaattgtctgtaaaatatgaaacagaacaaaaagaaaatgaagtaaaaatcaatgaacttcaagcggagcttgataatgaacagaatagagctgttacaagcgatatgtttttatcttctgttcgtaaatatacaagggcaaggaaactgacaccgagaatgttaaacgaattgattgacaagatagaagtatatcaggctgaaaaaatagacggtaaaaaggtacagcggcttaaaattcattataactgtatcggagctattgaaatacctgatttaagtaaattacctgaaaataacgtatcagtacatacacgtcagggcgtaaatgttcagtatgctgcgcttgccgtatgaacacaaaaaaagaatgtccttattggttcaagtccaataaggacactcggtatggtcgaggtgacaggatttgaacctggaacaaacaacgctatatacgtatatttaagaatatcgactgataattgactttaaaaactgaatgaccatttctttttctggcaagaaaaagaaacgcttcaccaaagaaaaagtgcttgctcgcttaggtcgcctgcggctccaaagggcgctcgcccccactaatttcatcttgaatctgcgcttcaagatgaaaaagccttgtaactttcccgttggatttttgaactaccgtgaataaagattttacgagttagtattaagatagatttgagcaaaaagtaggtactaattaaaacgaatataaaaaaatatagaataattataaaacttatcaatagattagaaaataaataattagtttgtatattgaacactgcgtgttcagatgttggctcacctaacgcggcggcatagccgcccttccgatgttcgctgaaccccagcgtttttgacgaattaaataaataggaaactcgaaatatcttttttcacggtagttcacaaagtcaacgggaagttacagggcttttttcatcatgaagcatggcttcatggtgaaatgagcgtagtgcgagcgccccttggagccgcaggcgacctaagcgagcaagcactttttctttggtgaagcgtttctttttcttgcgagaaaaagaaatggttcaaacacctattataagtaaaataatatatattatatggggtcatatacatagtatataatttaaaataatatatagtaatataatttaaccctctttcgtattgaaagtattatttaaatatgatataatatattaaattcagggggggtatttaatgagtaaaaatattggatttgataacagggatcgttttattgaattaggtattacaatttccgcaataaggaaaatgaaaggattatctcaagaagaattagcaataagagcaaatattagccgctctcatttgagttatatagaagctccaaatatcgtgaggccgttctcattggaagttttatataatatagcagatgcgttggacgttagtgccggtgatttgttgaatataaaattcccatttagtgatgtaaaaaaagaatctaaatgattgaaacaaatactcttattatattttaagaatgaaaccatttaaaccattgaaactaaaccttgtatattgttttttataaaaaattatgttttttcaaacgtcggtaggtgtgaccacacctgcgaaagtgggcgtgagccttaataactctttatccgtaacccttcaacgtcaataatttgaatactcaaacgcggcaatgccgccgctttaggtgagctaacatttgaacacgcagcgttcaatatatcgttaacaattataaatataaaaataaaatattcttgacaaataaagagaaagagaatataataaaagcagataaaaggtaaccgttaaacggttgtcacaaaaacagattttaaattatataactgtcctgtgtcagaggacagttatattgcttttatggatactattataaaaattattataatagatataattactttaagtaagtatttccacataagcgacacctcccttctgctgtaagtaacagcatatggagatgacaaccgtcctacaattcccttttacctgctaaaagtaattatatatggtatatcgaataaagtcaaattaaaaattctttacataaattcacattttttaaaaaatgtaggtttgtcaatgatgtgttacaaaaaagattaaaagagttcaccgaaattgataaaagagttgatgtagtcaatgggagcttttaattggaaagctcccattgactacatcaactcttttatcaatttcggtgaactcttttaatcttttttgtaacacatcattgacaaacctacacaattatgtccaataatctatttgacaatctatcttttatatacaatactacataattcacttaacagacaagtatacggcagaaacggcgccgcttccgccgcaccatcctgccgtatatataatcggattacgatttctccgttaaccgaatttgataacagtatattagtcaggaatctgttcgctcaaaacaactgaaacagactcagtcttgcccgtagcatacttataaacttccagcttaaccgtatctccgggtgactttgtatctttatactcagtaaggtctgagcctttagatatggtcttatcatctatcttggtgataatatcaccctgctgtaatcctgcgtttcttgcattatccgttgttacagacataatctgcgcgccctgaggccatccatactgctgagccatatacgccgatacgtcacgtgttgacaatcctataaccggtcttcccttaacataaccatagtcaagaaggtcggatataataggctttgcctctgaaatcgggatagcaaatcccataccctctacaccggtagttgttactttaaccgcgttgatgcctataacctcgcctttggaattaacaagcgctccgcctgaatttcctgaattaatagcagcgtcggtctgtataagattcattgttctgttgtcaacctgaacagttctgttaaccgcgctgactattccctgtgttacgcttccaaagaactcaagacccattgggttacctattgcgatagccgtctctcctacctctacttttgtagagtcgccgaggttcgctactgtaagttcttctgtcggctctatttttataactgcaaggtcggtttggtcatccgcgccgataacctttgccgcatattcagaaccggtgttgagctgaacagatacagaacttgaatcagcaacaacatggttgtttgttacaatatatccatcggcgctgataattatgcctgacccctgtgcttctgatgtgctgtatccgccgaacaaactcatctgcccctgaaccgtgctctttattccgacaacagccgggccgacttcctttgctatctctgttgtgtccttgcttcctgtggttgaagcggtgcttgtcgctccgcctgtgcttcctccgctagactgtccgtcgtcggttttaagctgttctgataaagtggttttgtttgtcaccgttccgctctttgaaccaaacgagtgaccgagagcaaacgcgccgcccaaaactgctaaattgagaaccgccgccgccacaagtgccgcaacatatctgactgatttcttatcggtttttttcttgtttatatgttcattatacggaactccggggtttccgttcccgtttgacttgtatgcggcattaaatccgttattataagcctgattgctgtaaggtccgctttgataagaagttgaaccctgggtgttatatgaggtgtttgccgattggctctgactgttttggttccgataatttgttcccgaatactgactgttttgattaaaagattcacgtgcattgccgcccaaagccgaaccgctgtaactatacgatgctgtttcagttgaagaagctgtattttctgtcttatcgctgatttctattttagcttccgcctgacttggtatattttcctgagtagttgagacttcgttcatttcaaacgccgccgtttgctcactctttgaattatcattattattttcggtcacagaattttctgctccgtcgcctgaagtcatatcaaactcttttttgaactcgtccatactgatacctcctatataatatataaaaaatttaactgtttgaaaataaacaagttttctatctccttgctatgtttaacattatatacggaagatatgaaaaaattatgacgaaagtgtaaaagaattgattaatttaaaaaacattaattttcatataaaaaagcggctttccgaaatggaaagccgcccaaagttcgggcaaaacataggaaccgaatgctgcacagcagcgaggtgtgaagtttaaataattaaatatatttttaaaatttcatttaaatataattcagagacagctttaaactgcaagcaagcttgctgaataaagataatggttagcctttgttgccatttatttaatgacagaaaggagatgattcacatggattatatgtacataattatttttatgattgttttcattactctcattgagtcaataaaaaagtaaccgcccttaccccaaggattgcggttactttaaaatcccaattctcggctaaccgtttagcggttacctcttacctacttttattatatcattttttttaaagttgtcaaggtcatttttatctattatatgtctttatgtaaaaaacttttaatttgactttattcgataaatcaaatataatattatagaagcaggtaaaaggaaattgtaggacggttagcctccctatatcacttacttagtgatagaaagggggtgatttgtatggagtatgtttacataattatttttatgattgttttcattactctcattgaatcaataaaaaagtaaccgccctcttagctaggatagcagttactttttaactatattcctggctaaccgtttaacggttaccttttatctgcttttattataccatttttttttaaattgtcaaggtcatttttatatattatatgttttatgtaaaaaacttataatttgactttattcgataaatcaaatataatattatatttagcaatttaaaggaagctctcttcgacaggctcagaggcagctttgaacccgcaagcaagcttgctgattgaagataaaagaaaattgaaggacggttaacctctattgtcatttacttaatgacaatagaggtgattcacatggattatatgtacataatcatttttatgattgtttttacatgtatgattgaatctataaaaaaataaccgcgcctttgcctgggtcacggttattaaaataactaaactcggctaaccgtttaacggttaccttttatctttaatcagcaagcttgcttgcgggttcagagctacctctgagcctgtcgaagagagcttcctttaaattgcttttattatatcattttttttctaattgtcaaggtcattttttagtctattaatgcttttatgtaaaatacttttaatttgactttattcaatattacatatataattatatccagcaggtaaaaggaaattgtaggacggttagcctccctctatcacttacttagtgatagaaagggggtgatttatatggagtatgtttacataattatttttatgattgttttcattactctcattgaatcaataaaaaagtaaccgccctcccccaaggattgcggttactttaaaatcacaatttttggctgaccgtttaacggttaccttttatctgcttttattatatcattttttttctaaatgtcaaggtcattttttaatctattatgtttttattttaatcggcttccccggaggggacgacgatctcgcccaggctcggcgggcgaaactgggcctggcgcaacaaagtaagtaattataaaaataattaaataattttttgctgaaatgatatttattatattacatatttccgcgactgcgcgccttacgtggcagactacgtctgccctaccgatgcttgctatataatccgtttttttgttatgaaatatataaaaaactaactatctattctttctgctactaatccttcaaaaaaatcatcatatttgcaatcatatatctctcgcaatgctactaacacactaatgcgaatatttaactctccgctttcatatttttcatatgttgtcctgccaatgtcacatttataatgttgtagctcaacaatcggcttccccgtaggggacgacgatctcgcccgggctcggcgggcgaaactgggtctggcgcaacaaagtaagtaattataagattaattaaatgtattttgctgaaatgatatttattatattatttatttccacgactgcgcgccttacgtggcagactacgtctgccctaccgatgcttgctatataacttttttattttgaccaatattgtggtcaacatattacttaattttattatatattaatgttgcttaatattttcaaataatattatgagattgacattatataacaacattagtaaacaaaatttacataactactgtgtaaaatttatctagtaaattattcataatatacattctgatatgtagaaatatttcttatatattattgtattgacggtagttaaattaattttgaaaatattgtaatattgggtcatatgaggggtgtagcaaaagatgaataataaatttttaaataataaattctctaaaagagaaaaaagaatacgcaaaacttatgaaattgaggatgatttatataactttttagaagaagcttctttaacttacgatgcttctgtttctgatattttaaatttttgcatatcagaattaattagaacaaatgatttaaaaatttatacttcctctaatatgaaaaatccatcacataattttaatatagcagtcagtaatgtaaaaggtctcgcaaaactaagcgagacaactccatttactataaaatcgttagtaaatatgtctataagaaatattacatagttctgtatcctaatattccatatatttatattttataaatacttttatttttcacttacttttgcggatatatctatgaaaaaatattctttattaattagtattttattatctatattcttaataaccagctgttgccaaaactcagaatttatccggcctgaattatctgagccaacgcctgcagcttctttttatgcagataatttgtctgttgattcatcggataaattatccgtgcattttatcgatgtcggtcaggcggactgcgcacttctcctctgcggaggagagtctatgcttattgacggcggtaacgccgccgacagcagtctgttattctcttatcttaaaaagctaaacgtaacttcaatagattatatgatttgctcccacgcccatgaggaccacgtcggcggtctatccgcccctctctccactatggaagtcaaaaacgtctttgcccccaaaaaagaaagcaccagcaaagcatataataactttaaaactaaggccgccgaacagggattggaaataattcatccccaatccggggatacaatttcattcggcggctgcacagtagaattctttgtccctgccggcttaggctcaagcaatatgaataatacttctattatctgtaaaatcactttcggcaacacatcatttctattcaccggggacgctgagcgcgaagaggagcaaaatattatagaacagggctgtaatctcagagccgatgttctgaaagtgggtcaccacggttctgaaacttcaacgtcgtatgtattcctgcgtgaggtaatgccaaaatattcggttatatcagtgggaaagaaaaacagttacggtcacccgtcagaagctgttctgagccgtctgtcagacgagggctcagaagtttttcgaacagatttaaacggcgatattattatggaaagcgatggaaccaatatctcaataaccacgcaaaaaaattaaaaaccggctccaaaactatatcttagctgcggagaccggaaacaaatatataaggagagaaaaaatggattatgtaaacatgattgcccacgactacttggcaaaaaacgactttataaaacggaaggagtattctatctgcattgtaaaagaccatagctggtatggctacgatgtatcagagaatccattcagtatatacatacgggacagatacagacatacaaaactgcattcgatactgttatatcagtttaaaacttttgaagatacagaaaatttctgtataaagattgatgaggataaaactgtatatgatttgatgtcagagcttaaaggatataatgctgcgttaaacaaaaaaatagaaaagaaagtaaaacaggataaagcggattttgaaaatttgcttaaaagccataatattacatatcagcagcttacaaacattaataatgagtataataatttgccgacttatataaaagtattttatacaaagctgagaaaaggggaaattgtataaatatattaaaatctgacgtatggcaaaaaagttttagcttaaagcacaaaactagaagctgcttagcaagcatcggtaggtgtgactgtgaccgcacctggaaggtgcgtatgcgccacaatatctatttaccattaaacctaaaatgtcaataaataacttagttgtgatatttcacacctggagggtgtgtgttatacgtattaacttattttgttgtacctacaatgtctgcgaccccaccagtatggtgggtgtgatacaaaataacttattttgatttacctacaatgtctgcgaccccaccttctaggtgggtatgatacaaagtgacttgttttattatagcctacaatgtcaataacatgaatactcaaagaataatatgaatacgcaaatattaatatgtatactcaaatgaggacaaagtcctcctcgttaggcgcgcagtcgcgggtatatttaattttatctctaatccgcttaattaatttataattgcttactttgctgcgccaggccctgtttcgcccgccgagcccgggcgagatcgtcttgccctttggggaagacgattaaatcaaatttgtaatactacataataaaaatggcaataaaaaatgacctgaaataaaatacaaaatttttgtgttttatttttcggtcattttttgtacctattattcttagtaaaattaaaaaattaattataaaatcttaagaagcattcttaagctgaagtcttaatttgtctgctatcattgctataaattctgaatttgtcggctttccttttatttgtgacaccgtgtaaccgaacacgttgtttaaggtgtccatgtcacctctgtcccacgccagctctatcgcatgtcttatcgctctttcaactctgctcgacgttgtgctgaagttctccgctatggttggatataattctttggttacagagttcattatatccaaatcatatatcgccatcattattgcccttcttatgtattggtatccctttatatgcgccggtatgcctatctcatgtataacgtttgtcaccattgcttctacctgtgcatagtcaaacttttttgtgttcaccttccagttctgcattacatcttcgcctgtggttatcggagccgccatcattgtgattctgtcaatcagcgcatcatagttgacaggcttcaacatacaatattcaacgccgtatgaattggaatatgacgttacagtctcgttcaagactgagcttactatcagaacatgaggacgtttattcagctgcattctgttgattctctcaagaactcctattccgtctatggtcggcagcaccaaatccattaccaaaacatctacgtcattattctttactgaaacggagttatatgtatttcttaactatttaaaaaggaagtatttaatggatttttattttaaatagttaattatttttatataagcaaaaactttccggtgtttttactccgtttcagttttttatgcgtatgcttgtccaacttttcggagttaccggagcgcgtaatgatttacgccctccggaatttttcagtttatgtaaaaatccatctttttaattctacactccataatttctaatagccaaatatttacctattattaaaataactaatcaataaattgaaatttattatttatatacctctcttttccgtcaataacaacttttgctctgccattaacaaacgattcagcataatcatacctgttttctgttgcatattctccggatttattaatatatgtgaactcatctttttcatcaaaacttgcaaaaagcggtctgggtaaatttcctttcgtttgaacaaccgctaaaccttcagaaaaattattaccgcttacaaatgttttatcgccaaacatcttattacctgatttatcaatataccatgctctaaaaacattatctaccgtatcataaacacatgcgcttccatccttaaaatctgtcgacatataataatattcaaatggtataactaactctcctttgacatttatataaccatatccatcaaatcggtcagtccccgtacaaattacatctcttgactttaccaatgctaacccatcagaaaaattattcgcctcagtgtatgatgcttcaattacaatatttccatctgtatctttatatccatataaacctttatcttcaaatacttcaagattattattagcttcattattcttttttaatgctatattatcaacacattctccctttgtgtttattctatatggatatggataaaaatcagattttactgttgcaatcccattctgaaaatcacctgcttctgtatatatatcaggtattacaaaatatccatagtcgttaatatagccataatatttttttgaagaatatttattactttgactcgctgcagctagaccatcagaaaatttactgcagtcagaaaaatatccatattcattctcaggcatatcttctctattaaaatagtaatatccaaaccactcatcacaagatatgtctccgacatgccacttatcaggcagatttgagtcatcaatgatatcaacaattgaatattcatcatcccatctaaccatacaccccaaagcttccgagactgctctaagaggaacataggttctgcagtcatctactaaccttgcaggaacatctaattttatatattctttattttttatcattatatcactgtttattgttacggatatagtaatattattttttgtggctataactgtttgattgttctcatcccaatcaacgtcagcatctaaggcttcaaaaatcccccgcataggcaccatagttctgttatcttctataaacggatacatatcaaggtttatttcattattatttatgtagacttttatttcgtcgttataacttaaattttcagaacaaaaacaagttagagacatcattaatactacaattattatacttacaaaacgtatacatttcattttacttcctccaacaaatattattttgccagcaatatcattacattgcttatacatcaaaaactttatgctttaataaaattcttctaaatattttctatatactcataaaaactaaaacggaactatatgtattctctaaccattcaacatagaagtatttaatggatttttatttcaaatgattaagtaatttttatatattcaaaaactttccagtgttttttactccgtttcaattttttatgcgtactcttgtccaacttttttgttttaccggagggcgtaaatgatttacgccctcaaaatttacttactaaacattattttttaaagttatcttaatttattattttattaggaacctttattctctatagccttttttccaatcatctatgtaatacatatttacatatccccagtagccggtctgaaatcttggtatgtataaaatagttctcactatttttgaaaattctttccatgttatattatcgtctaactcttccggttcaataaatactgacgatgatgaaattaaattcccatagtttatcatcctacattcttcagctaaatctaaataaaatgaatctgataaatcacctttataaagaagttcactatttaaagtccttaatgccataactattacatctctatatgtagctaaatctttaatattagctttatgtaatccattttctatatctcctttaaatatactaccttctactccccaaactactattgtacattcctcagtaccattttcaatatcttcaaattcccatccaagtgttgaacatatactctcttgattattcctaggttctaagtcattatcaatatagaccaaacatgagagtgtatcaacaacctctgcccttgttactaaatcatttatatctttttctctatattcttttggtactattcccaaatcacatattattttaaaatctccatcagcccaaaattgacctatttgtgcacttactgttatacttgataataatatacatattgcaatcatacatcctattgatcttttcattttttacacatcctttttatttatataatactttagttataaacatctaataaatattctactatgttgggtcctctgcttctcaatattgctgctgatacataatcacctatccttttttcttttaaatcacccatatctgattttggtgaaaaaacagaattacttgttactgtcaaatcatacggaaattgaccatatccattggttcctattactaaatctgtattttcacttcttgtttcataagatttttcagctctaaaagcatcttctattgtcattgcaaacgcttctccatattgtttttctatataactttttatttttgactttgttatttctacacttaattgtttttaatatacttacttacgaataaaaaactgaaacggagttatatgtatttcttaactatttaaaaaggaagtatttgatggatttttatttcaaatagttaattatttttttatattcaaaaactttccggtgtttttactccatttcagttttttatgcgtatgcttgtccaacttttcggagttaccggagggcgtaatgatttacgccctccgcaacaattttactttgtataaatatctactctttgcaatgcttcgtcccattctacccgacaaccgaatgcttctgatattgctctcaatggcactaatgttctgctgtctcctactaatcttgcaggtacatccaattttatttcttctccatttttttgcatcctattactgtcaattgtcactgatactgttattccatcctttgttgctgttgccgtttgcgtttcattttcccattctacttctgctcccaacgcttcaaatattgctcgcattggcaccaatgttctgtctttttctgttataggatatgtatcaaaatttaactgcttattgtttaaatatatttttatttcattgctactttcatattgaggtattttatcctgatttacaaatttaggagaattgtttaactttacagttttatgattaagaacaaatatagtatttaattctccagcataatatactgtattattttgctttaattttgtatgaccagtaaaacaacatacaatgttattattaccaccaataaattcagatacagtactttcatcgtctgaactattttcatataacaatatctctccaatttcggttaaatccctattataaaaaacattttcaagtctaagtaaattctcaccataactaaaacatttgtcatacaaattattaccttgtatatattgttttaactctttactaccaataacctgcccatctggagaaactagttctataaatccagtattgttctgattttcgtttaaatacccgtcgaataaaaccataccactatccaatattctaaaatttttataatacgttccatgttcaattatgaaagtattagtatatttaagttcattatcccttccatacatatatgcatttattttgtcaaatttatcgttttgttttgataaaaaggtataaacttttattgatgattttgaatcatatcctattaattctccgctgtcaggcagttctatcttgttcttttgacaaggaaccaaatccttatcaattatatattttttaccgtttagattgtattctgcataaccatttgaaaatacctcataattttcttctttatcatattctgttgctatacttgaatgatattttacaaaatcaccttttgtactaaaaataacattacctgtattatcaaaaaagaaattttctatctctccagaattattctctttgctagcaaaccccataccatctttaaaaattgtagcaaagttgtatattggtggaacaacccaattatatgactcgtttatatatccatatttatcatctatctttacccttgctataccatcataaaacaaaccattcaataaatcatcatttttattataataccttattgaaccatcatatccgactaacgccatattccatttatcaacagagttttcattatcgtctattccgtaaaaatctatccatattccattttcatctgcataataaatatttacagcttgagcatctaaaatacaatcatcatattttatggcctctttaagtttaataacatgatattcgttatcaattttatttgcaaatgtttcattatgttcattataatcattttcaatgcttgaaaaagctaccatatttacaaacaaacataatggtataagaataataagtattttttttaataatttcattttcatcacccaatctttctattctatatactcccagccaggagcgtatttatttaatatatcttcatgatccgaatatgcaagccaattattaaaaccattatttttatagttatataacatcatagcaaaatccactggttgtgcaaaacttccattcgacataatactcccagtattttttataggtttccctttattgaaaggtttactgtcaaaataaatatcatataatttaaaaccaccatgaccaaattcatgagccgctacattttttaagtttcttatacaatttgttactgcataatcatattggatttgaatttcctcttccgtaaaatcattatcatcaattctcgtcggtttagtacaatttaaagtaatatcacctgatctgattttggtgaaaaaacagaattacttgttactgtcaaatcatacggaaattgaccatatccattggttcctatcactaaatctgtattttcatttcttgtttcataagacttttcagctctaaaagcatcttctattgtcattgcaaacgcttctccatattgttttttatataactttttatttttagttttgtcacttctacacttaattgtttttaatatactttactacgcataaaaaacttaacagagttatatgtatttcttaaccatttaaaaaggaagtatttaatggattttatttcaaatagtttattaattttatatattcaaaaactttccggtgttttactccgtttcagttttttatgcatatgcttgtccaactttttggtgggattaccggagagcgtaaatcattacgccctccgcaacaattttactttgtataaatatctactctttgcaatgcttcgtcccattccacctgacagccgaatgcttctgatattgctcttaatggtaccaatgtcctgctgtcttctactaaccttgcaggtacatccaattctatttcttctccatttttttgcatcttattgctgtcaattgtcactgatactgttattccattctttgttgctgttgccgtttgggtttcattttcccattctacttctgctcccaatgcttcaaatattgccctcattggcactaatgttctgtcaccttctgttatcggctctatatcaaaatttaatcttttattatttaagtatatatttatttcaccataaacatctttaggttcaacatatttacttattctatttttatctacaagcaaattatcattactcaattcttttttattattataaactatgtatacatcacttaactgataaagacctttactaaatatactatctgatgaatctgcatattttagtaaactacatattaattttcctttatttacaaaaattttaacttcataattatcattgttatataaatgacccacatattctaagttattatccataacaattccattatcaaatactaacatattataaaaactatatacttgttcaaatggaaatccatctttaaaataataagatgtataacaatcacttgttaatgcagaaaatagtacaatgcaatgtgtatcattttcaacatttaaacataaaattagatctccattatttaatatttgacttgtaaaaatattaaattttttaccaattttatcacttaaatttagtgcgtttagtaattcaccttttgaattatacccatttattattatatcgttatttttttcatcagctctataatatatattatttttaattctattatcaaaagtgatataacctccttgacttacttccttttcttcttttgaatttaagtcatacttatttataatattaaaactattatccaacaaatattgactcttagtctttagattacttaattttaaaataacatcaccagtagaaaactctgcataaaattcatcttgtctaaaagaaatttgtacttctccgtaaatattaaatatatatattcttttgtttctctcagccataataaaaccgttatcgcaatacactattctctcatatataggtggaattatccattcatatttactatttatacatccatatttatagtttgttttatgctcgtctaaatttttatctgtcgtttttataattgctgtgaccacacctgaaaggtgtgtgtaataaaaagttacttgttttaaataacctacaatgtcattattatgaatactcaaataaaagaaaaagtgctgctcgcttaggtcgcctatcggctccaaggggcgctcgcccccgctaatttcttttgcgctccacgcacaaaagaaaaagccttgtaactttcccgttgactttgtgaactaccgtgaataaagatattccgagttaatattgatttaattaactaaaaaagtgggtttttcagtgaacttcagcagggcgcatttatgcgccacgttaggtgaactatcatctgaacacgcagtgttcaatatataaatttgatatataatattttgtttattaaaaataatatatatctactatgtatatgaccccatataatatatattattttacttataataggcgtttgaaccatttctttttctagcaagaaaaagaaacgcttcaccaaagaaaaagtgctgctcgcttaggtcgcctgcggctccaaggggcgctcgcccccgctaatttcttttgcgcttcacgcacaaaagaaaaagccttgtaactttcccgttgactttgtgaactgccgtgaaaaaagatattccgagttaatattgatttaattaactaaaaaagtcggttttttagtgaacatcggaagggcgcatttatgcgccgcgttaggtgaactatcatctgaacacgtagtgttccttatatttataaatattattactttaatatggattctttttattagtgcgatttaataagtaatcggttgaggtattgtaaaagtcggcaagtttcactagaaaatgtagaggtatagtttgaaaacctctctcatatcgtgaatacacggtttgttgtattcctaacatttcagcaatttctgtttgttttaaccctgcgcttaagcgtagagttcttaaccttttcaaatacattttatcacttcctttacttatcttctaattttttctgtttttcatcttcattaaaataagaagaaggcaggttaagattaagtaagtcgccgggtttaacctctaaaatatctgcaatattaaagaaaacttctaaagagaaggaagaagatatattaggagcttcaatagaactaagatgggaccgactaatatgagccttctctgcaagttcatattgagtatagcctttagcttttcttaaagcagaaatcatcaagcctaactcaacaaaacggtctctgttttcaaagcctacttcttttttcataagtattctccttttattttataaattcatatatataatcaaatatatataattatattatagcatataaaaacaaaaatctaaccgattatagtttgaatttatataaatttaaccagtagaattggtaagattataaatttatattataaagtcaaaacgtatattgaatactgcgtattcagatgatagctcacctaacgaggcgcataaatgcgcccttccgaagttcgctgaaaaacctgcttttttgtttattaatctagattgaaaacttgacttttttaatgagtaaattaataggaactcggaatatctcttttcacggtaggttacaaagtcaacgggaaaatagtagggcttttttcatcatgaagcatgcttcatgatgaaattagcgggggcgagcgccctttggagccgataggcgacctaagcgagcagtactttttcttttatttgagtattcataataatgacattgtaggttatttaaaacaagtaactttttattacacacacctttcaggtgtggtcacaggtgaagcgtttctttttcttacgagtgtgaccacactttccttgaaagtgtgtattatacatatgttcttatttttccataacctgcaatgtcaataatatgaatactcaaataaaaagaaatggttcaaacaccctattatgtaataataaatttttttatatggggtcatatacaaagtatatagataattatttcagtagataaaataataaatattaaatggaattataaataaagttaatttgagcatataagacctgcaatttttggacacaaaaatatccctgtctagtttagacagggatatttttattactcatgatttacattatccttcactacaacgtcatgggctccgccctcaataatcgatacactgcttaccaatgtcagttttgctttattctggaattcagaaatattcgtagctccgcagttgcacatggttgagcgaaccttgctcagggtggttgttagattatcatgcagtgagccggcatatggaacgtaacagtccactccctctacaaacgagagctttgccgcgccgccgaggtcgtacctctgccagtttcccgctcttgcgcttccctcaccccagtattccttcatgtaactgccgttgaccataactttattggtcgggctttcgtcaaatctggcaaagtatctgcctagcatacagaagtcgcagcccatagcgagcgctaatgttatatgatagtcaagaacaataccgccgtcagaacatatcggaatatatactccggtttctttgaaatattcgtctcttgcctctgctacctctatgacagaagtagcctgtccgcgtcctatacctttggtttcacgggtgatacaaatacttccgccgcctattcctatctttataaagtctgcgcctgcctcagctaagaatctaaatccctctctgtctactatgttgccggctccgactttaactgtgtcgccgtatttttcacgtatgaattttataactctcgactgccattccgtataaccctcactggagtctatgcagagaatatctacacctgcctctacgagagccggcacacgctcctcgtaatctctcgtgtttatacctgctccaaccacgtatctcttatgtgaatcaagcagttcaagaggattctctttgtgctgttcgtaatcctttcggaatacaaatgccactagtcttccgtcatcgttaacaatgggcagtgaattgagcttatgttcccataatatgtcgttggcttcttttagagttgtgccctcaggagctgtgatgagcttgtcaaacggggtcataaaagttgagattttttcatcaggcgacatacggctgaccctgtaatcacggctggttactatacccacaagcttgccgttttgtgttccgtcttctgtgacagctattgtggagtggcctctttcagcctttaatgcaagaatatcggctaaggtcttgtccgggcttatatttgagtctgactcaacaaaaccggccttgtatgccttaactttcctaatcatttccgcctgcttttctataggctgtgagccgtaaataaaggatacgcctccctctctggcgagggcaatagccatatcaacgcctgaaaccgactgcattatggcggacacaagcggagtgttcatagataatgcgggttcctcaccttttttatattttacgagcggtgtttttaaagagacgttgccgggaatgcagttagaatcagagtaacccggtacaagcaagtattcactaaatgtgtgagatggttctttgtaataataagccatatttatatcctcctataaaattaatattgtgaatagtacggtaagtaagtttaagattttaagtttgccggtaaaaaatgtataatatcacgcgtcttatataacaatatatgagctgatattttatccatatattacggcaattttgttagataataaattaaaaattaattgtcgtttttttaataagatattatatcatagagttgaatatttgtcaaagaattgctaaaaatgattttaagtgaaaaatcttataaattcatcaaaatgacgatataaagcaagccgtgaaaacgtggactgaactcaaaattggattggaacaaaaaaatatcttcctttttttggtgaaaagttactataaattcatgttttcagggctcaaaaggctcaaaaatttgtttatttatacaaatattttataaatcaaaaaaatagtgtggaaatttgcagttatttgtagtaaaataaatacgtattggtggattaaggggatgggagtatttgcagtgcttataggctataactatattgttgtggcaaacggtcattctaagacgttaacctgaaacagacatgcagatattaaccctacttaaagctttgaaaaaataattattttatatatttttttaggaggacaaaaaatgaataagcaagaattactttcagctatggctgaaaaatcaggtttgacaaagaaggattcagaggcagcactcgcagcttttattgaaacagttcaggatactctcaagaagggtgaaaaagttcagttaatcggatttggaagttttgaagttagagacagagctgccagaacaggaaagaaccctctcacaggtgaagaaatgaatattcctgctgcaaaggttccggcttttaaggctggccgtgcgttaaaggatcttgttaacaacaagtaattttaagaaaatatataaaaggaatgcggtttagccgcattccttttttaatttaaactttattttgctgatctgtttttataattaggatttaaaacaaattctattttttataattgccaaaggtttaacatttaacctgccgtttataaaattgtgcaggtattttctaagtaagattttattttcgttttaacagctccgggtgatccatggcttttccgagaccggttacaacacaggtttcagggtcgtctgcgactttggccttcatattgagctcacgccagataaggttggtaataccgtaaattttagagcatccgcctgtgagtacaataccgtttctgcaaatatcaccgataagttcaggcggagttttttcaagaagcgttctgatggcgtcaactatagctccggcggattccttaagcgcgtctaaaatttcatcgcttgagacctgaattgtctttggcagacctgaaaccaaacttcttccgcgtgcttccattgctaaaagcttgtctcttttatagacgcagccgatttttatctttaattgttctgcggttctttcacctatcagaacgttatattttttcctgatatatcttattatagcgtcgtcaaaactgtctccggctgttttaatagaactgcttatcactattccgccgagagatataacggcaatatcgcaggttccgccgcctatatccacgacaacgtttccttttgcttcctcaacgtttatcccaactcccaaagccgccgccaaaggttcttcaaccaggctgacccttccggcgcccgcctgaattccggcgtcaataacagcgcgttcttcaacctccgttatattgcttgggacgctgacaaccattctcggttttataaacgctccgataaaactgtgtcccgacgatttttgaacaaaatgcttgagcattctttcagctgtcgaatagtcagaaataacaccgtctttaagaggttttaccgctatgatgtttccgggtgtgcgacccagcattttttgagcttcagcaccgaccgctattatcctgtccgtgccggagtccaccgccacaacgcatggctcccggtctattattcctctgcctttcacataaacaagaacggtagacgttcctaaatctattccaatatcctgcccaaacataatgaggattctccttccaaaatattacagatatgttactatattgcaacacaatgattattgtagcttaaaatattcctattgtcaataaaatttgccttaaacctttttacaaaaagcgacttaattatacaaaccaactgtgtaaaatactgctgaaagagttagattggagtattaaaaccttataatatttttaaattaagggacaacaataaaaatagttaacctaaatttaacattagcatgattttggatttaacattagggtaataatataaatatgttaagaaatgcagaatttgctaacagaatcagcggtattatcaaatcagttgatttaaaacaattaaaaggagagaaaaagatgaaaattaaaagagggtttatcttagcggcggctgtatcggttttagtgttgggatgtatggctttaacttcatgcggttctgataccgccggcaaaggcggaaatattacggttatttcaagagaagacggttcgggaacaagaggagcgtttattgaactttttggaatagaggagacaactaacggtgaaaagatggacatgactgtggatacagcagatataacaaacagcacctctgtaatgatgacaagtgtatcaggcaatgtgagagcaataggttatatttcgctgggttcgcttaatggcagcgttaaagcgctgaacgtggacggcgctgaagcgacggctgaaaatataaagaacggcacgtataaggtttcacgtccatttaatatagtgacaaaagataacgtttcggaagtgacaggagactttataaagtttatccagagccaagaaggacaaaaagtggttgaagacaatcattatatttcagaagcgaacaccggaaattatgcgggcacaaaaccgtcaggcaaaattgtcgtatcgggatcatcttcagttacgccggttatggaaaagttgaaggaagcatattccgaattaaatccaaacgctgaaattgaaatacagcagagtgactcaacaacgggagtgaccaacgctttgtcaggagtatgtgatataggaatggcaagccgtgagcttaaggacagcgaaaaggaaaagggcgcaagtgcaacggtaatagctctggacggtatagcggttatagttaacaatgaaaatcctttaaataatattacatcggagcaggttaaacagatttataccggagagacaaccggttgggatgatattcattaataccaatcatataatggggtatttattatgacgaaatttaaagaaaaatttatgcacggcgtgtttttattctgtgcgtgcgtatcaatattggcagttcttctgatttgcgtatttttatttgcgaacggcataccggctatgaaagaaatcggtctgtttgactttctgatgggaagacagtggaagccgaataataatatatacggaatactgccgatgatattgggaagtatatatgttactgccggagccattttattaggcgttccgataggcattcttgtagccgttttcatgacgaggttttgtccgaaatggctgtataaaatacttaaaccggctgttgatttgcttgcgggaatcccatcggttgtgtacggattttttgggcttatggtaatagttccgctgattcgtgatttgttcggcgggagcggaacgagtatgttagccgcgtcaattgtgttgggaataatgatactgccgactataatatccgtcagcgaatcagcgataagagcggtgcctgaaagttattatgaaggttcgctggcgcttggggcaagtcacgagagaagcgtatttagggtagttctgccggctgctgcttcgggagttatggccggcgtgatacttggcgtcgggcgtgctatcggagagactatggcggttattatggttgcgggaaaccaggcggctctgccgagaggattgttcagcggcgtaagaaccatgactgcaaacattgttttagaaatgggatatgccgcagatttgcacagagaggcccttatagctaccgcggtggtgctgtttgtgtttatcctaatcataaacgtctctttttcagttttgaaaaggaggtcggaaaataaatgagaataattttgagaccgtcaggcgaggcagcggcggaacaaagatttgccgggaggcgcagcggaatgaataaatcaaagctacagtcagtgattttaagaactcttgtatatacagcggcgtttataacattcggcgttcttatttgtcttattgcttatatattgataaagggaattccaaacttgtcgctagaccttttcagttttgaatacaactctgaaaatgtctcgctttttccggccttgataaacacagttgttatgacggctctgtcattggttatagcggtgcctttgggagtgttttctgctatatatcttgttgagtatgcaaagagaggaaacaaaatagttggccttatcagactgactgcggagaccctttcgggaataccgtccatagtttatggattgttcggattccttttgtttgtcacagcattttcgtggggatattccctgcttgcgggagcgtttactttggttattatgatactgcccgtcataatgagaaccactgaggaagctcttaaagctgttccggatactttccgtgaaggcagctttggcttaggagccgggaagctcagaacagtgtttaaaatagttcttccgtcagcggtgccggggattttggccggagttgttttatctgtcggcagaattgtgggagagactgcggctttaatttatacagcaggaacggtagctcagattccgagcggtttgttcggttctggaagaaccctcgctgtacatatgtacgctctgtggagtgaggggctgaacactaatcaatcctacgctacagccgttgtgctgcttattatagtagtgatactgaacgcggcttcatcggcattggctaagaaaatttccagtaaataatattgggtttatggattccagcaaaatccaaatttaagtataaggataaaaagttatgagtgtgatatccattaaagatttaaatcttcattacggggattttcatgctttaaaaagtgtaaacatggaaatacctaaaaatgaaataaccgcatttatcggtccttcgggctgcggcaaatcaacattacttaaaacccttaacagaatgaatgatttggttgagggctgcagaatagacggagaggtaaaacttgacggtataaatatatataaggacatggatactaatttgctccgcaaacgggtgggaatggtttttcaaaagcctaatccttttccgatgagtatttatgacaatatagcgtatggtcctagaacgcatgggataaaatcaaaggctaagcttgacgagatagtccaaaagtcgcttgagcgcgccgctatatggaatgaagtaaaagatagattaaagaaaagcgcgcttggtctgtcaggaggacagcagcagagattgtgtatagcgagggcgctggctgttgaaccggaggtgttgcttatggacgagccaacgtcggctctcgacccgatttcaacttcaaaaatagaagaccttgcgcttgaattaaaaaagcgttatactatcgtcatagtgacccatagtatgcagcaggcaacgcgtatatcagataagaccgcattttttcttttgggtgaagttgttgagttcggagatactgaacagatattctcaattcctaaggataagagaacagaagactatattacgggaaggtttggttgatactatgagaagcaaatttgacagacagcttgacaaactaaacagagagctgattgagatgggtgctctgtgtgaaaatgcgattgattgcgcgatacgggctttgttaaatcatgataaggaaacagctgatgaaactctgtctatcgaggaagagattaatcagatagaaaaggatattgaaggtttgtgtttgaagctcctgcttcagcagcagcctgtggcaagtgacctgagattgatttccgcggccttgaaaatgattacggatatggaacgtatcggagaccaggcggcagatatagccgagatagtaatccacaccgaattaatggacggatataacagcgcgcatattaaaaaaatgactaaagcggtttccaaaatggtaactgagagcgttgacgcatttgtcggaagcaatctggagttagcccaggatgtaataaacagagatgatgaagtggatgatttatttatagaagtaaataatgatttaataaaatatataactgaaaatccccagaatgcttcggctgcacttgatttgatgatgacttcaaagtatttggagagaattggggaccacgcggtaaacatagctgagtgggtagaattttctatcaccggagttcatagagaatagtgaggataaaaaatgatttattgtgttgaggatgacagcgggattcgggaattggttgtatacagccttgaaaatacaggattttcggctaaaggctttgaaaatggaaaacagttttttgacggattggatgagagcagtctgccggatatggtgctgcttgatataatgctgcccggtgaagacggagtcagtatacttaaaaagctgcgtgccaatcccaagaccaggaacttgccggttattcttctgaccgccaaagattccgagtatgataaggttatcggtctagacagcggcgcggacgattatgttgcaaaaccgtttggaattatggagttaatctccagaattaaagcggttttaagaagatgcggtcatgagggaactgtctcagacgactgtgtatataacatcggctgcataacgcttaacacaaaaaagcactctgttgaggtcgatggaaatagtgtcgaactgacgttaaaggagtttgaagtattgcgcctgcttatgaaaaatcaaggaacggtaataaccagggatatactgctcgaacagatatggggatatgattttgacggcgagaccagaactgtcgacgtacatataagaacccttcgtcaaaaactgggtcacggaggaaatataataaagactattcggggcgtaggataccgggcggaggaatgatatattgagttaactgttgggcggcacagtaaattgtatttgaaagaaagggggcgtcattatgaaactgagcagcagaatttttggaggaattatattaacaacgttaataagtgttgttttcacaacagttatagtcgccggacttttatataacaatctatcaaatgaaacaaaaacacaaataaaaaacgaagctgaatatataagtgaaattcagaatatttctcctgtgactatggacataagccggctgggaaataggggccagaaccgtataacccttataggttctgacggaacggttaagtatgacaactacagcgactttaatgatatggaaaaccatattgggagacctgaggtacaggacgcgcttgaaaaagggagcggcgagagtaccagaacgtctgacacattcggtaaaaagacatattactacgccgtaagactaagttcaggcgacatacttcgtgttgcatgtgaaacatccagtatgtttggagtaatttttaaggctatgccgggaatattgttctcaattataattttgcttgccatagctatgtcagtcgccggattccttacaaaaactatagtaaaccctattaatgagcttgatatagataatcccaccgcggcaaaggcttatgatgaactgtcacctttacttgtaaaaatcgatacccaaaacaaggaaatgattgagcagataagcacaatttatgacactcagagagaaaacgaatttataacgcagcatatgaatgacggattaataatcattagcagcggccgacatattatttcggctaatatggcggcaaaaaaaatatttgattttgataatgtcagcagtaataacggaaagataaattacctaagcatatgccgtgataaaaagtatatggaggccgtagaaaaggcgtttcatggaatatcaggggatattacgctggaacgcggagaacgtatatacagaatatcaatatcatctgttgccaaggatttttctgcggggaatggaagcaataaaatatatgctgttttgatgtttatacacgacgtgactgagaaagaagcgtcagaacaaatgcgaagagaattttcagctaatgtttctcatgagcttaagacccctctgacttctataatgggatgcagtgaaattatgaaagccggaatagccaaacctgaggatatgccgaggtttttaggtcagataaattctgaagcaaaacgtttgttagctttaatagatgatattatacgattgtcaagccttgacgagggtaatggcattgagatgagtgatgtggatttatacaaagtttccggggacgtattaaacgagctggagatgaaggcaaaacagagtgagattactcttgagcttgaggggagcagccaaagtatcgaaggaaacgagcgcctgattcatgaggtgatatttaatctttgcgataactctatcagatataataaggagggcggaaaagtaaagataacagtaggtaaatcaggagataaaaaatttatatcagtggaggataacggtataggcataccaaaagaagaacaggacagagtatttgagaggttttacagagtagataaaagtcattcaaaagagaccggcggcacaggacttggactgtctatagtaaaacatactgttttaattcatcatggaaaaataactatgaacagtgaggtttcaaaaggtacgaaaataacagtaacattttaattatatcttcaaaaaaatttttgctgtattaaactaacagcaaaagaaggtggtttcaaaaaggaacctctattttggtgaactggtgttcttatagaacttatttaaaaactcagtaaaataaagatttttgattatcagtagtcagtattaacctcaaaattaaatatttttataatgctctgacgtaagaaagtcggagcatttttgcgctctgaaacgcagtttttgctctatttgccattgtatattttattaaggattcaagttatattacgaaaggaaatgtatttaaaataaatattaaaaatgcaaaacagctatctcctgaatccaaaacagagaaagatgtatatttgcttaacgacagaaaactgctttggtctcacctgaattattataacggtaagatttgttcaatgtgtaactaataaaagaaaacgagtgtgaaagtttttattggaaggagcacttgtatagattgttgtattgaagtataataatttatggattaaaagaaattattaaataactctatgtaaaagccatgaaacaccatgtaaactgcaaatgcaactaaaaattgcggaatagttggtggaagcaaccatgagttttcgatagaatatgtacagaaaagcaaatgaaacgatgtttttcacaaaaagcaaattgaaaggagaataaatgaatacgactagatttttaactgtaacagttgctctgctatattgttttttttggatagcagttgcgggagcagccgtttatctttttgtgttggttgtcagagcactgaaaaaatatatcaatacaaaagaaataagagaagaaaagaaatcaatacgaaaatctttgggagaagtgctaaaggaaaacagacttcgctgtaaaatgacgcaggaatttgtatcagaaacattaggagttagcagacaggcagtttctaaatgggaaaatggagtttcccaaacaaaaggatattaagaaataacctgtgtttacctgcttgcaaattattgtatttggataaacgagaaaaaaactttttattgacagatataatatcagatattataattgtctgtaattgaataactatcttcagggcagggtgtaattccctaccggtggtatagcccacgagccgaaaggcatgatttggtgtaattccaaagccgacagtatagtctggatgaaagaagataaaagtaagtttatgcttttttgcgtgctctggaatgattttatattgtttcagagcattttctttaatcgcataaatcctcttttgcatgtcttggatagattttattcaaggtatgtatttttttggaggtgtaaaaatgagcgatatagaatacatgaaaatagcaatagaactggcaaaaaagggtgctggctatgtcaatcctaatcctatggttggagcagtaattgtaaaaaataatcggcttataggacagggataccatgaagtttttggtggattacatgcagagagaaatgcactaaaaaattgcagagagtcacctgtaggagcaacgctttatgtaacacttgaaccatgctgtcactatggtaagacaccaccttgcacagaaacaattattaaaagtggtattacaagggtagtcgtcggaactttagactgtaatccgattgtgtctggaaaaggtgtaaagcaacttgaggaaaataacattcaagttgatgtaggcattttagaaatagaatgtcaacagttaatcaaagtatttaggaagtatattacaaagcgtattccgtatgtttttatgaaatatgcaatgacaatggacgggaaaatagcaacttatacaaatcaatcaaaatggataagtggcgaaaaagcgagaaaacaagtgcaccaattcagacataaggttactgcaatcatggtaggagtaaatactgttattcaagataaccctttactgacatgccgattagaaaacgggaaaaatcctattcgtatcgtatgtgatacagatttaagaacacccattacatcaaaaattatccaaacagcgaatgacattaaaacatatatcgctacttcttctattgatgaaagtaaaattgctctttacagaaaatgtggttgtgaaattatttatacgaagaaaaaaggtaatcatattgacttaatgaatttaatgcaatgtttaggaaatatgcagatagacagtctgcttttagagggtggaagtgcgttgaattggagtgctcttgagcaacagattgttgatgaggtgcaaatttatatagcacctaaaatatttggtgggagtgcaaaaagccctgtaagtggtcaaggtgttgcttttcctaatgacgccattatgcttaaaccatatgctttttctcaagtgggaaatgattatttcatagaaagcgaagtgatttatccatgtttacaggaataatagaagaaatcggtaaagtagaaagaatacagaaagatacttgtaactgtaaactatccattaaagcttcaaaaatattagaggatatacatttaggcgacagcatagcagtcaatggtatctgccttacagttacttgtttcactcgacaatcttttacagttgatgtgatgaatgaaacatggaacagaacggctcttagcctgttaagacatggaagccttgtgaatttagaaagagctatgcctatgaatggcaggttgggcggtcacattgttacggggcatattgatgggacaggtagaatatcgtctgtgcgtagagacaaaaatgcggtgtggtatcaaatcaatacgcaaagagaaatcttaaatctaattgttgaaaaaggttcgattgctattgacggtattagtcttactgtcgcaaaagtatcgaaagcagatttttcggtatccgttatccctcatactttggagcaaacaattctcaagaataaacaagtcggggatatggtaaaccttgaaaatgatatattagggaaatatgtgcagaaactcatagacaacagcaatgaaacagagttgtcgaaagagttgttatgccgatacggattttagcagaaaggataaaggaattatgaaatatcaaaaaataaaagaggcattgcaggcgttacaagagggaaaacttgttttggttatggacgataaagagagagaaaatgagggggatttaatttgttcggcacaatttgcgacaacagaaaatgttaattttatggcgacttatgcaaaaggcttaatctgtatgcctatgagtgaaagtctggctaacaggcttatgctttcccctatggttgaaaataatacagataaccatgaaactgcttttacagtttctattgattataaggatactacaacaggtatttctgccgaagaaagaggattaacggctcgtatgtgtgtgactgagaatgtaaatccctttgactttcgtagaccggggcacatgtttcctctgattgcaaagaacggaggtgttttagaaagaaacggacatacggaagcaacgattgacttattgaggttggcaggattaaaagaatgtggcttatgttgcgaaattatgaatgaaaacgggaaaatgatgagaacatctgatttaattcaattttcccaaatacaccatataccaaccctcacaattaaagaattacaggaatacagaaaagtatatgacatgcttgtagaatgtgtttcagttgtagaaatgcctacaaaatatgggaatttcaaagcacattgttatatcaataaattgaatggagaacatcatgttgcattggttatgggagatttgaataatggaaacgatgtgctatgtcgtgtccactcagagtgcttaacaggagatgtctttggctctttacgctgtgattgtggacagcagttagataaagcaatgaaaatgattgcagaaaatggttctggtgtattgctttatatgcgacaagagggacgaggtatcgggcttgtcaataaactaaaagcctatcatttacaggataacggtatggatacacttgacgccaaccttgcattaggatttcaaggcgatttaagagaatattatatcggtgcacagattttaagagatttgggaataaaatcattgcatttacttacaaataatcctgataaagtttatcagttagaagattatggaatgaaaatttcaagcagagtaccgattgaaatagaagcaaatccttatgatagtttttatctaaagacaaagaaagaccgaatgggacacattttgaatatggaggaaaaataaatgaacacttttgaaggaaatttagtagcagaaaatataaaaatcggtattgttgtagcaagatttaatgagtttataacttctaagctattagcaggtgcattagataatttgaaaagagaaaatgttggtgaaaaggacatagaggtagcttgggttccgggagcatttgaaatacctttgatagcgtctaaaatggcaaaaagtaaaaaatatgatgcgattatttgtttgggagcagttattcgaggtagtacaagccattatgattatgtgtgtagtgaggtatcaaaaggaattgctcaaatcagtttaaatactgaaacaccagttatgtttggtgttcttacgacagatacgattgaacaggcgatagaacgagctggcagtaaggcaggaaataaaggctctgaatgtgcacagggagctattgaaatggtaaatctaattcgtgcattagaggtataatatgcttggggttaaaagctaaagcgaaaaaacataacaggcggagtgatccagacacgacggtgggaaaatctcttagatttttccgccgtttttagtggctggttcacttcggcagttgagcgagcttgcgagcgaacagtaagcccccgttatctaacaaggggggcacaaaaaacaagagacaatagacactactaagcggaaaacgctgtatttataaggcaaaaccgcattttacatggtgtgatataaattatgccattatcactaagaaaaattgaataagacataggaaagacagttgatttcaaataagaaattgattgtctttttcttttgcagaaatttaagtataggcaattatcaaatatggtagttgcctttttgattggaggaattgaagaatgaatgataaatactttatagaagaattaagacaaaagcgtgaacaatacggagtaacacagacaagacttgctgttgcctgtggtatcagtcgtgagtattataaccgcattgaaaaagggaaatttccattgacggaagaattgaaagaaacattagaaaaacagattgagcgtttcaatccacaagaaccattattcttattgattgattactttcgtgtccgctttcctactacggacgcattaaagattattcgtgatgtgttgcaattaaaatctgattatatgctttatgaagattttggcaagtacggatatgaaagcaaatatgttttaggcgacatcaacatcatgtgttccatgcaagagcatttaggtgttttattagaactaaaaggcagagggtgtcggcaaatggaaagttatctattggcacaggaacgctcatggtatgactttatgcttgattgtttaacggcaggtggtaagatgaaacggcttgacttggcaatcaatgataaagcaggaatattagatattccaaaattaaaggaaaaatacaaggcaggcgaatgtatctcctacttccgtatgcagaaagattacagcggtacggaaaaatgtggtagcgatttaccaaagaatacaggagaaaccttatatctcggttcaaccagtagtgaattatatatgtgtgcttatcagaaaaattatgagcagtatgtcaagaatggcatagaagttgaagatacggagattaagaaccgctttgaaatacgcatgaagaatgaacgagcctattatgcagttgtagatttattgacctatcgggacgctgaacgcaccgctttttctatcatcaatcattatgtccgctttgtagatagagaagatgataaacccaaaaatcaatggaaaacaaatgatgattgggcatggtttgtaggggaaaatagagagccgatacgattaactacaaatccagaaccttatactttacaaaaagcgttgcattggttacaaagacaggttgcaccaaccataaaaatggtacaagcattagacagagaaaatcatacaacgatactgaaagatatgattgagcaggcagaactcaaagataagcataaacacttattacaattagaaaaatcaaccatagaagaacgcatagataccgctgtcccacaagagaatgacggtattttttaatttcttcaaaatatctgcaacaaaacatcaacttgtgtacagatatggtacgagaaaaggaaatctaactttttttgaaaataggtcatcaaatcaaggtttccattccctatatggagtgaaagaagaaaagttttgaaaaaatgtcggaaattcaagatgagtggacagtgttatgtgaaagaagaaaaagtatcttcaatttgtattcaaacaggtattagcagttgagtgttgatgtgaaaagaagaaaatattttcattctcaacttaacatttggtagttgtcgttccctatatggagcaaagaaaatctttcatttcatagttggcagtaacggtattgcataggtagttagggtgtgaaaagaaatcttttcatcatcaacttagcagaatgacaatttctttccctatatggtacaagaaaagaaaaaagttttgaatattggttacgcttttactcttttccaacgcgatatataggaaagatgattttcttctttcaatcgctctttgacaactgaataaagcaattcaatacctttgacagacagcgagccattgaaacagatacgccatgacctttctcctgcaaaagtgagcgacaacctatctgtgttcttgtaaaagatttgtcctcttttatcgccatgacctgtgctgtcagataatgatactcccgtacagccacagcttgagcgttaaaagcgtcgcacgcaatgggtacggctacataagaactatgcagaggtggaagtcctgtgggctatgacaaaagccgttgaattgcttagaaagattttacagaaagggggtatgtgttattgataatgctgtaaaaacaattcaaaagaaaaataacaagtgtggcattggcaacagaggaaagacaaagattgttgtaaaagagcatttctccgaaaagggaaagacaatggaagaacttctaactgatgtcatgttggaaaaagcaaagcagacaatcgcataaaatcggtgcagttgtaagaaatagattgaatgacaaaaagtacccgtgttatactttacttgcaagcaggtattgtaaacgcgggttagttataaaggaggataactgacaatgaaacaacagatttacaatactgcactttatcttaggttaagccgagatgatgaattacagggcgaaagttccagcattaccacacaaagaagtatgttgcgtctatatgcaaaagaacatcatttgaatgtgattgatgaatatattgatgacggctggtcgggaacaaattttgaaagaccgagttttcaaagaatgattgaggatatagaggcaggaaaaatcaactgtgttgtaacaaaagacttatcacgacttggtagaaattatattatgacaggacaatatacagaattgtattttcccagccataatgtccgttacatagcgattgacgacggtgtggacagcgaaaaaggcgaaagtgagattgcaccatttaagaacatcatcaatgaatgggtggcaagagatacgagccgtaaagtgaaatcagcctttaagacgaaatttgcagagggtgcgtattatggggcttatgctccgttaggatataagaaacaccccgacatcaaagggaaactgttggttgatgaggaaacaaaatggattgttgaaaaaatcttctctctagcctatcaaggttacggtagtgccaaaatcacaaaaatactgcgagaagaaaaagtcccgacagcgtcttggttgaattttacaaggtacggtacttttgctcatatctttgagggaaagcccgaaagcaagcgttatgagtggacgattgctcatgtaaaggcgatattgaaaagtgaagtctatatcggaaacagcgttcataatagacaatcaaccgtttctttcaaaagcaagaagaaagtacgaaagcccgaaagcgaatggtttcgagtagaaaacacgcatgaaccgattattgacaaggaagtgttctatcgtgtgcaggagcagataaaatcaaggcgtagacagacaaaggaaaaggcaacgccgatatttgcagggcttgtcaagtgtgcggattgtggctggtctatgaggtttgcgacaaataaggcgaataaaacaccatatagttattattcttgtagtttctacggacagtttggcaaaggttattgttctatgcactatatccgctatgatgtgctgtatcaagctgtattggaacgcttgcagtattgggctaaggcagtacagcaggacgaagaaaaggtattgaacaaaatacagaaagtcggcaatgcagagcgaatacgggaaaagaagaaaaaggcgagtgccttgaagaaagccgagaaccgacaaaatgagattgaccgtttatttgcgaaaatgtatgaagatagagcctgtgagaagataacagaacgaaacttcattatgctgtcggggaaatatcaaaaggaacagatagaattagaacagcagataaccaacctaagagaagaattaagtaaaatggaacaggatatgataggtgctgaaaagtggattgagttaatcaaggagtattccgtaccaaaggaactgacagcaccgttattaaatgcaatgatagaaaaaatccttattcatgaggcaacaacgaatgaggagaacgaaagaatacaggaaatagagatatactaccgatttattggaaaagtagactgataaatagggttcatatctttaactaagggaaagcggaacatctgatccaagcacctcaaacttgattgctattgcagaattatatggcgtatcttctgaggaactattaagaagtacaaatgctggttgccaaaaaaattccaaagaaaaaaagtaagaacaatataaaaatgtataaacaggagaaaggtaaagatgattacattatcaaaaatatataagaattatgataatcttaaagttttgaaggatgtcaatcttcatgtagcaaaaggggagatttatggtttgattgggaaaaatggtgccgggaagacaacgatttttaaaattattttaggattaactgaatttgaaagcggaacgctgtgtattgccggcagtaagaaaaaaacagaattgccgcagaaacgtaaaaaaataggtttttttataggaaataatttctatgattacctgacagcagaagaaaatttgcactattacaggcagttgaaagatattaaagacaaagaagaagtaaaacgtgttttaaatcttgtgggattggaaggcgtaacgtctaaatacggttctttttctatgggaatgaagcaaagactgggaattgcaaatgctctgctcggaagccctgaaattctgctgttagatgaacctattaatggtcttgaccctcaaggtattgctgatataaggactcttattgtaagcttgaataggaagcaaaatatgacgattattgtttcttctcacattctcggtgaattggaacataccgcaaataaatttgggtttgttcatcagggaactgtgttaaaggaaattacacatgatgatttgaaagtaaaaagaagcgcggttcaaatttatgtaggagatttggaaaaggcacgttctgttttaaaacaaaacaacattcctgttttgcaggaatcctcggcttataaatctttggaagattattattttgatttggtaggaggaaaaagatgtgagtaattatgttttagcggatattaaacgtatttgtcataaaaaatcgtttcttaggacaatcggaatatatattgggttgttttgtataatgatgtttatatattttaatcctacatatacggcggatgcttatgttgcaaaaacgacaatatttttaggtttttttcctctctttgttggtttgactgtatttctttctgtgttttatgatgatttcaaaagtaaatccattcaggtggcgattggatatggacttcaacgacataaagttgttctgtcaaaggtcattgaaagtattttgttgatttttgcgtctatcttctgtattggtattttaacattattagctcctgtggtattgggacttgctttgaatcaggcgcaggtcatagagcttattcttagcgtgatagttgaagcattacgagctgtgggatatatatgtatttcagcgataccggttttttatacacaaaatgcagtgaacggcacaatagtatacgttctgctttcatcaagaactgtaatgcttcttgccactatgattttaggacaagaattatttgtaaatatgattggagatatgacaaagtatttttatacatctcagctatatagcattcgcagcgcctttttgcagaatggaacatgggacatatcgacgatgtgtgcagcattgagtgtctatgtggtgttacctgtcgtaatatcggtattcagttttgagaaaaaagaattgaaattttaggaggaaagctgaaatgaaaaaaataataactatcatagttactattgttatagttatgtgcggggcgtttatggttaaaggctattataatgaccgttatgtagcatcggatagtttttatacacagattccgttagatgaagtaaatgaagattcatggcttgtcaataaggacggagtaaatcaggaaaagggaaaagaatataatcttattgggtataaccagaatggagaaaggaaagaactatcgtttaagaaaaaaggaaatgccgaagattattatgagccgggaacttacattaaggtaaatacaagcaaaactttagttgtaggagtagaaattatcattgaaagcgacataccaaaagaagctttaaacaaaataatttctttaggagttaaggaacaaagaaatcaataagatttataataatattattgaaacatgaacaaaaaaatattacaagaacgattagtctttcaattatgtttcacaaaaaattaaaggctataataaaggtgaatattaatactatagggttgattttttgaaaagagtggtatttgataaaatcaggtgtataatggatttggcagtataatatgggtttgcagaaattgttataggacagttccataaagttatcacagcaggaatgtcagctaaagtgaatggaactcgccatttgcagacagtagttgtgaagcatattcattagactggtgattcaaaaaattaaaaaccgagtgttcttacagaacttttcaagtcctgtaagaacactcggtatggtcggagtgactggattcgaaccagcggccacctgaaccccattcaggtactctaccaaactgagccacaccccgttatcttgttatatgtatctgcaacaataatgaattatagcatatattgaaattaaaatcaatactttttcaggaaattttttgtgtttttatcataaaaatatccgaacacgctgtgatgatgttcggatattttcgaatataagttagcttaaaaattgtcgctcagcccggcaaccaaatcctgcatttcatgttttgtctgaacacagcgggctttgtttattacgctgtgtctttccgcgtcagtcatttttgcaaaatgctcaagagctccggtgttctgtgcaagcgccatgctcagaccaacaggaatattgttataatccagcattttttttgctccttcctcattgttattcatattatcacctatacttattattgacaatataatatttgttatacacttgtgataagaaatattttccaaactaattttatctatttactgttgataatatatattctaatcaagcaaatgtgaaagagcggcaattccttcttctatctcgttgtttgtaagttctccataaccgaatatgaatgttttatccgggagtttgtcagactgtttaaaaaggaaggctgaaagcggcattatttttactccggccttatatgctgattttttgagttcctgttctgttttttcagttttaaaagttactaaaaggtgcgttccgccgttgtctccatgtattgttaaccggtttgcgaatggaagattgtttagggcggatatcaaaatatcttgtttttctttgtatatctttcttaaggaattaacatatttgatagcgtgtccgtctttaataagctccgctacagcaaattgttctgcccgtgaggcaaggcaattataaaacggaagtttaaggctccatttttctatcagcggttttggcataactaaataggcaatttttattccaggggcgaggctgcgggaaaaatcacccatgagaattactctctcggaatcatccatagtgaataaagatctaggcgcgtttttttggtatataaagcttccgtcataatcgtcttcaactatataatggttgcccatctttgcccagtcaagaatttcacggcgtctatcctcactgataatctggccgaccggaaactgatgattaggcataaaatacagcacgtcaatatcactgtttaataaattttttatatcgaatccattaaaccctatatttattaatcttatttccgaaacgctgtcttgaatactgctgaaagagcggcggtagcacggattttccaatccccaaactgtatcttttccgagaacgcggcaaagacatgtaagaatgtaatcaattcccgcgcctataataatttgattttcgtcgcattttatacctctgaccgcatacaaatactttgcaaccgcttgtcttaaacatgggtctccgggcttttctccgtgagaaaataagtccggctggtcgtatatggcgttgcggtaaatcctggcgagagattttttcggaattttggagagttcaagaccgttttggctgaatatatattttgcatcgctctgcgtctcccaatcgagatgaacggagtcttgaaaaagattataatcaggattaacataaaatccgcttgaggccttggggacaatataaccttcactttcgagaagctgatatgcgccgagcacggtatttgtgcttatgttaagcttctgcgctaatttacggcgtgacggaagccgttctccgccggtaatttttccggagataataccgtcttttatatggttatagagctgcttataaagaggaagttttgcatttgggtcagcgtagaattcaaggttatccataatttgcctccaaaacaatgatttatcctgcttttttatttaagtttttttacaaaaatataactaatagtattatactaaattggtaccaaaaaatcaacattaaagcggttctataaaataaattattttcgaggtataatatgtttacctaataaataggaggaaaagaaaatgagaaaagtctggaaaagattgttaagttttgcggtgggcgttagtttaaccgctgcagctttcggcggtgtggttctgtcgcagtcctcagatgtttcggcggcaaagaactttgaccctgaaactgtaatgtggacaaataatatggttgaaaatgtggatgaaaattactcaagcatggatccaaactggagcaataaggacaagagcgaagttcaaagtccatatgcgaaaccgggtgaaaagttagataagtggtcatatgctgaattcctatggactcacgcatatcctataggcaacggcagaatgggcggtatggtagccggagctatcgacaaagaaatcattcaaatcaatgaggataccatttggagcggttctccctatgcggatttgcagaatgagaatggcgaaattgtatcgaacaattcaaacacggatactactgctatcgctaatgcagagcatatttcggcagttaaccagacaagcggcagcaaagagggcggctggagatatttccgcggcgctgacgtaaacggaaatccggcagaaataggttcggctgacgctgttgttggagatgaaacatttagaactaacttcccggcgtttgccaataagagtatctcaaatcaggctttaaacaatgataactctgctacgaacgaagcggttcaaaacagatacagtatggagcgcatggtggaatcaacattcctgggaaatccaaaatcacagaaagttttcaagtcgtttgttgaagtatatcttgactttaatcaaagtcataatgacgtaactaattatacaaaggctttggatatggaaaccggtaccgttactgttgactatgattataacggcaatcactttacaagagaaagctttgccagctatcctgaccaaacagtggctacgcatatcgaatcagacggcgaccttaattttgacgctgctttccatacataccataatcaagacgcgtcagcctataagtttgaaaaagtaagcgataatgaacttaagcttaccgcgcgcgttacagacggaggaaagagcaatgagccgggcggtcctaacgttatacgttttgaagctcacatgatagtggacagcgagccgggagcggttttaacagtttctgatgataatacaacaatcaatataagcggcggaaagacagctacaatctatgttgtcggagcttcgaattatgtggactatctgaatgttgacaacgctaagccagcaaacgactgtgcggtttacgtaagcaacgttaaatcaaaagattatcagacaataaagagcagacaccttgaagatttcagtgggcagtttacccgcacatctttatctcttgcaaataaagaaggcgttaataattctaatgttcctacagagaagagaatcagaaaagatgtaaacggtgacagcggttataaagtaggagcagacagctcactttcaaaggctaatgcaaacggcgtatacagcgcttatggagacggtgataaccagctggcagcactggagttcaattatggaaagtatctgctcatatcgggttcgagaccgggacgtgatggtaatgccgcaaccggagatattccaatacaaataagtcagcctctgacccttgcgggaaaatggaacgcaagcagaagcgcttcgtggggcggaaagtatactataaatattaatactgaaatgaactattggccggcacagccgctcaatttggctgaaaatgaaaagccgctgatagaaacttttgcctcattggcgcagggcggttctataactgccgcaaaccagtacggtatatataacgaccgaggcgatgacacatatcagccgggagacccatgggtaatgcaccataactatgacttgtggcgcggtactatgcctatagacaacgcaacagcaggcttatggcctaccggtggagtatggctgcttgaccatgcttggcagtattatcagtataatttggataccgagtatttggcagaagtttatccatatattaagggtgctgcatcattctttacaaagtacttggttaaagaccctgtaaccggatatttaattacagcggcgtcatgctcgcctgaacagggcggagttcagccgggaccggcaatggatacacagttggttagaaacctttacgacactgttcaaaaagcggctaaagttttgggcaaagagacagaagacgctgatttgctggctaagatagcagaacagatgccgtcaagttatttggcagatgagccgggtaaggttgcgccgaatcttattgacgaaaaaggccttattaaagagtgggcacgcggagatgttgcttttgacttctcgacggttgctgatggaagcggaaaatataagaatataattaacccgtttacaggtgcgtcaacaagcataaatgagcatattgcaaacaataataacggacacagacattgttcacagctttgggagatgttcccgggcaagcatttgagcgcttacagcgaaaatgaaagcgagcaggatatatttaaggcatatcagagttctgtcagcggacgcggagccggcagcggtcagggctggggtgtcgcatggagaatcaatttaaatgcgcgtgcgcttaacggcgaatttgcatcgacattgcttaatcagttgtttacaacccgtacatcaccaaacttatttgaccagcatcctaacttccaaatagacggaaactatggtgcggcaagcggtataacagagatggttatgcagagccatgatggttcaatcaacctcattccggcaataccttcagattggcaggcaggaagctttaaggggcttaaagcactcggcggagctacagttgatctgacttggagtgaaggcaaacctgttgaagcaaaggttactgcagcaacagacggagagttaaaagtccgcaataagtacatgggaacagctgttataaaggacggcgaaggtaacgtagtgaccggaacacttaatcaggacgagactttgctttcatttaacgcgtcagctggtaagacttatacaattgacaacttcggcgagaccgaaaaggaatatatagaagcgacatgggatagtttagctacggatactaaagggttctttaattctgtcaacgattcacaattgcctaggatagagaaaaacggcaatgtgggatttatatataacacatattatcccgctcacggcggagtagcaggtgaagttggatattattatccggactgtactatggatagacttaagagtctttcgcttgaattggatacccgtgctaagactgacggatatgtttctataagactggattcgaaggacggtcctgaaatcgcacatagtatggttacagcaaccgggtacagcgcgcaggatttgggcaagattactgttcctgaaggcgtgacaggaaaacacgacctttatgctgtattttatacagaaggaaatgttaaagataagtgggtagcgaatgtaaagactttgcacggagtatatgaggttaaaaatccgaattataatcctgacccggatgcaagcgcaacaccggatgttgctccgagcgcaacgccatctgcagacagcggattagaagtaactgaagcggaaggaaattacacagccgccgtaagttcgaatgtgtttgacggacgcgcaaatgcgacagttatatttgcgctttataacgatgaaggcgtattgattgacataaagagtgcaggtgtgacgccggagacaaacacggcggtatatgctcctgcggcgaacggaaatctgaaagttatggtatgggatgatgtaactaatatgacgccgttagtgggtactccatatgaagctaaggtatccgtttaagctaaggacgaattttaataaaattctagattaaaagtaaaaagcccgccggttttatataaaaatcggcgggcttatgtattaatgtttaatataatgttttataataaccaagattaatagtttattattataaattatatatttactatgtatatgaccccatataaaaaattttattattacataataatggtgtttgaaccatttctttttctcgcaagaaaaagaaacgcttcaccaaagaaaaagtgcttgctcgcttaggtcgcctgcggctccaaggggcgctcgcccccgctaatttcttttgcgctctgcgcacaaaagaaaaagctctgtaactttcccgttgactttgtaagctgccgtgaaaatagatattccgagttcctattttatttaactgttcaaaaaagttggtcttcggcgaacatcggtagggcaaacgtagtttgccgcgttaggtgagctatcatctgaacacgtagtgttcattatattagttatatattattcctttaacgtggatttttttcattagttcgattcaatatgtaatcggttgaggtatgataaaaatctgcaagttttactaaaaagtgtaatggtatagtttgaaagcctcgttcatatcgtgaatatacagtttgttgtattcctaaaatatcagcaatatctgtttgttttaatcctgaacttaaacgcaaagttcttaatctttttaaatacattttaccacttcatttattaatcttctgcttttttctctttttcatcattattaaaataggaagagggcaaattaaggtttagcaaatcaccaggtttaacctctaaaatatcggcgatattaaagaatacttctaatgaaaaagaggaagtaatattaggagcctcaatagagctaagatgagaacggctaatatgagctttttcggcgagttcatattgcgtgtaacctttaacttttcttaaagcagaaatcatcaatcccaattcaacgaaacggtctctgttttcaaaacctacttcttttttcatatatttatcccccaagatatttcttataatatataataacatatctgtatttatttgttagcttttatctgatattaagataaaattatttcaccgacacatatggaacaaaatataaaacattgccgatatatgtaataaaagagacatcaaaataataaaaaccacagctaaaactgtggttttactttgttaccttattaatctagttatttcttatatttatatttaagacataatttcaaattttatattttcatcttcatcttctaatcttttgaatatatcaaatatcttactcatatactcatcaaaatcttttggcagagtattaacacctttcacataaatgactgtgtcaggaggacaatattcccataagctatcccatagcgcagacagattatttccataaaaatcaggaaatccaaaagtatcttttataatcaaatgtaattttaatggtgacttgcacccggtaaaatctaatgttatctgattcataatttttcatttcctttttgttatcgctatctaaaaaagtaaggattttagtttaacaaattatattagatatatttgtatatatagaaatgtatatttgtcatgaattagaattaagtaatctatccattatttccccggcttcttttattctgtcttctattacgtttctgcatcttttcaatccttcatgtgtaagcgtgattgaatagaaatgctgaagattcaaaatctcaaggttaatattgctgttattttttgggtatgggaaaaataaaaaatagttgacttgattatagtatttctgcataagactgattaattcattaaaatttaaatttcccataattataagagtacgaaaatcttcaaaaagaagtgagtttctgtcaacaacttctacattgaatttgtcaatattaaaaacattttctgatgctgtaataaagtgaattacattcatacgaagcggtgtaatataaattccttttctagtaaatcgatgcctaactttttcccatagcggatttaaaaattttgattcgttatgtaatgagttattatagatatagtcatattctagtatttctaattctttttttcttaataaagaaattagcgtatttattcccaaataattttcatcattattatagtaatcaaaaaaatatctgttgaacctggttgaattagcaaaatttttatcgaaatattccattaaatcacctttagtttcaaacaaggataaatcaatcttgttcatcttaaactcctttgtatatcggtataattggaatactattttaaatcatatttttaattattcattgtaaggcgaaataatataattctgtgttttaccgatttaaaaataatttgcggaaaatacaattatgcaatatctggtatataaactttgtacttatgcatggtgatattgtttaacaaatgctttaatttgttttattaacaataagtacaccggttataccttcatgcctatagctgaatatattgcctcctatatgaacaatactgttcggctcatattttagtattaactcagaatcttcgttatataattctccgttctcaccataaaaaactgattcacagctggaagatattattttatcacggttttcgccttgacaaataaaatagtcgtcgttttcaataattttatcccaccactcatttaacgtaagatatccataacgatgtataatattccaacccccgttgtaaaatactttggcataaccgaatttgttaaaatcatatcctccatttgtaaatggagttgtatctgttaaagctgtatccaaccacggctctatcacaaattcgcctgaagtattaatatatccccattttccgtccgcttgaactgcagacaagccgttattgaaataggtataatgagggaattttacccatcctttttgaccgtggaatgcgctataataatattctggagtaatatttaaatatcgtgcagtaatttcacctgaagtatttataataccataacgttctccgatacctggaacgtcttcttttataaacgcataaccttcatgaaaatcctgtatctctgagaacaaacattcagtaatcagagttccgtttatatctgtcaatccccaaaggcctccaacgttgactggaataacgttgttttcaattaaacatttgaaattataatcattttttatctcgtcatattctataggtatcacaatgtctccacttttgttaatgattccaaacttctcatcttttcgaaccagcgaaagtccattttgaaaacaagcataccatgaacaataatagctattattgtataaatcaaaatcgtattcaaaattgataactgtttctccgtaagtgtttatgaatccccatttgccatcttttttgacggcagagagaccttcggaaaaaaattctgccttatcatatataagaggaacagcaacttttccgtatagatcaatataccccaatttgtcgtctttgcgaaccagcataagattatttccatcagaacccaaagctccgtcgttgttaggataaatataatcatatatgtctgaaaacaatgctttcccattttcatctatattgcagaattgatataaatagcttaatcttatatcggggtttggatattttattataaaaccttctctatcttgattcttagtaatctcattactcccaaaaggcactattgtatttccatttgtatcaaccaaactatactgcttttcagaattcttttcctgaacaatgatattcattcctataccatttttgtcactgcaacactcatcgtacgaattatattgaaatggtgtaatcacattaccggagatgtcaatctttccccatttttcaactccgtcaattattttacttgcgggaattgtttcatcaacaagaatagatgaggatatacaattatattcgaaaggaatgagtacattagacgctttatcaatggcgcccatatattcaccttggcgcacaagtgcaagtccatttttgaaatcatacgcacgatcatattgagcaggcaatatttctccgttggtttcatttatatatccgtattttccgttttgtaaataagcaatcattccatcagaagaacgtatcaagctgttatcaatctgttcgattaaaggacaaattgaatattccggggaatagttatccgcggcaatagcatataaatgaaaagaaaatgataatataaagattaatgcaatggataatatttttttcatggtttcatccccattagttaatataaatttattataacatgaaatttacatatatacaacttttttgaataaatttagatgaatatttaacaaataagttaaaattacaaattgatatataataaaaaatactttagtgaatagaatacagcgcagaggactactattatgaacatgagattcttatcaaaagcaatcataaaaaaattgtcggtttgtacttaattaagtttctaattcctgaaaattaaagtccttctttcttaaatttcggtattaataaaataaattattttttcgcatacatatatttaaagatgatacactattgataattaaatctatttgtgttattatactaatatcaaagtaaaatttattaattgttttaaaatatttttacatagagaggatttgtgttgcaaaatggataaattaaaattacagtcattattagatgagtatattaagaataaaaaaattaatgcttcgtactataatgaaaattggtctgagcgtaaagagcgaaagaacttttatcagtcatacacaaaagaaaaacttttacaaatgacagaggatgaatttttcgaatatataagcaaactttggtctatgcttatttggggtaataaaaaatatgttgtggataagctaattgaagataatggttttaaaaccttaaaaaaagagttagcagagcttttatttggttctgcaaaaattgaagtaagatgggattcgtttttaaagtctataaaaggattaggacccgcgacgataagcgaattacttacatatatcaatccagatgagtatataattttcaataaaactactatactttgtttttcttatcttggtatacctgatatgccgaaatataactatcagtatactggaaaaaaatatgcggaagtatgtaaaattgcaaaggatattgctagaattttaaaagaatccggtgcagaagattatgaccttttggctgttgattattttatgtgggatgaaattcttccacttgctgaacagaaagaggtgaaaaatgactccatttcagttaaaccaagccctgtaagtgataatgattataaatctctgcatgatgagattaaggaaaaattagttgctatcggcgaacttcttggatttgaaagccgttcagaggtaaagattgctaccggtgcgattgttgatgtggtatgggaagctaaaattggcaatatgggtaaagctatctatgtttttgaagtgcaatccaaaggttctattgatagtttaatattgaacttaaaaaaagcacaaagtaacgcggctgtacaggcagttgttgctgtcgcagatgagacacagcttagtaaaattataaacgaaagcagtgaagtaattgatgaaaaatcattgcgcacttgggattcagaagatgtcttagccgtatatgattcgcttgtaagagcccatgagtcaatcaataagcttgcacttgttccggaaagtttttaacttgatatattttaaaatattaaaaaaatggtattatattacgtagaaagtatacttgggtaagtaatagctttaaacaaataaaaaaggaacatggcggcgttagagatgtgttgttactctcctttttgatattttgctctgataaattaaaaatccaaacccgttttaattgggtttggattttttacttggtggaggtgaggggaattgaacccctgtccaaagaagtatcctcaagaggcactacgagcgtagtcaatggttaaaattccctcactgtgcagtccattgacaaactgcatagctcggtagcttcattaattcatggccgggtcaaagctttcccggctcacgttcaccgcatcattgatgccctaacctgagtctgcggtaaactcaggcggacaagctgcaactaggcagctaaagctacgttattatttttagcgtttaattttaaagttgggcttttaacgtggcgcccgccacggctcgctcctcaggcctctacgaccctgtcgaaaccattacacccccatgtgtaaatattataactggctgtttatccagtttattgaaagctccatccatccggttacgccgggtacaaaatgcttttcctcgcatccggtcagcttattgccgagcgacagtccgtgttttccctttgggtatatatgaagttcgtattctactccgtgttccagcagagcggacgcgaaccgcatcgaactgtatacaggcaccgaactatcctcaaatgtgtgccatataaaacttttaggcgtgtttgaggttacgtgcttgtccaaaccaaaatattcaagcttttcaggtttgccctccgtaaatctttgcttggtgccgtcgtgcgtttttccgtcgtcttctattataaccggatagcacaaaatcaaaccgttcggtttgttttcttctcctgtcgcttccgaacctttctgtatcataggcaagtcccaatatactcccagtgaagcggcgagatgaccgccggcggaaaacccgcatacaaaaattttgtccgggtctataaaatattcatcagctatagcccttacggtcttgacggcttttgaaagctcgcatgtaggagcaggccagcctgtaggctctattgagtaatcgagaaggaatccatgaaatccggcggcgcagtatttaagcacaatcgtctccgcctctctgcttgaccttgagcggtatccgccgccggcgcatacaataacagccgggcgtttgttccatagggtttttgaaacaagctcaggttcaagaatatatgaggttagttttgccgtttcattaggttggtttgaagatagtccagcataatccaccgacatatcaaaacttttgataatcattggtcttcctccatagaatcaatacaactatttgcagagctcagccacaatttggtttattaatttgccgtctgctttgccttttaactcgcccattaccgatttcataatcaagcccttgttgccggaagccagtacgtctgagaatttttcgtttataattgtctttatttcgtcagcggacaactgttttggagcgaattcactgattatatttactttctcattatattcagccagcagctcggttctgtcctcaggacatgtctccacttgctccttggcggttttaagctcctttaaaataacagtttcaaccattgattccggaatatcgtcccggcatccctcgtcaatagcaacctttttaacggcggcaattagcccggagattgtgtcttttctgttcttctcctttgccttcattgcggcaatcatttcggtttgtaagtcttttatagtcatgatatatctcctaactccgcggttttatccatggttataattcttaatggcgcggtctatgtttcttttagcgtcacgctttgccatagcatcacgcttatcgtaattctttttacctctgcacagacctattgaaactttaacaagctgttttttaaaatatactctcagaggtataagcgtgtagccctgctgctgggttaaaccgataagacggtttatctcacgcttgtgcagaagcagtctgcgcgctctttcggggtctttgttaaatatatttccgtgctcgtatgggcttatatgtgtgcctatcaatatggcttcgcctgttttgagtgaaacatagctgtcttttaagttaatctttccggcgcgcaccgatttgacttcggttcccaaaagttcaattccggcctcgaattcttcatctacaaagtaatcatgaaaagcttttttgttttgcgctattactctgtccgccggttttttgtcagccatattctcacctcttttggattttaactgtgtaaaaaaattttgttctgaaacaattcaaacaaaaaatcttatctgtttagcttgtacattatacttttatttttatcaaaagtcaagtgtattgtcacagtaatttgatgaaaaatccgcctaatttcggcagtttttaaatatgtttacaaatctctcacccttgactttcaatacaatacgtgttaaaatatacattaaattattattgggcaaatttacccaaatttatcttgtttagtaattcagcggaggatctttatgtttttatccgataagtggaaagattatgaacttttggacgcgtctgacggcgaaaagctggagcgctggggagatgttattctgctaagacccgaccctcaaatagtttggacagtgagcgaggcggacaagtcaaagttatggagagcggcggacgccaggtatgaccgaagccataccggaggcggcagctggaagacttttaaaaaactgccgaagtcctggactataggttaccgtgaactcaaattcggaataaagcctatgggatttaaacatacggggctttttccggaacaggctgcaaactgggactggttttcagatataatcaaaaacagcggcaggcctaaaaatgaggtaaatgttttgaatcttttcgcgtataccggaggcgctactatggcggcgtctgccgcaggagccagcgtttgtcacgttgacgcggcaaaaggcatggttacctgggctaaggaaaacgctgttttatccggtcttgatgaaaggcctatcagatatattgttgatgatgtaaagaagtttgtggagcgtgaggtcagacgcggccgcaaatatgacggtataattatggatccgccttcttacggcagaggcccgggcggcgaggtctggaaaatagaaaatgagctttttggtcttattgaatcgtgtttaaatgtcatgtctgacaatcccctgttttttttggttaattcatatactaccggaatgtcgggcaatgtaatgagcaatatttataaactcacgctctgcaaaaagtttggcggagaaattgatatagatgaaatcggtctgcctgtaacaaacggcggacttgtgcttccatgcggctattcagcacgctgggataaaagataattgtatttaggggtatctctttatggaagatataataactgtcgacaacttaatatttgaatacacggacgaggacaccggagagaaaaaccgtgtgctcgataatgtgagcctgaacgttaaagaaggagaatttttaacggttctcgggcataacgggtccggtaagtcaacgcttgcaaaacattttaacgctattttgcttccaactgatggcaaggtatttgttgacgggatagatacttctgatgaaagccggctttttgatatacgcagaagggtcgggatggtgtttcaaaatcctgataaccaaatggttgccacaattgttgaagaggacgttgcgtttgctcctgagaatttaggggtaccgcgcgaggagataagagagcgtgttgataatgcgctggaaactgtaggaatgaccgcgtttaagcggcatgcgcctcatatgctcagcggcggtcagaagcagagggttgctattgcgggagttttggctatgcagcccgaaatattggttatggatgagcctacggcaatgcttgacccgaacggcagagcggaagttatacaaacaataaaaaagctcaaccgggaaatgggcatgactgttattctgattactcattatatggatgaggcggttcaggccgacagggttatagttgttgacagcggacacatttctatggaaggcgctccccgagatatttttccgcaggtagataggttggtggatttgggactggatacacctcagtccacatatttgatatatatgctcaataagctcggtcttgactttaatccgcgcgttcttaatgataaggagtgcgctgaagaattaataaagagactaaagaagaattgctgataatttgatatgattttcttatacggaggcaggcattaatgattaagcttgaaaacgtaagctatacatatatgaagggcggtccatttgaaaaaaaggcgcttgacaatgtgagcctggaggtgaaacccggtgagtttattggggttataggccatacaggttcgggcaagtcaactatgatacaaatgctgaacgggctgttaaaaccgtctgagggcagagtttttatagatggaacagatattaatgataaaggcgtaaatcttcgggatataaggtttaaagtcggattggttatgcagtatcctgagtatcagctttttgaagaaacggtgcttaaagatatttcatttggcccggctaatatgggtctccctcgtgaagaggttgaggagagagctagatttgccgcaaacatggtagggcttaatgacagtctgcttgaaaaatcaccgtttgatttgtccggcggtcagaagcgcagagcagccattgccggggttttggcaatggagcctaagattttgattttagacgagccgacggctgggctggacccggcaggacgggatgagatattgtttaagataagagatatgcacaagaggatgaatttgacggttcttttggtgtctcacagtatggaggatgttgcaaaacttgccgacagaattcttgttatgaacggcggccatgttgagatgtttgatacccctgataaggtgttctgcaaaagcggaagacttcaggagattgggcttaatgttcctcagataacgagggtgatggataggctcagagaagccgggattgacgttccgggaggtatctacactactggggacgcatacagagtactggctcctatgttgaagtaaaatatttaatacagttttattgaaaggcggaaaaatgctaaaagatataacactcggtcaatattttcccgggaattcttttatccacaagctggacccgagaactaaaattttaataatgatagcgtatgtggttttggtgtttatcgttcagaatttttacggctatttggcattggcggtatttttggggatttgtgtttttgtgtcaaaattgtctcctaagtatttaataaaagggcttaagccgataatgatatttattgtgttcacagggctttttaatttgtttttgacctcaggcacgcccgtatggcattggtggatatttaccattaccaaagagggtatacgctttgcggcgtttatggttctgaggttgatttttctgattttaggcacatctctattaactttgacaacttctccgatagcgctgacagacggtctcgaatacctgctgaccccatttaaaaaaattcatgtcccggcgcacgagatagctatgatgatgactatcgcgctgaggtttataccaaccttgctggatgagacggataagattatgaaagctcagtctgccaggggggccagcattgacagcggaagccttctgagcagggcaaaggccatggtgccgatacttattcctctgtttatcagcgcgtttcgcagggctgacgagcttgccacggcaatggaatgccgctgctacagaggcggcgagaacagaaccaggctctatgaacttaaattctcaggaatagatataatgagctggttatatgttttaatattgcttggaataattctttcactgaattttggatttggaagtttttaatatggaaaatataaaaaatattgcaatgagaatcaggtatgacggaacaaattaccacggctggcagtctcaatctaatggggtaactgttcagagcactatagaaaaggctctttcggaactgaccgggtctgatgtaaaagtcacaggctgcagcagaaccgacgccggcgtacatgctttggattatatttttaattttaaatcagaaacaaaaatcccggtggaaaaactgccgtacgcgttgaattataggttagaagacgatataaccgccctggaagcctgggttgcggcggatgattttaattcgcgtttttctgtaaacggaaagcggtatatttataatatttggaacagcgctttaaaaaatccatttttaaatagatatagctggcattttccatacaaattagattttaaaaagataaaagatgctgctgttttttttgagggaaagcatgattttgctgggtttatggcggcaggaggacagcagaaaacgactgtcagaactattagcgtatgcggagcggagcagagcggggagtttcccgaactgctgacaataaccgttgaagctgacgcattcttatataatatggttaggataattgttggtacgcttgcggatgtaggcaccggcagaattgaggtttcggatattcctgaaattatatgcagtaaagacagacgccaaggcggtattacagctccgcctcaggggttgtttctaaaaaaagtatatttatagctgaggatgacctgatatgaaatttgatctcaacaaagagtttagcttctctcagataggcaactatttaaagagaaagtatgactccgcagtaaaatttataaaaaagatggatggaagcagtataaaaaatattactgtcaaaggtaaggtcgtccgtatcaacgcaattcgtttaagctttatcgcggcggttttagcagtgcttttggctctgtttgtaaatattgttatagttccgaatactacataccgtgcatattcggatttggagtttgatacgggaggacagtatattcagtatgctttcggcaaagatgttttgctgcttaacaaaagcggaatcaaggatgttaacaacaaaggcggagacgtttggaatataaaaatgacgctcacgaatccgacaatagatattgccggaaaatatgcgcttttagcggacctggacggaaataacagcttgaatctgtatgatacaaatgggaacaatatagtaagctatccaataagcactgatatattgtcagctaaagtcaataaaaagggatttgcggttgccgcgcttgccgaagaaggttataagggcacagtggtggtttttaataaaaaggctgacgaggtgtttaaatggaacagcggagagggatatataacggacgttgatatatcaaaagacggcaagtatattgccgttgcgcagatgatgagcgacggagacgagacttattcaaagattcgggttatgaatacgtcaaacggacaggagagcggcactgcaatttgcgaggacactctcattgcgaaaattaattttgataaaaacagcaatataactgctgtcggacaaagcaagatatttggattttcaaaaaaagggaataagaattttgaaattgatttagccggaaaatcacctgtcaaatatgatgttgaaaacggtgataatctgttgttcctgtgcagggacagcaggggaaactcagtgcttgagatttatagtatttcgggcaaatatctcggaagctatacaagcagtgacgagataaaaaacattgccggttataatgacaatataatcgcagcgacttccagaaaccttatatgtttaaattataaaggaaaacttaaaaaatctatagagatatcacatgatataatgagcataggtatatatgggaatgaacgcaatgttttggttctcggagggaataaggctgatattgtcaggataaaataacagagtttgtcggaaaatattctaggaggtttcacggtgcttgatattctaacagcatgttttttcgcaatttttatctgggtgggttataaaaacggttttttaaaatctgcatataaggtagcggcttttattgcgagcataattttggcatatatcctttatccttatattaaggattttattgtcggaagcgcttttggagatatgattcgttcaattgtgcagacgaaatatgttgaacccaaaatagcctcggaaacattaactgcgacggcgctgccggaatacatgagaagcatggtggcaaccggacagacggctttaaatgacgctttaaccagctttattacaaatttggttttaaacttgatatcgtttttgtcggtgtttattataacccgaattttaatttctattataggaaaagtggttaatatcgtttcaagacttcccgtgataagattttttgacagagcggttggagtggtatttggaataattgagggtgttatcataatatatttagttttggctcttgtatatgctataaccccgctgagggagaatgaaaatactcaaaaatatatttcagaatcaaccctgacaaaagctatgtatgaaaacaacccgatagtgcagttggttacgccgacggattatgataacttatcgtcaaagtaggaggatttaatgaacaggaaaagcagctccgctgaaatggagaaactagaaaatatgaagatagttgagctcagagaatatgctaaaaatctgggtcttaaaggcgtttcaaaactcaagaaacaggagcttattgaagcggtttctgattttattgaaaatgaaaaatcgggaaaaactgaagaggttaagaatccgtcagaagcttctaatcaggcgttgcaaaaaaataatgtttcagaaaaggaacctcagaataacagccgcccgggcggagaaaataaaaatgataaaccggctgttcagcctgcaaaaaatgaagttatagaatacagcgacccggttcgccgcacaaacttaatgagcggagttcttgaggttcttgaagacggatatggatttttgaggtcggataattaccagtcgggtcctgacgacgtgtatgtgcctcaggctcagattaggagattcagacttaagacgggggactatattgtcggaaacacgagaatgcagcatgagggtgaaaagtatcaggctcttctttatgttcagtccgttaacggcgataaggtagatgtgtcaatacgcagaaaagcgtttgaggatttgacgcctatctatcccagagagcgtttgaaacttgagacagtcaagacggattattctatgaggataatagatctaatagcgcctgtcggaaaaggtcagaggggaataataattgctccgcctaaagccggaaaaacaacgcttcttaaaaatatagcgaatagtataacccaaaataatcctgacgttaatttgatagttctgctgatagacgagcgccctgaagaagttaccgatatgcagagaagcataaagggcgacgttatatattccacctttgacgaggagccgcagaatcatacaaaagtggcagagatcgtattggaaagggcaaagcgtttggttgaacataaaaaggacgttgttatactgctggacagcataacccgtttagccagggcgtataacttaactatagctccaaccggaagaactctttcaggcggattggatcccggcgccttatataagcccaaaagattttttggcgcggccagaaatattgaagggggcggaagcctgacaattttaggaaccgcgcttatagagaccggcagccgcatggacgacgtgatttatgaggagtttaaagggaccggaaatatggaggttcatcttgacagaaagttacaggagcgtcgtgtatttccggcaatagacatagccaaatcaggcacgagaaaagaagagctcttgttaagtcagagagaaaaggaagctgtttggcgtatccgcagggctcttgtgggacagaatacagcagatgtaacagagactatacttagatacattgtaggttcacagaataacgatgaatttattagtgtaatagaaaaagtttttaagtaaacaataaaggagaattgattatgaagaaattatccctggttttagcggcgatgattgctgcttcatcaatttcattttatggaacggcggcatttgccgaagaaaccggtcttgattatgatggcagcgttaatgttgcttttggaaatactacgggaagttcaagcgcaaattcagagacgggaaatccgccttcttggataaaggatatatactcgaccgccactccggctccggcttcgacaaaagacccgaacgctacgcctgaaccgactaagaacccagatgccacgcctgaaccaacagcagcgcctacccaaaaaccgtcggcgacgcagcctcctaatgaggttagagccggaacaccggaagctgatgttgttaaggtgccaatattgttatatcaccatatatcggatgattttgacagctcaaatgcgatatctattatctcaccaagagattttcgtttgcatatgacggcgattaagacgcagtatactcctatatcattaagagattatgtggattttgtgaaatgccgtgacggctctaagactatcccaacaaatcctattataataacatttgacgacggatactcgtcaaactatgaagtggcgtttccgattttgaaagaactcgagattccggcgactatttttgtagtaaccgatacagtaggggctacaaaggaaagcggaaaggtgaattattcacacttcacatgggagcaggcaaaagagatgcaggacagcggtctcattgatatagaatcgcacacaaacgaccatgttaaactcggcgagctggataaggacactcttaactacgagcttcgcaagtctaaatatttgatagaaaagaacttggggaaaacatgcgatatgattgcatacccctacggttcatattctgatattgctatcgacgcttcacacaaggcgggatttattgcccagtgtttggttggagacgacgccactgatatagattatgaggttaatatcccaagagacggggttgagaatatgacaaggataactgtcagcgggcttatgggaaacgtcaatgtaattgagcttataagacaggcggtttcgaataaaattataaattaaaatattaaaattcagaaaggaaaagcagggcgataaaccttgcaggtaaaagcttatgtcaaatgtaataactgtaacatctgaaaattttgaatctgaagtattgaattcggaaaaaccggtattggtggatttttgggcttcatggtgcggaccgtgccgtatgctttctccgattgttgacgagatagccgaagaggttcagaccataaaggttggaaaagttaatgttgacgaacagcaggatttggcgggtaaatttggtgtaatgtctattcctacccttatattatttaaaaacggacagccggtaaacaaatctgtcggcgcaaaatcgaaagccgctttgcttgactttataaaatagaggtgagacaatgtacgacgcagtgattataggtgccggaaccgcaggaatgactgcgggaatatatcttgcaagacaaggcaaacgcgcgataattcttgagggaaacacttatggaggacagattgttaattctctcggggttgaaaattaccccggtataaaaaacatatccgggtttgatttcgctaccgctctttatgagcaggtattggagctgggcggagagatagattatggagaagtcgtgggaataaaggttaacgataattccaaaacagtgctgactgccgataaagagtacgaatgcgaacgtgttataatagccacaggcgcagcaaaccgtaatctcggcgttgatggcgaggaggatttagttggtctcggcgtgtcttattgcgcaacctgtgacggagcctttttcagagaaaagaaagttgccgttgtcggaggcggaaacacagccttagaggacgcggaattcttatcgggattatgtgagactgtatatattattcataggagagatgagttcagaggcgaccaatccacggttgaaaagctgaaacaaaaatcaaacgtggaattcatactcaactctacagtaacggcgtttaaaaagggcgaggacggcaggctgaacggagtggaactgcagaataaaataagcggtgaaatttcagggctggctgtggatggcctttttgtagccgtgggacagattccgaacactggttttttaaaaggcttggtagagttagacgccgccggatatgtcatttccggcgaagactgcaagacaaatattgatgggatctacgcagccggagactgcagaacaaaaccgctcagacagctggcaacagccgccgcagacggcgcagtggctacaatgtagaaaatttttgttttaatcaaattttttatcgttaggatagcaatttcaggcgtaataaggcggcaagctgtttcatagctccctgcgaacccgcatgaaatgggcgtttcctcaaatccggcgactaaaccggcacaatctgtaacagcatggttttgtaaagcccagcaccatttgggcaccacaaaacaaaaaatcagcaagcccttgtccggcctgctgacagccttattatatagcgtatgccctgaaaaagcaatccccgaaaagctgctaacggtaagcagacgcagtctgaacaagccccggcatgagaagtgtgctatctcataccggggctattttcatgcgcggcgggaattccgattccaccgaaaacaatagtggcaagcagggcaaagtgccctgcttgccactattgaaaacggctaaagaaggaatacgtattatgcaaataaggcgcatttaatcagcccggcaaactgggatttgtcatttgtcttttgtttcaaagggtttgttccacgagccaatttcaataaggtttccttcagggtcagctatataacaggttctctgtccccaaggctctgttgtgggttccaaaacagccgttgctcctttatttattgcatttttgtattccaaatccacctcttcaaaagtatcaacataaagtgcaatttccgaatgaccgttcaggcccttcacatattcatattttttgcttgtcatattctcaaagtcttttctgccataaagcaaaaacaatgtgccatctttcacaagataaacattcgatgtctgctcattttccttaattgcgaagccgagcacatctctataaaatctaatcatagttcccatatcgtttacgagcaatccaaaaccgtctaacctcataattaacctccaaattccaatttgttaaatacgttttatccgcctaaggcctacaagcccataactatcttttttcattttaatatagccgcatggaaatgtcaaacagctcatttcgtttcattacttcatgctgctgtttataactgtatgttcgcttgggcaccattttactctttgcaggacggtttttcacatgacagaaatgctgatttcataagcctttccggctgaaaaaagcattttataatcaccaaaaatttactattttctataatatttttttcatctgtttaaagagttcgatatgctttaatatgtcttcatatacctgctctttgccaatttcatttagtatctcgtgtctcataccggcatacatcttgcttcctacataataatatccggcttcctgctgtttggaaaccgcctcgatatgttttttgtatcccagcatacatgaatcttcacagcctgacataaatattattggaagcatggggtttccggctgttaatgtgttgtcgagatacgttcggttgagaagctccagcaagcccctgtatccgttaatcgtaaaagaaaatccgcacagcgggtcgtttacaaactcgtcaactacgtttttatcactgcaaatccatgcgcttttttggttctcgtctttaaatacaaaatcaaagattccgacaaaaaggtcgtttatcagctggtctttataatggtccccccggagtttggcatatttgtctagcacaggggttatgacgcccgtagagttgtcagagctcggcgcaccgcacagaaatactccggaaggtatataatcatatgtctttaaatacacccgtgccgctaatgtccccatgctatgggcaatcaggtataggggcagccccgggtaaagatccattacgtactctgatacgcggcgcagatcttcaactatacccgtagcaccgtcttcgtaaaaatatcctaggtcatcacggtttttcacactttttccatggccgcggtggtcatgaattatacagatataaccttttgaagtaaagtatttcataacgtttaaataccgttctttatgttcggtcataccatgtgaaaattgaagtatcccctgtatgttttcggtggtatcaggcgtgcataacattacgctaagtataagcgaatcgtgctcagaaattaattttaacgtctttgatttcatggaattatcacttcccaatatataagctataattatattatagccttaaaatattaattaatcacaactttttgtatacagtcagtatcatagtggtgaaagcggcagcgcctcctatcagatttgagataggctccgcccaaaacacgccgtttacatgcggcgtccagaaaattggaagtaaaactgtcatagggaccacaataattattttcctgaacatagagaaaaaaacagcttgcttcggtttgtccaaagcggtaaagactgtttgagcgcagaattgcagagccataaagaaaaaaccaaaaaagtatatgtgcagagccggaacgcctccggcaagcaaatctgcattctctgtaaaaatccttataaaaaattggggaaagacagcaacggtcatccaagctaaaacagtatatgatattaaaatcacagacatatattttattgctttcttgactctgccatttttttcagccccgtaattgtatccgaggacaggctgggcaccttgtgaaaatccctgaacaggcagaacaagtatatccctgacagatgttattatcgtcatgattccaatatataaatcgcttccgtattgttttagcgtcatattgcagaccatttgaactgccgcgtttgtagcgagcattgtaaaccctgccaacccgagcgacagtatttttttaatccttctggaattaagtcttatcatatggcgaagttttatggtatatgtggcctttttgctgagtaaaaagcctactgtccaaatggctgaagcaatttgagaaatcacagttgcaatcgccgctcctgccacgcccatattaaatacaaaaatcagtatcgggtcaagaataatattgagcatggcgccgatagctatggtgagcataccggtttttccaaagccctgggcgtttattatactgttaagccccagagctatcaccgggaaaatggctcctataaggtagatagtgatatatgaatcagcgtatgggagtgttgcgtcgctcgctccaagaagctttaaaatcggagttttaaaacataagcccaaaacagagattgatataccgacaattataagcagactgcaggcgtttccgagaatactttccgattcctcgccgttgttgcggccgcgctcaattgatatgagcggcgcggctccggcgcctatcagatttgaaaaagccattataattgtaacgatgggaaggcagactcccactccggtaagcgcgtcagtcgtttccacaccgcctattcgccctataaacattctgtccactatgttatatagtatggttatcagctgcgctatcgtcataggtatagctaaacgcagtatatgtttaagaatgcttccctttgaaaaatcattagcgcgggttttaatatcgttcaatttttaggctcctttccgcaaaattcaaaaaagaggttataaaacctcttttaaatatatttaatttagtcaattttatatgtcgttgaaacgctgctcaagctttgggtataccttttcttccacaaaaatataccagtcgagcagatttttggtttcaaaatagtatttttcaacatcctcgtctatatagtagtcgtttgtgtcagacttgcggtttctaatttcgcttatttcttgatttatttgtataagctgaagtctgactgtgttgtaatcgtcccacactgaggcaatctgcggatatgtaaagccgtttaagcattcagctattttctttctgagtaatattgagagaaagtccgccgtatcaaagaatgctttgcactcatgccccaaagcgacccttaaattgtcgagaacatactttgggttggaatcggaattaccgattcttgccatatagtcgttggcgcacacatgaatgatattctcatacgcgtttttaaggctgtttatcggaagaaagaaagtctgaagttcagagccgtactcttcagctaagatatacagttcctttgttttgaggtgaacatagaaaatacgttcccaatattcattctcagtcatctcatttttcctataagagtttattccttcaaacaaagctttgtttgaagcgtctatgctatccttgtcaggggcgccgtcagttgtcttttttatatttttatcattttggacaaccggcatgactttagtggtttggtcagcgacagcagttttttgtcttttcatatattatacctacctttcggaagtttaatcggcgatgtttttcttctcagagcgttaacattttcatctgaatagaacagtcccatagcaaaccttgcctcggatgcgggtctgttataaaaatcttcaagttttttcacattttttttggtaagatgttttgtagtgctggggaactcagcgtctataagccgcgtcgagtgccaggcttccgagattttataggacatataaactatacaaataagtatgcatactccggtgattataacagaggccagtaagaaagaaaatcccatattcattatttttcagctccttctcgtaccctgaaactaactgacaggaataatacaaaagctaaaacgactgatatagtaacagcccaaatattaattttatatactgtttctccaaacaaaacagggtctccttccagcattaaataccccatcatagccaaaaatatcccaacaacctccaagactgcaatgagatatacagccacagagttcctttttcctattaaaatcgacatacccacggcgactactgatattgcaacgacaagatataaaacatcattgtcactgaacaccataatccagtatccaatatccattgtttcagcaacattggtaaacataggtcttaaaataagggggaaaaacgagaatatggcgcatacgagccacacggaaagcattccaaaaaatcttcggtaatcaaaatataaagcgtttccaacttttcggctgctgatttcttcctgaatatttaccaagataataccccccaattgttatatacggcaataaatcctatatgttattacatatttcgacatatttcataataaaaaggtaccataaaacagttagaaagtcaagagcgttttaaatattggaagataattgttaaaatattcactaccatatataaataagcaataaaaaagagcctaaaaatgatatgcaccccaaaagttagacacttttggaggtgcatatcaaattcggctcaattaaattatattgcaaagtaataaccaacaccgcgtttagtcattatatgttttggctgagacgggtcgtcctcaattttttctctgacgcgcctaacagtaacgtcaacagttctgacgtcgccgtagtactcataatcccaaacatattcaagcagactctttctggaatatattttattcggctgtgctgaaagaaatttaataagttcaaattccctgactgttaaatcgataagctttccgtttttataaagctcatatctgttacagtcaagagtgaaacagccgatttcaactatatcgttttcaacctcagcctgctgaggaactatatcgcttcttctcatattggccttgacccttgccaaaagttcacgtacgctgaaaggtttggttatgtaatcgtcagctccgagctcaagccctaaaaccttgtccacttcttcttcacgtgctgtaatcattaagattggaacagaagaagtctctctgatttttttgcagacagaaaagccgtccatattcggaagcataacgtcaagcagtatcaaatcaggtttttcggattccgccttcctaacggcttcttcgccgtcatatgcctcgcataccgtgtatccttcattttttaagttaagagtcaaaatttcaacaatgcttttttcatcgtcaacgaccaagacttttttacccataccggtttagcacccccatagttttccaatgaattatatgtaaatctataccacttcgcctaaaggcggtaaaaaccaaacacaaaacaatgcaattaaaaaataggaataattacatttccattacatatacactaattttatactacttctcttaaaaaatcaaggtttttattaaaatatttttaaatcttttatactatttaaataaacggtaatatatttggcaaaaaataacaattaaggcggcgttgtttaagtttctgcgccgagaacttccggaccattatcatcgattttaaagtacaccgcaccgtttttggtttcaaagacttctgttcccaaatccttatatgctttcaaaaccttttctgaggcaggttcgccgccgctgtcggtgattaccgcgtattttgcagagacggcttctgcaagttctaaactttcgtttccgtcctttttgccgtggtggggcaccttaataaaatcgcagtcaagttcaatgcctgaatttaatagttcctctattctctcgctctcggcgtctccggcaaataatagccgaactccgttatattctgcaatagatacaattgagaaggcgttgtcgtctccgtcttttgtgtatggctcagttctcttcgacggatatagagaaataactgcgtttcccaaagaaatattcatgtcgtttttaagagttaaaggctcaatattttttgcacttaacgcattcataaaactattataatttttactgttccttacgtaatcagggataatcacgttttggactgatgttccgctaacgactgcagctgcgccgccgacatggtcgttatcaaagtgtgtgattaagaagtattttatattatctatgccgcaggatttgagatgagctaaaacatcgtctccgttctcagtttccccggcgtctataaccatcgtttctccatcaactgtaagtattattgcatcagactttccggtattgagtatcgcgccgtacgctccgtttgccggtaaattcccggagccgtctgtatacggtgaattatggctccctgtgcaggaggtaagaaaactgattgtaaaaattaatagtatggaaaataaaatgttggttttaaatcttttcataaaaaatcacctcataataattttggtgtttttcatataatatttctgacgttttaaaaagaaattccattcttaataattttatcatatgttagaaatttaggtgttaatattttgtaaattagccgtagcttactcaatatgtatttataaatcagaactattgataattgattgtgttagtgatataatcaactttataaaaagaacatatggagaaactaaaatgaaggatagatataagactgttaagaatatggcgagcgcagaaatagtcgagaagcgttccagattcattgcgtcagtaaaacctgtggaaagcgagcatgaagccgtagagtttataaacgaactcagaaaaaaatactgggacgccagccataacgtttatgcctatattgtcgaagaaaatggtgtaatgagatacagcgacgacggcgaaccgtcaggcacagcaggaatgcctgtgcttgatatgttaaaaaaagaaggattaacaaacacggtcgttgttgttactagatattttggaggaatattgctgggtaccggcggattggttcatacgtattcaaaaagcgcaaaggccggagttttagcggcaaatattttagaaatgatactgtgccgtgagctttctgttatctgtgattacaatatgctgggaaagattcagaatgaactgcacagctgggaattcatacagggtgaaacactatattccgacagcgtagagctttcattatatgttccgataagtgactgtgccggattaaaggaacgtattgtcgatataagcaatggaactgttaaaattatagaaggttcagaaatctataaggagaaagtttaaacaattatatgaaaataataaaagttgagaacaataaaaagaaatacttagatcttcttttgttgggcgatgagcaggaaagcatgatagatttgtatttggataaaggcgatatgtttgtcgccgctgacaatggtgttaaagccgagtgcgttgttgtaaagtgtgaagacagggtgtatgagcttaaaaatatcgcggtcgctcctgagtttcaaagaatgggatacgggaaaaaacttgttgagtatatattatcttattataacgactgcgatactatgtacgtaggaacgggggattctgagaaaacccttaatttctataaagcgtgcggatttaaagagtcgcatagagttaagaatttttttgttgataattatgaccatcctatgtttgaggatggaaaacagcttgttgatatgatttatttaaaaaaggagacaacaaatatggataagtttaaaaagattctaagcggtgagctttatgaccctatggaccctgaaatagcaaaggaacagtttcctaaaatagataaaatcatattggagtataataatataagcataaatgatacagaaaagcgggaaaaaatgcttggagaaattttaggccgcacagggaaaaattgttttatactcagcccattctccgctacatggggatgcaatacttatgttggggataacttctttgcaaatttcaattttacacttctggatgacgccgaggtacatatcggaaataatgttaaattcggacccaacgtaactattgtaaccgccgggcatcctatatatcctgaactgcgtgaaaagggtatagagtataatttgcctgtcagaatcggcaataacgtttggatgggagcgggagtaatcgttctgcccggcgtgacaataggggacaacagcgtcataggagcaggaagcgttgttacaaaagatataccgcccaatactgtggcggttggaagcccgtgcagagttatgagagaaatcggcgaaagagataaaaagtattactacaaagatatggaaataggcagcgagtggaaataaagtaactcaaaatccttagaggttcagcggtttttgtcatccaaacggagcgtttgttgtgcagtcttatttatcacagtataataaataagtaaaataaagtaatttttgacggcaatgtaataaaaatgagccgggaggtgataaaatggattgcagaaaagtaggagagttaatacaaaagctgagaaaagaaagaggctggacgcagaaatatttggctgacaaaatgaatatcagcgacagaaccgtttcaaaatgggagcgcggactgggtctgccggatgtgggactgcttaaaaatttatctgatatattcggaatagatttaggaaaaatgctggacggcgatttaaacgaaagagagactgacggagggaatatgaagaaagtaaagttttatttctgccctgtttgcggaaatctagtaaccgcggcaagcggcgctgacgtgatatgctgtggacgcaaacttgagcctatgatagaaaatgggatagacgaaaaacatcttgctgaagttaaaataatagatggggagtattatatatcgtttgggcataaaatggaaaaggagcattatataaattatgtgctgtgtacgggatatgacagggctttggttgtcagactgtatcccgaacagggcggagaggttagaattccgcggatttccggcgcaaaaatttatttggtgtgcagcagagacgggctttttaggattatgtaattaaagaaatttaaatgaatcaggtgatattttgaacgatactataaaaatttgtataggaataattattccgcttgtcggaacatctttgggcgcagctatggtgttctttcttaaagataaaatgcagccggtgctgcagaaagttttgctgggttttgcctcgggcgtaatgattgccgcctctgtgtggtcgcttattattccggctatcgatatggcggaggagaacggatccattccgtgggtgccggcggcagttggttttttgctcggtatcggatttttgcttctgctggacagtataacgccgcatttgcatttgaattccgataaacctgaggggcgaaaagcaaaacttcgcaaatcaacaatgcttatttttgcggtgacgcttcataacataccggaaggtatggctgtaggcgttgtctttgccggagtgctcagcggaaacgccgctatttcaatgtccggcgcgtttgctctcgctataggtatcgctattcagaatttccctgagggcgctattatatcaatgcctttgcttgggaatggaatctcaaagcgccgctcctgtttatacgggattctttccggggtagttgagccgataggcgcgataataactataatactcacatcattgattgttccaatacttccgtatatacttgcgtttgcggcaggcgctatgatttacgttgttgtggaggaactgattcccgaagctcaatccggggatcacagcaatattgccactatcggcgttgctgttggttttacaattatgatgattcttgatgttgctcttggataaaactatatattatggattataataatgtgtatactggaattatagtataaaggaggaatacactttgaaaaattcaaattgtgatgtcaatttaagaaaagtggcggtaatcggatgtggttttgtgggttcagcttcagcttttgcgcttatgcagagcggaatgttctctgaaatggtgctgatagatgttgataaggacagggcggagggcgaggctcttgacataagtcacggcgtgcctttaaacagaccgatgaaaatatattccggcgaatataaggacgcatccgacgcggctatagttattattaccgccggcgccgggcaaaaaccgggagagaccaggcttgatttggtgcataaaaatgtcggtatttttaagtcaataattccgcagataaatgagtgcaattttaaaggaattctgcttatcgtttcaaatcctgtggatattttaacgtatacatctataaaattgagcggtttgcctgaaaataggataataggttccggaacggttcttgatacggcaagattaaaatatcagctgggtcagcatttgggggtagacagcaggagcgtgcacgcgtttataatcggcgagcatggagacagtgaaatagcggcatggagcagcgctaacgtttcgggtatcccaattaattcattctgtgagatgagaggttattttaatcatgaagaagcaatgataagaatagccgacagtgtgaaaaatatggcttatgaaatcatagaaaagaaaaaggcgacatattacggtatagctatgtctgtaaagaggatatgcgaggctatactccgcgatgaaaaatcaattttgcctgtgtcgtctatgatgcacggggagtatggtatagaaaacgttgttctcagtatgccgtcaatagtcggaaaggacggtatagagacaaaggttccgataacagtaaatgagaacgagtgcactcatcttatgaaatcggcaaacgctctaaaagaagtaatttctgaacttgaattttaataaaaataaaataaaataaaacggaaatgtgcaagaggcggaagaatagattgataacttgacataattataaaaaacaaaaaagcttttttgcgcatttccaaatattaaaagggagacgcggtacatatgtttgaatcaagatgcggaatcgagtgcgattcctgcgaaagaaaagaagaggttggctgtacgggatgtttaacgatgaaaaaaactttttggggcggagaatgtgaagttaaaacctgctgtgagagcaaagggcttaatcattgcggtgaatgcgaagaattcccgtgtgaaatggtctctaccatgggcgttgaaatgggatttgacccaaagcccagattggaaaactgccgaaaatgggctaaagaaaaataatctgtacatatgcgcaggtccaaattcggacttgcgtattttattgttttaatttctgaacgtatgtgatataattgcaggataataaaatgatataatgaggtgaataaaatgttagctgtttacaaaaataataaaaatttggcaaaaaaagatatttccggagaactaaaaccatttttttggcttggggatacagcgtggctgttagctcagaaattgaccgctgacgaagcaaacgtatattttgcggacagagccgaaaagaattttaatgtaattcagacagttcttgtacataatatgaatgttgaagagccggatgaaaaaatcacggccgtgctagataatgatttttctaaaatctgcagttacagcggctattgggaaaaaatagatactcttgtggagatggctgccggctatggcttatatatgggattgcttccggtgtggggatcgatggtcaaaaaaggatatttaaacgctgataatgcggaaagctatggaaagtatctcgctgacaggtacggacagcatgagaacgttatttggattcttgggggggatataaggggcgagaccggttttgatgtatggaacatattgggcaacacgataaaaaaatacgcgccggaacagctggttacattccatccgttcggcagaacctcgtctgctatgtggtttaatgactgcggctggctggattttaatatgtttcagtctggacacaggcgttatgaccaaagctcgctgggcttttgggacgataataatgtttcagaagatttttacggggaagataattggagatatgtaagaagagaacttgcgcgtacgcctttaaaacctgttcttgacggagagccttcttatgaaaatatacctcagggactgcatgatttttcacagccgttatggaaagcaaaagatgtaagaagatatgcgtactggtcagtgtttgaaggagcctgcggccatacctatggggataatgcaataatgcagttctatagggaaaacgacaaagacgcagggtataatgttaaaacctgctggagagaagccctgaacgacccgggttcagcacagatgggatatttgtataatcttatgacgtctgtaaattttcaagacggtaaacataacgataacttaataaataacggcggtttcacaaaatacgaccgtatcacagctttttcaggaaaagactttgccttgatttataactacagcggccgcagttttgaattaaatcttgaagcgctggaatttaaacctgtatcagcccgttggtatgacccggcaagcggtgtgtttttagataaagagaccgctttttcggatgtgattgacgtaccgaaaaattcctccgatgaatccgatatgattttggttttgaaatagtaaattttgggcaggataaaaacagaaagttatttaaatagtaaatattattgataagtttgttaaaacgggcataaggtaaaattggggcgtattggtattataacaaaacatttgaattttttgttaagatattaataatttggttgtatttttattttatgtatgatataatcactcattgtatcaatattaaaatagcatttaaactggtgttatatgtgtatcaaaattttttgacaggaggcgacagagtgaaaaaatatttaaagggtatcgggttttacttgctgttgtttttagttatccttatggtattttttatgacgagagttacgcctaaacaggataaagacgtatattcagaattagtaagagatatccaaaatcacgaagtcagcgagattagtatagctgacgatgttgctacggtaaagatgaaaaacagcgattcaataattaaggttgaagttccgggttatgaaacactgaggagcgacgtcggagacgagatggaaaaacagataaaggatgggtcgcttaaggttgagactcctcttccgtccagtataccttggtgggtaacatggctgccaacgcttggaatggtcttgcttttcgctgtattctggttcatgtttatgcagcagtcaggaagcggcggccgcggtatgatgaactttggaaagagcaaggcaaagcttaccaacgaagggcagtcgaaaaaaacttttgccgatgtagcaggcgaagaggaagaaaaggccgaacttgaagaaatagtcgagttcctaaaaacgccggaaagattcaggcgtttaggagccaggataccaaagggcgtacttttggtgggccctccgggaacaggtaagactttgctcgcaaaagctgttgcaggagaagccggagttccgttcttctcaatatcaggttctgactttgttgagatgtttgtcggcgtgggcgcgtcgcgtgtcagagatttgtttgaaaacgctaagaaaaacgccccatgtataatttttatagatgaaatcgatgcagtgggccgtcacagaggtgcaggacttggcggcggacatgacgagagagagcaaacccttaaccagttgttggttgagatggatggtttcggtgagaacgacggcgttattataattgctgcaaccaataggcctgatatccttgacccggcgcttttgagacccggcagatttgacagacaggtattggttgacgcgcctgatgttgtcggacgtgaagcgattttaaaagtacacactaaaaataagcctttgggcgatgacgttaaacttaacgttttagctaagactacaatcggattcaccggcgcagaccttgaaaaccttgtaaacgaggcggctttagctgccgcgcgcgcaaataagaaggttataaacatgatagaccttgaagaatctatcatgaaagtggttgccgggcctgaaaagaagagtaaaaaggtaaccgataaggaaaagaagcttactgctttccacgaagccggtcatgcggttgtgtcaaagatgcttccgacacaggacagggttcatcaggtttctataatccccagaggcagagccgggggatatactttgtcgctccctaaggaggataccagttataacagcagaaccgaaatggttgaagaaataatagttttgctgggcggccgtgttgctgagagtttaactttggatgatataagcacaggcgcttcaaatgatttggagcgcgctaccaaaatcgccaagagcatggttacaaagtatggaatgagtgaaaagctcggcgcaagaacattcggcgaacagaacggcgaggtgttcctggggctcgaagccggacattcggctgattacagccaggaaactgcagctattattgacgaggaaatccataggattataagtgaatgctatgagagatgtaaagtaatcctcacagaaaatatggaaaatctcaaaaaagtggcggaactcttgcttgaaaaagaaaaaattgaaggcgacgagtttgacgctctgttccaaaccggcgacgctgaggcgattgacgcggcgcttgaggttatgaatgatacggataacgccagaaaagagaaagatataaaagaggaaaccggcgacgtttccatgaagaagacagaatttaaagaaaaaccaaacgcttaaataaataggtgccgtacagtttgcggcacctattgttatgtaagctttaaagagggatatattatgttgaatataactttgatttgcgtcggaaaaataaaagagaagttttattgcggcgccgtcgacgagtacaaaaaacgtctcagcagattttgcaagcttaatatcatacaggttaaagatgaacccaacgaggacgggcagcagaaaattgttttaaataaggaagccgagaagattgcggcgaaaataccgaaaggcgcatatataatttccctttgcgttgaaggaaagcagctttcatcagaacagctttccgaaaaaatagagtccctttctgttaccggggaaagccatatagtatttataattggagggtcactgggccttgatgacagcataaaatcaatttctgatttaaagctgagtttttcaaagatgacgtttccgcatcagctgatgagggtaattctgctggaacagatatatagggcgtttacaataagcgccggaataacctatcataagtgattatattttataaccaaactgtcttattttgataaacctgcaaggtgctgcacctaaaaggtgcgtgtaagccaaagtagtttgtattgatgaacctgcaaggcctgtgaccccacctttcaggtgggtgtgatactaaataacttgttttgccattatctacagtgtcaattgtggctacacttttgtttaaaagtgtatgttatataagccatataatgttatacaaactataaatgccaataattaacatagttgttatataataaattacttagttgtgatgtattgtgaccccgccggtatggtgggtgtgatacaaagagacttgttttgccattacctacagtgtcaattgtggctacacttttgtttaaaagtgtatgttatataagctatataatgttatacaaactataaatgccaataattaacatggttgttatataataaattacttagttgtgatgtattgtgaccccgccagtatggtgggtgtgatacaaagaggcttgttttgccattacctacagtgtcaataaattacttagttgtgatgtattgcgcatttatgcgccgcattaggtgagctatcatctgaacacgcagtgttcaatatataaatttaataaatatattttgtttattaaaaataatatatatcaactttgtatatgaccccatataatatatattattttacttataataggtgtttgaaccatttctttttctggcaagaaaaagaaacgctttacctgtgaccacacctgcaaggtgtgtgtaatataaagtatcttgttttgccattacctacaatgtcaataatatgtatacgcaaagaaagaaaaagtgcttgctcgcttaggtcgcctgcggctccaaggggcgctcgcaccccgctcatttcaccatgaagccatggcttcatgatgaaaaaagccctactactttcccgttgactttgtgaactgccgtgaataaaaatattccgagttcctattagtttaacttatcaaaaaactaagttttcagcttttataatacataaaaaagtaggttttttagtgaacctcggtaggcttgcgctagcaagcgcgttaggtgagctaccatctgaacacgtagtgttcaatatatttgtaaatattattactttaatgtggatttatttcatttgtgagatttaatatgtaatcagttgatttattataaaagtctgcaagtttcactggaaaatgtaacagtatagtttgaaaccctctctcatatcgagagtataccgtttgttgtattcctaatatttcagcaatttttgtttgccctaatcctgcatttatacgcagagttcttcatctttttaaatacattttattacttcctctacttatcttctaattttttctcttcttcatctttattaaaataggacgatggcaaattaagattaagcaggtcgccgggtttaacttctaaaatatcagcaatattgaagaatacttctaaagaaaattaggaagatatattaggagcttcaatagaactaagatgagaacagctgatttgtgccctctcttcgagttgtattgggtgtagcccttggcttttctcaaaactgaaattaccaatcccagctcaacgaaagggttcctgttttcaaaacctgcttcttttttcataaattatattatctttttttaaattattatttcaaaaattattaacataaatttatatgtaatattaaggcagttatagatgttaactgtttaaagtataatcgccatacatattttttattttaattttgttgcaaattatgtcattttattatataatttttcattaatagctttttagatgattaaattataattttatagagtaatttgattttaatataataaatgtgttattataccgcaaaaaaatatgccgagtattttacttatattgtggaaaattatcgcttgttaacaaaaaggagcaaaatgtcttatgcaaaacttacaaatgacagaaagaataaaactaagagctaagcaaaaaggaatttcaattaaataccttttagaaaaatgcggtataaataaaggttttatttatgatattgaaaagcaaaataaaataccgtcagtagataaaattgaacgtattgctgattgtcttgactgctctgttgactatctcctcgggcgtactgatgtaatagaaattaacagcagtgcagtaaatactgaaaacaataattttaaagttttataatagttttgtagcagttaaactgctcttgattaattatattactatctacaggtgtaatatggtatagtcatatgaaacttataactgttatgaaaatactgcatttctaagtttagttgttgtcgacggtgaaacatctaaatttagatattagtaataaatgcacaaaatatggaggttaaatttatgtatatttccagcaaggttgctgatagaattaggctagtagcaaaaatgcgcaatgtcaccgtcaaaaaaatgcttaaagatattaatttaggacttaatactatgtcaaatatgaagaattcaatgcctaaagctaataatcttgcaaagattgctgattaccttgattgttcagttgactatttactcggacgtaccgatgtaattgaagttaatagggacggaaatgcagagaataatgtttaagttaaagtattatattttaaatattaaccgtagttgaaattaattttattggctttagaatttatttaatgtactgcatttgacgagtaaacgcaacatgcgaaccatttgtttatatacaaatggttgatattattttattattaagtttataaaactaagagccgcgcaaatttgtgcggctcttaataattggtgtttggaggttaaaagtgcattccgttcatcatcttttttgcttttttaacattcttcttgtcgagcattagaattcctattccaaacactgttccaagaagcataccggtactgaattttcccatgggtttctcctttccaacaaattctactatgtttaaatagatttgtaataatttcattaattatcacaataatattatttgtagattaaatctaaaaaatccaggaatttttgggaaaatatttacatgcgcagagtaaatttaccttgacgtattgacaaatatgttgtattatctaatatgatatgttatcgattatgataatttgtccgtgctgtaacatttgtcagcgcgaaaattaaattattccggaaggatgataataatggcaaaagtagtaccctttaaagggcttagatataatacagaaaaatttaaagatttagatatggttacagctcctccgtatgacataatttcagcggaagaacagcaggagctttataataaggatgagtataacgttattcgcttggattacggtatggaatttgaaagcgatgattctgacaataacaagtataccagaagcgcggcgtatttgaataagtggatagaggaacaggttcttgtgtttgaagacgaaccggcattttatatctatgagcaggtttttcagcttgatactgaagaatctccgacgcattcgctgaagggtattatctctttggttcagcttgaggagttctcaaaaaaagttattctgcctcatgaggaaactttgaaaaaggcaaagcgtgacagacttgatttaatggaagcaactaagacaaatatgagccaaatatattcgctttatatggatcctgaccaggcaatcgctgatattatttcagagtgttcagacggagctcccgatattagttttacaaccagggagaatgttattcaaaatatttggattataaaagacccggctataattaatgttatttctaaaaagtttgaaaataagcaattgtttattgccgacggtcaccatagatacgagactgctctgaattacagaaacgcccgtcatgaagctgacggaactgaaatcggcacacagtcgtatgactatactatgatgatgcttgtttccatggacgacagcggtctttttgtatttccaacacacagaatgataaaaaacgttaaaaacttctctgaacagcttacaatcagtatgctgaccgatgattttaacgcgtctaagatatacttcaccgagggcgattttgcggagataataatgactaaactgcgcaacaccgttgatgaaaagaggtttgcgttctataccggcgggaattattattacttgcttgaactcaaagatgttcatataatggatgatttaataaaggataagagcaatgcttataaatatttggacgttacaatactgcataagcttatattagaaaagtattttgatatagatgatgcaagcttagccaaccaggatcaccttgtatatacaagagacgcgtctgacgcggttaactgtgtaaagaacggcgattatcaatgctcgtttttgataaatgcgacaaagatttcagaaataaaggatatttctttggctaatgagaaaatgcctcaaaaatccacctatttctggcctaaactcataacgggtatagttattaataagtttgactaatatttttaacttgataaccggtttatgtttttagaagataacagagcaggaggaatataccaatgaagataggaattatgggattcggtgttgtagggggcggcgtcggagagcttattgccactaacgccgaatcaataaaacgccgcagcggcgaggaaataacagtcgggaagatactggatttaagagattttccggacagtcagtataaatgctttactaaggactttcaggatattttaaacgaccctgaaatcggagttgtggcggaagtcatgggcggcacaaaaccggcttatgagttcacaaaacaactgcttgaggccggtaaaagcgttgtaacttcaaataaagaacttgtggcaaaacacggaaccgaacttcttaaaatagctaaggacaataacgttaactatttgtttgaagcgagcgtaggcggaggtatcccgattataagacctctttacaccagtttggccgcaaatgagcttactgatatatatggtattttgaatggtaccacgaattacattttgacccaaatgattaaagaaggggaaacttttgagaacgcactgaaaggcgctcaggaaaacgggtatgccgaaaaagacccgaccgctgatattgaaggtcacgacacctgccgtaagactgccatactggcgtctttggcgtttggcaaatttgttgacagtgatgagattccgtgcgatggtatcacaaaagtaacccttgaggatgtggaatacgcggctaagttcggcgcagtaataaaattgctgggtataacttcaagggctgaaaacggcgtttatgctatggtttgcccggctattctggattcttcacatccccttgcgggaatagatgacgtattcaatggtattatggtcagaggcgaggggctgggagacgtgatgttttacggccgcggcgccggagcgcttccgacagccagcgcggtgctttcagatataatagatactgtgaagcataaggataagcatatcaggttaggctggagcgaggggcaggaaggctatttgctcgacgccaaaactttgccgtcaagattttatgtgaggctttcaaagacggaggcggctccggagacgtttgctaaaaaaggatacgatgttataactttggacggcgagaaatataaagatgagtttgcggttgtaacgcctgaaatgaccggttatgaatttgacaaacttgtgtcagttgacggcgagcttggcggatataacgttttgggaaagataagattggtggctgaataaaatggttaaggtcagagttcctgcaacatcggccaacatcggccccggattcgacagcatgggtattgcgctggggctgtataattatgttaccgccgaggaaaataattcgggcagactgcagattaatattttggatgactcaaaaaaattcctgcctgaaaatgagaacaacttaatatataaatccatgaaaagagtttttgagatggtcggccataaatgccctggtcttaaactcaccctggaaaataacataatgattaccaggggtcttggaagcagcagcgccggaatagtcggaggaatagttgcggctaataaactttccggagacagactgtctatgaatgaactgttaaagctggctgcggatattgagggtcatcctgacaacgtgacgcctgctctgctcggcggatttaccgtgaatgtcagaaccaaatatgctatacggtatgttaagactgagcttaatccgaaagatttgtgttttgcggctctagtgccggacttctatcttcaaaccaaaaaatcaagaggggttctgcctaaatccgtgtcccatgacgacgcggtatataacgccgggcacagcgcgctgctgacagcaagccttatgtccgggaagtatgaaaacatcagaaccgcagtaggcgataaactgcatcaaaattacagaaagcggcttatccctaatatggacagcctgttcaggctttgttatgacaacggcgcgcttggcgtgtatctgagcggagccggaccgactataattgcaattataaaagccgacaatcaagcgtttaactgcaacatcagcaaggtgcttataagcaaaatgaaggattggaagcttcatcttttaaagcccgataatctcggagcgtgtataatagaaaatacctaagtaaattattttagaattttcaaaaggaaaactgtgtttacggcatggaattctcatttgaaaagatatataaaaacaggaggggtttttttgggacttatcgttcaaaaattcggtggtagttctgtggctgacgccgcaaaagtaatcaatgttgcagagagggttaccgagacttataaggcaggaaatcaggttattgtggtagtgtctgcacagggcgataccacggacgacttaatcacaaaggcgaatgaaataaatcctgacgcttcaaagcgtgaaatggatgtattgctttcaagcggcgaacagatttctatagctcttttggctatggcgatagaaaaaatcggatgcccggtggtatctttgaccggctggcaggcagggtttaatacaaacgccgcgtcaggaaatgcgcgtatcaacaatatagatactgagcgtatgcagtctgaacttgacagaagaaatattatcgtggttgcaggattccagggcttggataaatatgataatataacgacgctgggccgcggcggcagtgatacttccgctgttgctatagcggctgctatgcgtgcagataaatgtgagatttatactgatgtcgacggggtctatactgccgatccgcgtatctgtaaggacgcaaaaaagctggatgaaatcacatacgacgagatgcttgaacttgcaagcctcggggcgaatgtgcttcataacagaagcgttgagatggcgaagaagtataatgtaaaattggaagttaaatctagttttgagagagtgtcgggcactcttgttaaggaggtagttagtgtggaaaaaatgttgattaggggagtaactcgtgataacgatgttgccagaatagcggttgttggtcttgaaaacacaccggggattgctttcagagtattttctcagcttgctcaggagaatataaatgttgatatgatactccagtcagtcggccgtgagggaacaaaggatatagcgtttacggttacgcgtgagaacgaggctaaaacgctggaagttttggaagggttaaaggatattttaaattataaagaagtcaaccacagggatgacctgtcaaaggtttctattgtcggtgccggaatggtgaacaaccccggggttgctgcaaaaatgtttgaggctctgtttgataatgacataaatattcatatgatttcaacttccgaaatcaaggtttcggttctgataaagcttgaaaatgctgaaaaagcagttaaagttatacatgataaattcaatatttaaaaaaatactggaacggtttaaaccgttcctttatactttaaaggtggtttttatgaaaactgtattgattaccggagcttcaagaggaatcggcgctgaaaccgcacgggtatttgcagagcaccgaggcgaatataacgttataatcaactataataaatccgccggtgaagcagaagctctggcggaggagacgggcggttatcctataaaagcggatataagcgtgccggagcaagttgagagcatgattgataaaatagaagataaattcggcggagttgatatacttatcaacaacgccggaatttcaaagtttaatttgttcacggatataaccgaggaagaatggtcggaggttatggaggtcaatctaaacggtccgtacagagtgacgcgcggcgttgtcagacatatgataaacaatcattttggctcaataataaatatatcctctatgtggggagttgtgggcagttcgtgcgaggtggcatattcaacggccaaatccggtcttatcggtatgactaaggcgctggcaaaagagcttggcccctcgaatataagggtcaattgcatagcgccgggggttatagatacagatatgaacgcagggcttgatgaaaatactgtcagagaattgatttccgaaaccccggtgatgagaatcggaaaaccccgtgacgtgggcgagctggcttactttctgtcaggaagcggagcggagttcataactggtcaggttatcggcgtcaacggcgggtttgtggtttaggaggaactgaaatggaatatataaaaacaattttcagtgaaagaatcttaaaggctgtaataagcaatccaaaacataaagacggcaaatataaaaagattgaaatagagctgaaaaaaatcggcggcacagagaaatatcaaatcgcctgctacacagaaaaacaggtttttcacgagaacgtagaaccggatttgataacaggcaccgttgaggagataatgcggtcagagagcttcagacagctcgacgcctggggcgcggattttttctatatgctgaaggtttcaaaaaaaggcaaagaaagtctgataaaaaagcggattgcgagtaaaactgacgaagccatagccggcaacaacagaaagaaaaagtatctgctggaggaaaacacgtcaataccgccgctggttgatttaggtgtgtttactaaggacggacatatcgttagctctatgtatgataaatacaggcagataaaccgttttgttgagatagcggacaatgttgtggactctttaaaactcagcagtataaacatactggattttggctgcggaaagtcgtatctcacatttatattatattactatctgactgagattaaaaaaatgaaagtaagcataacaggtcttgatttaaaagctgatgtaatagaaaagtgtaataaactggctgaaaagtatcggtatgacggactgagctttgaaataggggatataaacggatatagcgttaaaactccgccggatatggtcattactctgcacgcctgcgatacggcaacagattatgcgctatacaacgcagtatcatggaatgcaaaggctataatatcggttccgtgctgtcagcatgagctgaacggacagatagagacagaaaacttttctgcgctcacagattacggtctgataaaggaacgtttttcagcattggctaccgacgcaatacgggggaaaatattggaatggcagggctataaagtgcaaatgctggagtttgtggattttgagcactcgcctaaaaatcttttaataaaagctgtaaagcgcagcacctcaaaacctgtgagggagactgcaaaaacaaaagccgaaacgctgatgaaagagtttaatttcagccccacactgtatgaattgtttcaatccaaataataatcatgtaatttatattaataataaaaaattataaaagtcaacagaaaaattaaaggtgtttttagtgaaccttgcagtgtgtgacattgaccgccttataggagtggtcacagacattgcagataaatcaaaacgaattaaaaagaatcacatctaccctacaggtgtggtcacatcttccaatgttcgctgaaaaattgacttttttaatggattgaatcaatatgagctcgaaatatcttttgtcacggtagtacacaaagtcaacgggaaagttacagggcttttttcaccatgaagccatgcttcatggtgaaatgagcgggggcgagcactccttggagccgttaggcgacctaagcgagcaagcactttttctttggtgaagcgtttctttttcttgcgagaaaaagaaatgcttcaaacaccttattatgtaataataaaattattttatatggggttatatacaaagttaattataatgaatattttatataatgaacactacgtgttcagttgatagctcaattcacgcggcggtgtatccgcgcaatacatcacaactaagaaatttattgctctgcagtttatataacgtgatataaactataaatgccaacaattaacttagttgtcatataacaatcaaacttagttgtgatgtgcaaactatgtttgccgcgtaaggcgcgcagccacggaaaaaaatattagtaaaaaatattatgatatacttatttaagaatgttcacgctccgcgtgattttacacttgaccccagtatttttatccgctttattgttgtaaccgtcttaaaagacgtgtccgccatcatagacaaaagaccctcctatgaatgttcataggagggtcttttattaatcaattatcattgtttcagcgtcttcatcaccgtagtcatagtcgtcgccggaaacttcaggcgatgatttgtcaggtgaagccgttccgggattcgaagtggtgggagccgaactgtttgaagttgtaggagccgcactgcttgaagtagcagcgctggccgacgctgaagcggacggctccggctgaacataatctacttcttcaaatttaacaaactgtttcgggtcaaggaagttgtcgtcaagtttgatttcaaagtgcaggtgcggctggtcgttcacttcagacactgctgaacttccgactttgcccaaaacatcgcccatctttattgccgcgccaataggctcagacgttgcgtctttaagattgcagtatacactgtcgattccgctgtcgtcatggtgcagaatcacagttgtgccgaaaagactatcctcgtatacctttttaagaaccccgtcctttatggctgttacaggcgtatccttgttggcggctatatcaactccggcgtgggttctccagtccttcatcgtgtcagaatagagcagttcagagtcagaaaaatcttttataatttttccggacacaggcggctgaaccagttctgttgcttcggaatcagatgttgtttcagcgtcaggcttttcggttgccttttgagtttgagagttgatttcgtttctgctcagcggctcgcttgcgtcatatggtgttgtctgagcgtttgcgggaacgctgtcatagtttggcgccgcagtgctgtaggctgagccggttttggtttcatttggtttttttgcagtggtgtgcggaagcagtgagttcagaaccgcataaattccgattgccgtaatccccagtaaaaggattatgtaaaatccttttcttcttgatgaaacggcctcttccggctgctttttctgctcatcgctgggcggatcgactattattctacggtcataattgtcatttctccctttgtttctgtcatctctgtctttcggatttttactcattttatcacctcagataaaagtctttcccaaaacatgaaaaaaatacatgtgtttataaaattttaggagaatttttataaagtcttttatctaataatgaaagataagatatgttaatttactgaacgatttttaaattcataaagggccgcacctgcaagatgtgtgtaagccataatacactttcctttaaagcctttaatgtggaaagtgaaaaccagacaaaaaattaaagctgtttaaattaaaaatatataaaaatgcggtttgcaagtctcggaaaagtctgatataaagggagttatccaaatttaactaagtatgtacacgcttcgcgtgatatgtcagttcaccgcctattgaggtgtgcaagcgcatatattacatctaagtaatttattatatgacaaccaagttaattattggcgtttatatacataccctttaaacaaaagtaccgccgcagacattggaggtaatggcaaaacaagtaactttgtattacacacaccttgcaggtgtggtcacatttataactctaccgctgtttactaaaaacactcttaaattttctattgaattttcaaagcggacgagtgcctgcattatagttttgcaagtttaataaaaatatattatatttctatcaggcgcatacgggtgtacttaacagtttcagaagggcgcaatcctaggcttttattgatatttttgcggccaatatcaaataaaatttgtgtgtttatttttttatatgagtcaagattttaaaaattgcgcccttctgaaactgttaacttataactgtgttaataatgtgccgtctgaacgaataattatagtaccgagctggtcggtgcgtaagactgccgagcctatactttcaagattttgaagcactgtgctgtccgggtgtccgtatttattatttttgccgcaggaaattatggcatatttaggagagactttttccaaaaacgccgttgtggaggaggtgtcggaaccatggtgcccgacctttaaaacatccgcctgaacgtcttcatcctgcagttttacttccgtctctttttctgcgtcccccatgaacaggaatgaggtatttttatagtccatttttattacagcggaataattgtttaagttcttatatgcttctgagtcaggagccaagataccgatttttaagtttccgatgtttaaaatctctgttcccgattcggctttttccactgaaatgttcatatccagtatagtttggagcaggttttcaaacgtttttgtattggttgattttttcggcatatacatatgaatgatgttcaggtttttaatcacataggacattcctccgatatggtcggcatgagggtgggtagcaacgaggtagtttatagtatcatagccgaggttttttatatatgcggtgatttcgggaccgctgcccgaatccccggcgtcgataagcattgtttcattgttcggcagttcgataaactcacagtcgccctgacccacattgatgaagtgcgccgtcagttgcccggcgccgggcttttccgctgtttgtgccgaatctgtttgtgacggctgttccgctgacggcgttatttctgttgataatatgtatggtgatgtcagcgctgatgtttctgtgactgttgccgcagggttctgggttaagaatatggctgctgaacatgcggagagcagtagtagtattgttattataattatgtgaagttttttcactttaaatcccttccaagctttttttatttattatgtttttttatatgattgtataatttaataaataaaaattttagcaaactttgtcgagaagaggggatttatttaaaagtttttatattaaaaaataaaactaatgtaattatccattagttttattttttttagtattagttttgttttcattttcataataaagttcaactgatggaaattccatatttaacaaatcgccggctcgtattgcaagagcatcagagatattaaacaacacttctaaagaaaatgattgcgttatatttggagcttcaatagaactaagatgtgaacggctgattttggctctttcggccaactcagtctgtgttaagccttgagattttcttattgcagagataacaagacctaattcaacaaaacggtctctgttgttaaaaccaacctctctacccattatttttacctccaaattattccaaattgtttaaacatattataatatattgtgtcgaaacttacgagcaatgcggtaatgcagaagcacaaagtcttgtgcatgggcaaagtatattaatttgttgccttttattttagtataaactatttattttataaatagaggcatgcaaaacattgaaactaaaccttgtacattgtttttataaaaaaatttttaggtttttcaaacatcggtagggcagacgcagtctgccgcgtgaggtgcgaagccgcggaataatataatatttatcattttacttattaaaaaattatatatttactatgtatataaccccatataaaaaattttattattacataataaggtgtatgaaccatttctttttctggcaagaaaaagaaacgcttcaccaaagaaaaagtgcttgctcgcttaggtcgcctgcggctccaaagggcgctcgcccccgctaatttcttttgcgctccacgcacaaaagaaaaagccttgtaactttcccgttgactttgtgaactaccgtgaatgaacgcaggcgatataaaaatactttaacgtgtaaatttatttgattttatgtattagaaaataagaataaaataatatgactatggaccaataggtacaaggttgcgtaatgcacgtacaatgaaaaaatgtactcaagagtatgtagcgaataaattaggcgtgagtagtcagcatattagtgaaatcgaaagaggtttaagcggattatcaattccatcattaatggaaatatgtaggatattagatatagatgcagattatatcttgtttggaacaatcacacgagataatcacaatccactaaatgaaatattgttaaaaatgtcacctgagcaaagtagccatgcagaggaaataataaaagcatatgcgaaatcgtttggaataataagttaaaagatacgttgtataaattacaaacgtatcttttttatttaatatactgataaaaagtgggcttttagtgaacatcggaagggcggctatgccgccgcgttaggtgagccaacatctgaacacgtagtgttcaatatataaatgtaatatttattattttacttattaaaaaactatatatttactatgtatatgaccccatataaaaaaatttattattacataatagggtgtttgaaccatttctttttctggcaagaaaaagaaacgcttcaccaaagaaaaagtgcttgctcgcttaggtcgcctgcggctccaaagggcgctcgctacacaaaatcattgccggtgttatacggcgggtcaatatatatcatcttcaccttattgtaataagctgtttgcaacagctttaacacctcaagattatcgccttctatataaacattattggtattatcaaaatttacgctttcttcacggcaaggtcttagtgttcccgtagaacgcttctgtgcaagatgcaaacactctgatttgcccttccactcaaatttatacttttcaaaatcattatctatgtattcaccgcacagtgacaacagcttgtctatatcaagctttccctccgaaaaacattccgggaacacagtctttaatttctccatatttgagttttctaaatccattgaaagtccgtctaaaatatttttatccatttcatatccctccaaattattcgtcaagtctcagcttgctttctttggctttctgttttaatttttcaaaagaatcttcctctatttcgatatacttatcaaagtcgctttgatacaaaccatcctgaattactctaaacttctcaaattcactttccgcaaatgcttttgctatctcgtgggtaacttttccgttgtcgtgaaggatttcatgttcattaaattctaaaaaacgattcaatcttactacccaatcctgcattgtcattggaatattacgtcctgcttgatattcagcataatcaagatacatcgtaacaattctttcaagactttcaatctcgtccaaattcaaatagttttttgcaattgaaacatcgtatttttgaattttaccatcgggatatttttcccacgaagtcagtcccatatttggcttttcggcatttgctctctctactataatttctgctgcggtgtgcctgtgaatagcccaatgcaatttattttgaacatttgtaaaaaattcctttgtagtttttgaggttttgtcataatctaaggcggttgcataaatatccgttatcttctgatagaatttacgttccgacatgcgtatttcgcgaatttgatccaataagtggtcaaaatattcttttgtaagtatagaaccgctgttcatcaatctctctttatcaagaacccaaccttgtattgtatagtctttaacgattgaatttgcccatttacggaattgaacagccctgtcattattcaccttaaaaccaacggcaataatcatctgtaaattataatgatcgacgttacgggaaacttgtctatccccttcttgttgaactattaagtatttcttaatagttgcttccggcagaagctcgttatcggtataaattctttttatatgctgatttatagctgccacagaaacatcataaagtgttgccatcattttttgagtgagccaaatattttcgtccacatatcgcatttcaatactgtctttgctgtcgcctgttgatgccacaaaggttaaatattccgctgctgatgagcgtattgttatttcgtatttcttctttttcattttaaacctcatttccaagttaatcagtttatctctaacacaaattgtcttgcggctcttgctgtaattttttctctgcctaaaaattcatttattttattttccaaatcaacatctatccgcatttcatcaaagaacaatccttcttttttcttccgaatctcgtttttcaaagatgatattttgcgttcaattttaagcagcttcagcctgtccgactttacgctttctttttctctttctgcctgcttcatatcaagctctgtatcgtcaagagaatgaagaagaatatttttcctattcgcggcggcaagcttcattctgttaatctcctcctgctgcattggcgtaagtttttcttcttctttttttacatattcatcaagatttataagcctatccatattgtcgtttttttctgactttaaccaatacgcccttctctcgccctgttcctcaaagaaatatacaggactatttaatatatcttcgcattcattatgtgtaagcagcttaccatcctctgttatacccacaagcaccggaatatttttaatttcacgtcttccggaatatatttttattaggtaaagagctattgtgcatttttcgcaatcagcctttatactgccgtaatcggcgcagctaatattaaaggtaatcccctttgacagcggagacagcagtgagaactttttgaattctttaattgctttatatggtttattcccattattggtaggataataaaacaagtgcggaagctttgtataattatcagcttttatagtcctattcttttcgtttatttcaaaatagcaatcttgatgtgttttattatattcctcaaaataaaactttgtaagctcccacagttcatcgttgattacttttgattgttcctctgcataccgtggtgttatctttattttatccgacagttcctttgtaaatgtggtaaagagaatatcctcggctgactcaacgacctgtttatttttgttctcgttttgtgcaagtgttatctgataatctttttcaatctgggcttttgttcttacgttaagactttttattgccttatccaaattatcgcagaagccgcccataactgcatccgatacgccaaaaactccgtcggataaaatatgtctttttgacacaagttcaagctttctaacatcagcaaaattatctttatttataaaagacaggactatacaatcattttgctgattgattctgtgtattctatcaattcgctgttccattttcagcgtattgtaaagcaaatcataatttataacaagtgaactttcttcaagattatagcctttagctccgttgtcggtagagataagaatttgcgcatcctctttaaattgtttgattacattataatttacattggattgaccgttatatacaagcgttttgtatttatccttgagcacaccataaagatatttttgcgtttccaaactttcagtaaatataactgctttttgttttgctcccagtctctttaaaagcggaaacagcttttccaatgcagcgagcagcagcctcgattttgaatcttccgttatactttcagctatcgcaatcattttttcaaattcctgtttttcctcggatatataaagacgtttaattatgtttttcaagctcatctttatcgccgctgttgaggaggataaaagtcctaaaagcataagagccaaatcatattgttccatttgcgggaaagctattttgtgtggcttctctatatacgcaaaaagcagtttatacaattctttctctttttcgcttgcttcatattcaagtgttatatgtaacctttcaggaatctttgcatactgctttgcttgacttctaagcgttctgaaacagtatttgctcactttagctgcaagttccggataattttccggtcttcttaaatacgttttcatatacgtatcagcatcaggcagaagttcatcatcaataaaaaatataagaccgtataagtccattatatttttctcgataggcgtacctgtaagaagaattttaaaagtgttttttgaaaactcctttaacagttttgcctgtttgcttccgctgcctcttataaatgtattttcatcttgatagactgatgaaagagaatttgcttcttcaaaaataataatatcccattttattttatcagcattatcaatattctgggttaagtattcatatgttgtaatgacaattccatcatagacaaaggaattattctcagatgcaatacaaaatggtatactgtatttttcagaaatcatttcagcccactgaataagcaaatctgggtttgggatggctattaaaatattatttttgccctcataccaactctgagaaataatcaacattgcttcatgactttttcccatacctgcttcatcgcacagaatcacgcctttttgataagggttgcgaacagcaaacagcgcggctgcaacctgataaggatacacatcaattttaccctccgcaaataccggaagaagtgtattctcatcttgcagcatattcagtttcatagctgtataatatgcgtgaaacggtgtttgaagcataaaaaaacttcctttcaaatttagtgcaaatagagaaactcttaactttgcatctaaatgtttaacaaatttctatgagcatatcttctattaaatttcaacggcatcacaaatatcgccgatattgcatttgaaatatccgcatatacgaaggagagtagataaggatacttcatcgcctttatttaattttgtcatagtacctgttgacagttcaagagcatcacgaaactctgctttgctcagttctttttcagcgagcagtacccagagctttttataacttatcctcatttaagacacctccgaaacattgtttaatcttacaaaatattatatcaataatcaccataaatgtcaacgtatatcgttctatcgcacaaaagaatcgcacacaaatgtgattttcttatatttaagttattattgatatatacaattgaacagcggaatgctaacaggtctattaatcatgccttaacctctcgttttctatttgcttttgttttttatatatctgttcaatgtttcttatttctgatagagcacgcttacagaaatctttttgggccgacaacaggcttgtatgatagttcccccaatagtaatagtcaccgtttttacatttccatgtaacaaagctattaggcaatttggggtgaacatccagcacaatttctatttcgccaaccttaatttgatttataattaaatatcctgagtttattctttggatatccataaaatcctccactataaaagcggtatcccttaatatcatgagataccgctttaacgttcatattcctttttacgctgccgctttttataccagtcgtctaatagttttatcataacatcctctatctgcttttcagtataatcttccgggaaatactttttaaccttatcacctgccaatgttattttaatcttttccggcttctgttcctgcataatagaatctataacattgggatttagcttaccattctgtgaaaaacgccgcatttttgcagcctgtgcaatagatggtgaagcctcctccttttcgattgaatttagaacctctgcctgttcctttggtgcctaaataggataacccaacagctgcatttaaggctattttcttttcgtcaaccatttcaagtaacgggtcaattagattcgtaaggcgtatgtaacttgtaatttccataagatttactccagcttcttgagcaaattgttcccgtgctgttaactttggcacaaattgtgcagatgttaaatctgttctttcaccttgacgtttcatagcttccagcttcagccgatacgcaaaagccttttggctcggcaggatattttctctttgtaaattgctgtctaccagtaaaattgccgctgtatcatcgtcaagattttttactacaaccggaatctatgtaattcccgtaagctcacatgcttttatacgtctgtgccctgaaagaatttcatatccgccttctctatgaggtcttgcaataataggcgataataccccattttgttttatactctccataatctcctccatactttcatcaatcaataccttaaacggctgctgctcatacggctttagttctgatatgtttacagtctgtattatttctgtattgtctccatttccggtttttaatattttattctccataatagctatcacctactctctcattttttcatatcatagcgcacacgccagtcaatatatacatctgaggtgctgtatgaattaaaaatagcagctatcagatagctgcgtacatttcgtatcttcgtacagttttcattcattgccaaaagcatattgctgatatgtgtgtaatttattttcatgaaaatactttttaccacaggagccgtatactgtacatggttaatataatagctttcagccggaaaagtcagaacatccgccataatatccacaatgttgtcaattacctctttttcctcatgcagaattaatccctcatactctatatttctttttacaagctctctgtatttttcataatcctcaatcctatccattgaaaaagtttcacttgctgtattacacgatagataagattgatgatttatatactcagttttattattatcagtattgttatactcagtattattaatattagtattaattgctcgtgattttcacgattccggattcgtgctggttctccggcgttataacaaagcttttaacatatataatatcagtcttccccaatccctgacgtctccgttctatcaagcctattcctgtttccttatcaagctcattcaataattttgttgccttattatcggcacacccgaaatcctccataatattttttaaggtatagattatatataccttgttttcatcgtcaaaccatctgtttttaactgataatcccattcggtcaagcataaatccgtataatacctttgcatcggttgatagtgatttaaacgtcttatccttaaaaagaatttttggtatacggtaaaagctgtactgctccgcctgattaccatagtaataatcaaatattattttctccatgctgttccacctccttattttggtaagtcaagaccaccagtaaactggtggcttgcacagcccctataaggggctaatacaggcttaacccctgtaaggagcacagaagtttgacaccgcattactatcacaggcagccgctcacgtgcggctgtattttttgcctacttattcttgctacccgtaaacgggtttaaatactctttcatgcttatttgatccgatgcataatcctcctcaagttgattcctgatatattcggatattatttttttatttctccccactgtatcaacataatatcctctacaccaaaaatttcttgaaccatacttatatttcaaattggcgtgtctatcgaatatcattaatgaacttttccccttgagatatcccataaactgtgctatacttatatatggtgggatactaacaagcatatgtatatggtctaggcaggcttctgcttccattatttctactcctttttgtttacaaagctttcggagtatttctcctatatctcttttcaactgaccatatatttcttttctccgatatttcggtgcaaatactatgtgatattgacacctgtattttgagtgtgctgtgctctttatttcatttgtgctcttctttaacattattaaaaacctccatgatatattttttgtaatgcggtcgccaaaccatttactattatatcatggagatttttcttatgctaaagctttttatcttcctccggtagaaccgaaggtttttttccacgtctaaagaccccaacaaaaagagctaactgataaatcaaatcagttagctctatatttatggaacaatacaatttatgttgcaggtgttgccaaaacgttgccacaagatatatccagaacggtgtaacccgcactttgtaatccctcctgatttgtgtaactatccagtatttgggcatatgtgtccatattggctgtattcatagttgacctaatattatatttttgataggacacgaaagagtacagactacaatagaaacttacagtcacctatacccaaacaagcaaatcgaagtcgccaatcagcttgacagcctaatggctacaaaaaatacggctgatgtagccaatttgtagccactaaaaaagcaaaatcccgaaaagtgccgtaaaatcggcacttttcgggatagaaaagcacaatatttatcattcccactcaatagttataaaatactattaagtgtttatgtgtgtgttttcggtagttatatttctttttaatacatctattccattatatttatttattttaaaacgggaaagtcccacaatcgtcccatgaattttctctcatatacaaattgattgccaaattagtacatataatatacacaaaaagacaccaaactaggcgtctttttttaactcacctaaacgattacgcgagtttaactctgacacagaattaggaacaccaaccaataactcgattaaatcacaatttaaagcttcacatattaagtcaatctgttctaaacttactcgatctgtcatttcatgataaaggtcatttatagtattaggtcttatccctgttttccgtgcaaggtcagcttgtgtccatctaagttcgcctaacttcctagacaataaaattctaatcattgtattgctcctcttgatatattatatcaagtagtgaagcgatttatctgtttttattattttatatctatatttgttattaatatgttttgattttagtttataagactttcgtaacacatttattgacattcaatcacggattttgaagctgtatttttttattaatgataatttttaatataaatcatttttcacattttataagaatatctgaaaacagcgtttatgcccaatatgtaacatatagtttaaaatatattattgatagaatattcatatattttaaagattgggagtgaaatgatgaacatattaaaaatgtgctttggaaaaacattatactttagaagaattgaactaaaattaaatcaagagaaaatggcagagagatgttgtctgtcaccacgccaatacatagatttagaaaatggtaaaaggctaccatcttttaaaagtttaattaacatcataataaatagtggcatagacctaaatttatttattgaagaaattatcaaagctggatatgtacctgatgattcagtcggtaaataaattttatgtctttgtaatcataaaaaataggctccttaaaaaattataagaagcctattttgttttaatatatacacatttgtttttttatcccactgtatatcacaatttattattgattttaatgagttcaatggtattacagttatatcattgcagagtaatactgtaccatccatcaatttctgttcatcatttttttatatttgtcgtcatttattataaaagaacatgtattattgttataacttgcaatagctatcatatcttatcgaatcataacgaaatcttaacttgttgtttttgattatttatttttcttttctaaaatccagtcaatatattgaatactgtccgtttgatcgatctggatagattttgctgtcccatctggtggatcatctatcggccaatataaataacgttttttaacaagcatacgagacaatagagttttgaacatttcatctgtaagaagatcgtcttcctgaattatattatattcttcatcattcaataacccaaattcatttgcttgactcaaaacatcattccatgatatatttttagtatcatgcaaacaacgtaacatgaatgcaagacactctttgagcgtcacatcatttttcggttcaaaatcatggatagtatcatattcattactttgtatgccaatagccacaccaccgaacttagcaagaatgatatatcctgagtttacgttgtcatattctaaatctgaaaatactggctggtaataacatgcgtttgcatatctatcagcagtatcttggtctactccaatcactttcatgattgttgcaatacaatcaccacgttttattgattcattcacattttcagttatgtatggagcaactgctttaatgacatttaccattttctcatttatgaaatcctctgaggctaatgcccctgccccaaaacttgttagtatacacaatgaaatcataatacaaaatattttccttaacattagtaaaccgcccttcttcccatcataatatatccatcatcatctttatgtacgctatcatattccaagcgaagtgcattttcagaatagtaattatttgaagcttccacacgtgtcgcatttgcccaatcgccatttatgacttttacataatcaatacccgttgtattaagttcctcaacattaccctgccgtaaaagtgttttacctggttgtagaccacccaaatagtatccttgtgtttgtgtatttcctaattctccagtgaaaacatggatagaatgaatcaattcatgacccaagactataaaattaggcacctttcggtatccatatccttctccatcaacatatgaccaattacttggtgtgaaattaggattgaatgcaatttccgttcccactatatttccatttccatctttttttatactagcatatccattttgacctttactaaaaatgatttcacaatctaaattattatctattatatctcgaacaagattagtagctacttctctgtcaacatcatcgcttttagtataagatactattcctgtttttaaatcaacatccagttcatcgtctgtcaactcttgcaaagcaatgaatcttgcatcttttttgtcagtaattccagttagagttattaccaacccacttggatcaatataacatatagggttgttagctgcataaacataccaattgctatctgaacgaattggatcttcctgagtgaatcttcctatacttgggtcatagtatctgtttcttagatatattaatccagtctcttcatctgtatattgaccattgtatctgaatccgttgctgtctgcttctcctccgcctgttcctgataccaaacctccgaatgcatcatattcatatgctgccgttactgcaaatgatgtactttctgcattcttttctattatgtttgttgtgtctccgtggacgttatatgagaaatatctgctgttatttgctctatcctttgtctttactatttttcctccagctcctcggatatacgtctttgttccttttgttccgtattcggctattacgtttccattgttccatatttgtcctgtgcttactccgtttactgtcttccctattctcgttcccgttccgtcatatgcgtatgttgctgtttggtcttttccatcataactctccatcttattctgaaggttatatccgtaatctcttgttgtgttttcatattctgtatggaaatgttcatccggtgaataattatcataatatatgtgggtatttttacttgtcatgtttccgttataatcatacatatatttttgctcgttactcatacaatacccatattcacaattttggtatgtcagcctgttgttatcatcatatacatagcttgtttctccttctccttcttcatagctccacggaatatggtagtccatcagtgatatttcattttcatttattattccgtttttatcttttttgaacgctctgtttcctctttcgtcatacgtatataatgttgaatgttctaactgattgttacggtttattgtctcaagtttcaacctgccggcgctgtcgtaggtatagccttttgtctttccgaatatgtctgttactgacgactggttcccgtccaggtagtagctgtagttatactccgagtatgttccctttatgttttgcagcgggtctgccactgtttgattgcttacctttttcggcaggttgctctcattgtactcgtagctcgttaccattgtgtttccgttggttttcttctctgtcaggttcccgttttcatcataattatacactgccaccagctcgttttccaggttatcccttacctctttcatctttcccagatagtcatagctatagcttatgttctgacttactccgttggttgagttcagtatcagtcctgtttggtttccgtctttatcgtatgaatagctcagcgtttctcctgttatacggctttctcccgtaacttgtccttttctgtcgtagctgtaggttattgtggccgcttcgtttgctatgctcagcagcgctgtgcttgtgtctgcgtatgtgtaggttattgtctccgtctctccgtctctttcgcttgtcactgacaatgggttgtttattccgttatacacatttgttattactgttccgtttttgtctgttttgcttacaatatttccgttattatcgtatgtataactttcactgtatcccattgggtctgtgcttgatatcagtctgttttggctgtcatactcatatgttgtgcttactcctccttctccgttcactgaccctgttgtcatctttgttatgttcccgtttccgtcatactcatacaatgtctctcccggctcgtctgtgtatgtttttaccagtctgttcatattgtcgtactcataatacacatttctgtacgtcaacgcttctcccggcttattgcttgttatgctttcttttattacgtttccgttattgtcataactgtagctttttatgctgtcttcgccgtctattctgctctttacttctgtctgtcttccaaagtcgtcatactttgccgaactctcatttttctttggatctattgtctttacttcctgacccagcatgttcttttccactctggtagaattattacaaacttaaccgcatataaatccggcagccatgttgaactgtttgtaaatgttaaagatccttctgtcaaatcctgcggcagtgtaaatgttatcgcgctcagccatagttccctggcgcttccgtcctccgttattacaacaggtgtctgagttcttgtctctgacaccactgttccagaaccgcttgctaggttcattgttattcccctgttgttgcttcccaggtaatacattgtatatgttccggctgacagattcactccgctcaaatatgggtctccttttgtactgcttgagcctgagtttccgataaagtccttataacccttaacgtactcattatcaattgttgttccgtcagaactgaacaacgtttgtatgcctgtgcctgcataagaggatttcagcgtaaacgttccgctctgctcgttttgtcttccattggcaaagtcctctgcaatatatgttacctcaccggttacaggagccggttccggcgttggagttaccgcctgtttaacaaacgccgtatacataaccactcctgacggcggtccgtttgttcccagagttaccttatcgccttgattaaagtttttctgatatattttataggtcacatcatttgacgcctgcagtatataatcgttagctgtccatccactcagccacgacggcagattcgacactcgggtatccaatcctacatacactgtgattgcgcttccagcagtgaactcggctacatcagactgaagattctttgaatcgcacgccactcttatccattcagcgcctttgagataattagatatattggtaaaagtattggctctgtcgccgtagattacatcgcctgtctgcagattgttctggattgaccagtctgcagcgtttgcagtatcttttacaaccagcgatttaatcatattgccctcaagaggttcgccgcccccaccgttaaagactacagagtcgccggcgagttcatttaagtacatttcaacatttgtataaccgtcagctgacagacttaccgcacttccgtctccggaatcgttaggattgagcccatgactgttttcccaattgtcaggcatgccgtcatggtctgaatctgcaggcgccgttccgcctttaaagttagatgaatttggatagccgcctacgtcattctgactgtctataatacctttcaacccttgtttgctgcctttataagtataggttcctgttgtaacttcttttatatagcgtgaatctatataatcccagccctgagcgtttgcgcctacaccgtttacaacactgttataggcctcgtctgctgattgggtgttaacataagattcaaagaaaggcgagttgcttcttacatcggaaacagaaaccttatttcctgatgaattattgcccttgcctgccgttaccgcttttcctttgctccaggcgtcatcgcttggattcagaagcacagaacctccgagtgctaccattttattacctgaaacatatgccttctgcatatcataagtattcagctcgttgccgtcgattgagactatgtgcatattagtgttgctttccgctcctgctttgtaatagttatttacgaagttaagccgtcttacgccgccgtctgttgttctgtctctccagttataaacaacgttgtttctaatatccacattgccgccgtatgtgagagcgtcttgttccatacctcctgccaatgaccagtttctgccggtgcagtttataagcagattatggtgaaagcttccaacataaccgcttattgaagccgcaaaagcatgaggttctgtgtctgtacggtcatcaccgttataatgcacagaatcatgcagtgactcgccgattatattccactgaaaagtgatatttttagctgaccttgagctgaatccctcgtctgttgcccatgatactgaagaatggtcaataatactataatcgcagctgcctaaacccataccgcctgttgatttgccgtccatatccccgactcttacacgaatattacgaataataacgtctgatgagcccatagcaccaaaatcataatttatcaaagttataccgtcacccggagctgtctgacctgccacatatacttcgccgccgtcatttggaataaccagtgcgcttttcagctggataacgccgccgacgcggaagacaacaatacgaggacccttttccacctcaagagcctgacgcaaactgcccgagccggagtcattgagatttgtcacctcaacaatacgtccgccctgtccgcctctggcgaaacggccgtaaccctcagctgtaggaaacgcaagacgggctacctgaaaactgtacacagcacccttagtaactccgctgcttccgacctcatcaactctccaatagtaagtgttgagcgaagaatagctgtcgtccaaagcataattcggagatgttctgtttcctttatactctgccgaatttttagtcgcgttatacacgctgttataatctgttccgatataaacatcatgactctttgcgccggagcccgcagtccaagaaagacccctatctatttctaaatgtctttctccgtctttaggattcattcctgagacagacttaaacgggtcagcgccgtcaatttcaaacgcgttcagcacggctccgtttttgcttgtgtctgttggctgaattaaaaccgtaaccgtaccgcctgaagcattaaaggtcgtaaatgacttacccgcattctcgtcgtttgttacacgagtggggactgtaaccgtacttgattttgaaccattcacagtaacagtcaccggactgccgttcggccaattgtcaaaataactgtgccaggtcgtaagagtgtgcgttcccgaggaaagaccggaaatttcaagcttaatagctccgcccttatccgcgtccttaatcgtcacgccatccattgtaagagttggggtcgtaccgtcagactttgtcaaactcttataactggctgacctaatgcctgaacctgtgttcccgccgttgctgagtttaaatgtaacaccgttaaaagcagctgttggtgcggttcccgatacaatccaattgtaagcattattcgtgtaagaattctgcctgccgtcatttgcgtttaggtccacacgaatcctgctgcctgtgctgaacaccggttccgtagcggcggtatacccggtcagcgtacaaaataccatcgctgccgagagagccgccgcaaacattttgcggaaaaattgactttttttcatgattgttcctccatttctattagattatataagcctgaagacttgtccgcttacttgtcgccaaaccaatataacccttatttccgtaaatatataattataattaaataatgtcaatgatacgtatatcataatattatatcatttgtaattagttaatttttgccaatatttctgtaatgcgcggcagaaataatctgttaaatttaacaattataaaaatcaggctacgaacattatttcggactttgcaaacgtttctacactataaaataaacgaaatataagattctaagcttgtattaaatatgcaaaaatttgccatgtaaaaaataaattttaataaaaaagaagctgcgcctatggcgcagccccaatattttaaggagagagttttacacatttatgccgcacaatcagcgcggactttttattattatcatcctcacgctgtccttgagcggtttaacagcagaagcggattttcttggttccttttgaaacaaactttgtaaaaacgattttactgctgccatattattactcctttctggttctatccttactctatgctattattataacaggctaggtgtacaataaaacggacaagcgtacttattttattttttaagttttcatatatagtatacattaatttattagaaaattcttgtattattagttaattatatgtgaatttttttggattataccgattcattaaacgaatttcgaaaaataaatatatttgttaatacttttgtcttgtgattaaaatatgcttatgatataatcaagtatatagaaaataatgctgttaaggaggctttgttatgatagctataggcagtgaccacggaggcgtggcgcttaaagatactataaaagaatattttgacgaaaacggcatagagtacaaagattatggaactcaaaaagacgttcctgcagattaccctgatatagcggaaattgtatgcggcggtattctaaacggcgagtgctcttcaggagtattggtctgcggaaccggtataggaatgagcattgccgcaaacaaaatagacgggataagagcggctcatgtaaccgacgtgttctcagcaaaaatggcaaaggaacacaatgacgcccagataatatgtttaggcgagaggataaccggacccggtttagcattggaaattgtaaaagcatattttgattcaaaacacttaggcggacgccacagcagacgtgtagaaaaaataatggctttagagaagaaacagtaaaatactatttcctataatatagttctcagaatgttttccctaattattactctaggcatactgtttctcagaattttattccctgattattatttcttggaatattacatcagccgccggcatatttttctgaatataaagtaattcagaggtgcggatatgaataaaagcttaacagattttttgcgaaccgcaatggagcctgtcggttccacgatgtatatatggggcggcggctggaacagcgaggataacggcgccggagaggacgccaaaataattggagtaaatccaaattggaaaaaattctttatatcacaagacagcgattatgattataaagaacacagatatgagcatggaaacgggctggattgcagcggatatgtaggctgggttatgtataacttttttgaagataaaaacggcgcaggctcagactatgttacaaatgctaaaaaccaggggaaactatttgctgaaatgggtctcggtaaacactcaaaagaattttcaggggtcagacccggcgatataatgacttcaaacgaccacgtttacatagtaataggagagtgtaccgacggaagcatattatttgttcattccagtccgcccggagttcaaatatgcggaacaccggcaaaatcagggctttattgcagctgtgccgtagaattggctaaaaagtacactcaaaaatgctttccgaagtggtataaaaaattttcgaactgccgtcgcggtatgagttatttaactgacttttcaagatttcgatggtatcctgaaataatgcccgacactgatgaattatatttaaaaactcccggagagatattagaaataattttgcgcaaaggatgatacaaaatgattgaggtaacacaatcaacagtgcttgattttgaaataaaaacagtatgggatatagtaacttctcttgaaaactacagctggcgcagcgacctgagcaaactcacggttatgaaagagggcgaaaggtttgtcgaatttgataaaagcggatacgctacgacctttgaaataacagaattcaaaccatataaaagatatgaactaaacatggagaacggcaatctatcagggcactggacaggaatattcaccgaaaaagacggcggaaaaacagaagtatgttttacagaagccgttgagccaaaaaaatctatgatgaaacttcttgccaaaccatatttaaagcggttccaaaaaaagtatatatccgatttgcgaaacgctttagagaataaataaattaaaattatatctagggatatcccaaacatatcttaagactggcaataaaccctttcagcaaaattctgtttcattgccgccgaactcggaaggcaaaacgatgattttttacaataaaatcaaagcaaaattttgctgaaaggaataaaaaacctaattttcgttacactcaaggtatgctaaacatatcctttaaactataaataaagtatgaagcgtttaacaatattcacaaatgccaatgcttttgacactctttagaggagtaaaaaagcagctttgcagtctcaagaaaaacaaacagcgtttcctaaacatttctcaattcagcaatggtcattcgtctgagtacgcttactttgttttataacctttttctcaaaaccgcttttcgctagacatagatactataaaaagttatttttccaaatatattacacaaaaacagcgctcttttaatggctaaaagtctgaggacagcgctgtttttgcgtagtcatagagtttcctttgtgtgatttgctatcacggctttgcttttttacagccctttttaatgtttttataatcattatggtttattcgaattatttacaaactgttaatattttctagaaacgcccaaaatacttacgctcccacacctatttcagcagactatttatacaaaatttgcctatttaggaaccaattatcttgacatatcctgggatatgttgtatactcttaacttgtaatgttacaattgtgttacattaagattacaatttgatgggtgcataaagttttgaattataaatcaaccagtgtaaagaaaagttttgccgcaaaaatactgaggtgttttctgccgctgacaatagcgttaaccgtgctgttaagctccgtttcagcttatgcggtaagtatatctgcccgcggagcatttgtattggattccgaaacaggtgaagcgttattcgtacataatcctgacacaccgatacctccggcaagcatgactaagattttatctttatatgtaatatacagtcatttagcagacggaagcctttcaaaagacacacaaatacccgtagggcgtgccctggctaattattcaagagacccgggatattcaaatgtgtacctggatgccggagccacttacagcgtagacgaacttttgggggcgatatgtgttgtttccgcaaacgcggcggttatggcaatcggtgattatttatgcggaagcgaagcgaattttgttgatgagatgaacaattggttatcagcgtggggcgttaacggttattttgttgactgcaccggagtatcgagcagaaacaaaatatcgccgagaggaatggcaacagtagccaataggcttataagcgactatcccgatgtattaaattatacgagtttaacatttcttaacttccgtggttatacatattatccgacaaacaaaatgcttccgggaggagcatacgaatatgagggtgcggacggcttaaaaacaggaacgacctcagccgcaggatgctgttttaccggaacggcggtaagaaacggaaagcgtcttgtatcggttgtaatgggtgagagttcaacaaacatgcgttatgttgacacgataaagatgatggactacagctgggacttgctgtcaagcagagcggccaacggtcagacatattttgacagcacgcctaaggattacatagtagcgaccgacctgagatgtttcatcaacgattgggaaataccgacatttattcactatggaacagctgaaacgaattatctggactgtgctgttgtaatgcttagggatttaaaagattatggatttgatgtgagctatgatttagccacagacaccgtcacaatagtaaacaatgttgacaaggatttgacggcgggaccgaattacggagagcagtcacagtatgacgatgaggagaaactggagctcagcgattgggagccggcgaacatactgcttaagaacggccctgacgacccgggagtttatgcagaaagaacttttgacataaacggaagcggagctatatcaatagatgagctttggcatatgggaacagttgtttggaacgagaagtacaacataacagtagtggttacaagatactaataaaaaagataggaagagcaattcttcctatctttttactattataatatttttataatagtgtccataaaagcaatacagccgccctcgtgcaaaggatggttatatctattataatattttttataatagtcactacaaaagcaatataactgtcctctgacacaggacagttatattaattattaataaacttttttgtgacaaccgttaaacggttaccttttatctgcttttattatattctctttttctatttttgtcaagaatattttttatttataaattgttaattatatattgaacactgcgtgttcagatggtagctcacctaacgcggcgcataaatgcgccctaccgatgttcactgaaaaacctgcttttgtgtaataatttaaactaaaaacttagtttttttgataagtaataaatatgaactcggagcgtcttttttcacggtagaacacaaagtcaacgggaaagttacagggctttttcttttgtgcgtagagcgcaaaagaaattagcgggggcgagcgccccttggagccgtaggcgacctaagcgagcagcactttttctttttttgagtatacatattattgacattgtaggttatggcaaaacaagatactttgtatcacacgcaccatacaggtgcggtcacaggtgaagcgtttctttttcgtgccggaaaaagaaatggttcaaacacctattataagtaaaattataaatattatatggggtcatatacaaaaaaactaatctaaactatcatagaaatctttcaataacttcttttcatcaatttttaaaataatacagaaacacgctaattcatagtctgttactattctatcattattctctatcttactaatcatttgctggtcaatattaacattcataatttgcattttagtggctaactcactttgggtcaaacctccttcaatttttgcaatttataatttaatttattaaaaatattttatacttaattaattgggtatggtttagaatcatcagtacgatacaaaatgtaatcaacagatgtatcataaaagtctgcaatatttaatattacttttactggaattttatgtacaccattttcataacgagaataagtgacagtttttaaaccgaatgcgtttgcaacttccttttgtgtaagacctgcggaaatacgtaaatctttcagacgtgttttcatcattatttttcatctcctaatacaatttttataattaaccttaataaacaaaatattttatattatatattgaacactgcgtgttcagatgttggctcaccttacgcggcgcataaatgcgccctaccgatgttcactgaaaaacctgcttttgtgtaataatttaaactaaaaacttagttttttgataagtaataaatatgaactcggaatatcttttttcacggcagttcacaaagtcaacgggaaagtaacaaggctttttcatcttgaagcgcagattcaagatgaaattagcgggggcgagcgccccttggagccgttaggcgacctaagcgagcaagcactttttctttggtgaagcgtttctttttcttgcgagaaaaagaaatggttcaaacaccctattatgtaataataaaaatttttatatggggtcatatacatagttaaaaataactgaataaaattactattgtataaagaattaatatttatcattatcaaattcactatcctcattaatatattgaggagacggaagtttaatattaagcaaatcccctgcgcttatttccaacgcatccgcaatattaaacaacgtttccaaagcgaacgaactaataatattaggtgcttctatattgcttaaatgcgaacggctgataaaagctctttctgcaagttctctctgtgtcattccttttgatttccttattgccgatataattatacctaattcaacaaatttatcccgatttttaaattgaacttctttgtgcattatttaaactccctataaataatttttaactttcataaatagtaacacaatttttttaaaatcttacgtcacataaacgtacgcataaaatttttttagaaataaagaaaaaaatcaattttacttaaaattttttcaaaaaattttgataaaatacttgacaaatcccgattaaagatatataatgtacaagttctgtcggggtgtggcgcagtttggtagcgcacttggtttgggaccaaggggccgcaggttcgaatcctgtcaccccgaccataaggaaacgctgtggattacgagaggtgcgtggtctgcggcgtttttattatatacagcacttttttaaatttagtataattaattaaaattcattataaatgtcagtcaaatgtcagtcagaaatataagcatattattcacattataaaaaaggatagcttgtatactatcctttttcattttaaaattatttagttacaaataattattgtgttatttcttagactttgtaactctgtccttaggcatataacctaacttttgaatatcagaaacaaacttatttatatctatctcgccatttattataaagttaattaggctaatagaagatggaaacctcttcccgctttcaatatctgcatattgtcttaatgacatacagcatttttcagccatctttccctgactgagattaaattcttttcttttaaaatacaggatattactaaaacacattttcaaaatgtcaacaggttccataattccacaccctttgataaaatatacaaatattttatcaatttatctcataaacacatatgtgattagtctcatatttttgttttttaataaatattttggtgtggaattatgaaaattaaatattttaatacttgttatatctcatttattccctatataccccagctctatcattgactataaacattcgcattaaatcctcagtaagccccagcttgccttcctcatcaccttttaaaaatcccttgtcaaccaacttttgtattgtcggtctagcccaatcaggcatattgtcgtccacgtaatcataaattttagattttgcagtgtttctcaattcttcaaattctgttcccatttggttaattatgtcattctgacggtcgttttctgcctttagttcttcatattctctgctcattaattcgtcctcgctttccaatttatattctatccccaaatagtcgcatatacctttgtatatcgctgttgcgcacttatattttccgtcctcgcttgctaaaaatctgttatcgtcatagttgtcaataaatgctgtctctaccaatatagccggcatatttgtgtgttttataaccgcaaagttagcagatttaacacctctgttatacctttccgtctccgcggccatattcggctgtacacattccgctaacgccctgccctgcgtgctgcctgtgcaataatatgtctcacagccatacgcttttgtgtttgccgcattgcaatgtattgatacaaatacatctgcattccagctgttggcactgttatatctgtatgcaagactgccgtttaagctgcttgatactgtatcggtaatactatcacggctcatcttaacagtttgtccgctaaccaatagtaattctcttagtatcactccaatctgcacagatacatcttgttctttcaatccataccccacggctcctgtatccgctccgctgcagttatgtcccgggtctatgtatatctttgccattcttattcctccaatctattatattataacaaaaaaagaatgcccctagatgacattccgtaatgctattttaacttgattttttatgtatattcttgtataatactgtcaagcaggtaagaggaaattgaaggacggttgtcatctccatatgctgtttctcacagctgaaaggaggtgtcgcttatgtggaagtacttattaaaagtaattgtttcaatcataatatttacaacataatcaaaattatgtgataactaagttcatcttatcaagctgtcttagatgaaccgaaccactttccatggtatatatccgcgttgtatttatatttgtatgtcctaaaatgtcggctaaccttgataaatccttttcttctgaataatatatttttgcaaaaagatgcctgagattatgtggaaaaaccttttctgattttactcctgactcttcacataaatttttcatctctctccatatatttgaccggtctattggttttccgctctttgttataaagatacatccctttgaaatgctttgtctttttatatatatttttaaaattttacaaagtttcacaggaataaatattattcttctttttcctttattgttaatttctgctttacctttataaacggcttcaacagttatataacttaactcagagaccctaattcctgtagcacatatagtttgtataataagagatagtcttttattatttaatttttcagcagtcttaattaatctaaaatattcgtttttagataattcttttttctcatcgcaaaatatatttttctgaatctttaacggttttatttttaaatcgccccaaccgttatattctaaaaaaccgttagcggcagctaatattgtattaacgcttgaagcggaataactttctgccaatagctttttccattcaataagcagtattttactcaattctttttcttcaaaatatttatacattctttttatatcttgtatatactttcttattgttgacaagcttttttcttgttccattaaataaacttcatattctttaattttttctgaccttattattctttcctcagcagttatcatattttttacctccttaaatacttattttatctaaaataattgaaatacatactaaagatttaatatgaagtccatttcatactaaagtttttattttgtcaaaaaactaaacttaaaatttgataatttttaaaaaaactaatataaaaaaacaattatttaatttgaaatacaaaacatactgttcttatacaacttaattcaaaacataaaaattttttattaaattatgaaattttttaaaagtactattgacaacactaactgtatatgttatagtcacagtataattgtatttaaaaaagtcacagtttataaataatgaataggagtaacaaaatgacgggaaatttctgtgtagctgttcacgcattggtctatctaaaccataaaggtgaaactgtatcaagtgaaaaattagctgaaaatatctgcactaatcctacgcgcgtccgaaaagttatgtcaatgcttaagaaaaaaggtcttgtaaagtcgcaggaaggccttgacgggggttatattttatcagacaaaaaagaaaatatatctctaggtcaaatactcgacgctataaatgaaaaaactgtctgtcttaattggcacagcggcgatgatgatatggattgtttaatagcctcaggtatggccggaattatggacgacattgttgaaaacttaaattgttcatgtaaagactatctggataaaacaacaataaaaacaattgacagcaaaatatttaaataaaaacacggtatgttaatccatttaagtataattaattataactaagataacaatataaaatgttatgctaatttaataaattaactttaaaaattataataagaggtgaatttatgccattttcattagagcagggaatttcaattataactgtattttttcaaggtattataagttttttctctccgtgcacacttccgctaataccactttacataagttatttggcaggaggaagcaaatacaccggcagcgatggaaaaataatttatcccagaaaaaaaatatttattaatactatatgttttgtattaggtatcagttttaccttttttctgctgggctttagtttttctatgctgggtcagttttttaataaatataaatatgtttttatgataataagcggattaataatgataatattcggattataccaatttggaatatttaaacgccgtaatattatagaatcagaacaccgcctgccctttaatatcggaaagtttgccatgaacccgctgaccgcgtttgttttaggtttcactttcagtttcgcatggacgccgtgtataggtcctgtactcagcagcgtattattaatggtatcggcttccgattcaaaacttatcggctttttactaataggtgtatatacgttaggatttattataccattcctgcttgtcggtctttttaccggcactgtacttgatttgtttaaaagacatcagaacatagtaaaatataccgttaaaataggagccgttttgttaattataatgggaataatgacaataacaggattcatgaacggtattaacagttatatagcatctgtcacaaatacaagcagctcagagaaacaaaccgaaaataataattctgctgaaaataatataacctaccaaacaccaaatcctgaaataactcctgctcctacaaaaaaacctaaaaagaatacctcactggctcctgactttgaattaactgatcaatatggacaaactcacaaactgtccgattataaaggaaaagtagtatttataaatttttgggccacatggtgcggatattgtaaagaagaaatgcctgatatagaaaaattatatcatgaatatggagaaaacagtcaagacgttattatattaggcgcggcaaatccgcgttcagaaaaataccctaataattcagatgtcagtcaggaagaaattcaagagtttcttgatgagtataacttaactttcccggttctcatggataaaacaggagatgtttttaaatcgtacagtatcatgagtcttcctacaacttttataatcaatagggacggaagcgtttttggatatatacccggcgctatgtcggctgataatatgaaagatgctataagcaaagcaatgcaataaataaaattcataaactttacaatatatctttgatatgatataattcaccacaatataacaatatatggaagtgataaaatgttaaaactacaaaatataaattggaccctagaaaacggaactcaaataattaaagatataaatcttgatatacctgatggcaagctgatagttataaccggaccgaacggcggcggaaaaacaacgctggcaaaaattattgccggaatagaaaagccgacttcaggaaaaatatttttagataatacagatatttccgactatgatataactgaacgtgcaaaagccggaataagctatgctctgcagcagcctgtcaggtttaaaggcataacagtcagaaatctgcttgaactcgcttcaggaaaagaattgtcaatagatgagctctgtgaacttttaggaaaagtagggctttgtacttatgattatatagacagggaaatcaattcttcactttcaggaggagagataaaaagaattgagatagccagcgtactggcaagaaaaactaagctgactatttttgacgagcctgaggcaggtatagatttatggagcttcaccggacttataaaagtttttgaagaactaaaatcaaaacataaaggcacgcagataataatttcacaccaggaaagaattttggaaatagcagatgaaattatagttattgccgacggacttgtcagaacaaacggtcaaaaagatgagataatgccaatattgctggaaaatgaatatggacagcactgtcctgaaggaaaggaggaagtgtatagtgaataaaattactgatgaacttttaaaaattgtttcagactttacaggtgaatttaaaggcgcgttcaatatcagagaaaacggtgagtgtgcaggaagacaatcaagtaaaaatattcagattgaatccaaaaaagatgctcccggtcttgtaataaaaattgctgaaaatacaaaagatgaaacagtttatatacccgcctgcgtaacgcacggaaactttgacgatttagtttataatgatttttatgtagggaaaaatgctgatgtcactatagttgccggatgcggagttcacactgatacagaagaagacgcaagacataatggtatacacaagtttattcttgaggaaaatgcaaaagttttatatcaggaaaaacatattggaaccggaaaaggtacaggagctaagaaaatagaccctgtaaccgaatgtgaattaaaaaagggttcttcattaactatggatacaattcaaataggaggagtggataaaactacccgtaagactacagcaagcctgggtgaagatgcaaaactgataatccgtgaaagaatcatgactgacggtgatgaaacagccgatactgattttacagtatctctgaacggaaaaaattcagctgctgacgtagtttcacgttctgtagcaaaaggaaattcaaaacagagttatatttctaatataattggcaataatatatctaaaggacatactgaatgtgacgctatacttgttgataacggtacagttacagcttcaccgagactgacggcaaataactgtgattctgaattaattcatgaagcggcaattggaaagatagcgggagaacaattacttaaactcagaactttaggattaacggaagaagaagctgaacagaagataattcaaggttttataggtgaataataaacgaccatactattattgttatttttataatgattttagtatggtctttataataatatataatatatatatttatagttgaagatgctgttgttggtacggtgagaaatgtagataacttatttttataaacgctgtaacttaattttaacatgttgataaagtgtttgtaaacgaattgaaatattaacattttataccacaaaaagtgggtttaatgttacacacattttaccaacatattacaaatattacaaatgtgtataactttgattatatttatgtaatattttatttaatttaaatctagtgttttaaatctcttaaatagtcaattaatacaactaacatccacagcattccaagggaacctaggatatagtaaaggtgttttactaaatatgcaaagtttatcatagaaaacggcaggattattacaaaaagtaatatggatattattattcttctttttagagttattatgttaaaataagataatattccatatccttctgatacagcggtggtaaagatagacatcatcagacagattgagtagatactttcgaaatttttgtctattaaacctgcaagtttttgcagaggaaagctttcataccaaacagtgctgaaattcataccgatagcaaaccaaaccaagaatataagcagaccgattatagaacctgctattgctgaacttataagtattgtttttctgtcttttacctcttttgtcagcggtgacagtacagaagccgctgtcagggtattatagcttacatagcacacagcaagaaaaatcatatttctgcctgaacctgataaaaagtctgttaaaaaaaatgttggggagtatattttagacagtattgagaaaattgatataaaaagtatagttaccgtgataataggaactaaaataatatttattgccgcaatacctttaatgtcaaaaataaaaactataaaacaaagtgcagacaggataacagcccctgcaagttttgggataccaaaaacgtttgtaaatatttctccgcatgatgaaagcatgacaataagaccgcatgtcaagtcgaaaaatattaatacaagaaagaacttttgaagtatcttagagaaactcaaagtatgttttacatagtctgatatagtatagagttcatacttcattgacttttttaatatagcgtaacaaacaaatataaataaaatggacgctatacatacacctgtatagtcagtatttgaacaaaagttgaaatattcacaaatttctctgccggaagcaaatccggctccaattataaggcctatataaacaaaaataattttaagacaattcatattatcaccactttgtataaagttaaaatcaatatattttgtatgagcttttataatataactatatatagtggacatgcttttatatgaataaatatgggaatttttttaaaaaatattattgacaagcgtagaaatttgtgttattattgtatctgcctcgtgaaagaggctttatttgtgttaggaatttgaggtgataattatgcaaacaaagattacattagcttgtaccgaatgtaagcaaagaaattacgatactacaaagaataagcagaactgccctgacagacttgagcttaaaaaatactgcagattttgtagaaaacacactgtccataaagaaacgaaataattagaggtgtagagaaatggaacaaaccaaaccgagtttcttcaatagagttgcaaaatactttaaagaagttaagtctgaaatgaaaaaggttatctggcctacatttgcaaaagttagacagaatactcttattgttatgctctatgttgttatagttggtatagttatttggggacttgacgctctctttacttggggtatgtcacttatcattagtagatagcaaaggtgattttttatgtcagacaaaaataaagcgaaatggtatgttgcccatacatattccggttatgagaataaagttatggacgatattttaaagaccgtagagaacagaggaatggaagatgttatccaggaagtccgcgttcctatggaagaggttatcgaaataaaagataacaaaaagaaagtctcagaacgtaaagtatttcccagttatgttatgattaagatgattatgaatgatgacagctggtacgtggttagaaactgccgcggtgttactggatttgtaggacccggatctaaaccggtagctctcacacaggaagaggttgagagtatgggacttgagcatacagtgataaaatttgactataacgttggcgacaatattagagtaaaatatggagctcttgaaggatttttgggtgtaatcactgagataaatcttgataagaagaaggttaaagcaactgtttcaatgtttggaagagatacggatgttgaacttgagtttaaccaaatagaatcaatagcataaatttgttacccacacggattattccgtttatatataccgaaattaatcggtctgtgggaggggcctagtcccgataataccacgcatgtgtacaaggaggtgtaaatcacaatggcacagaaagttacaggttatattaaattgcagattcctgcaggaaaagctactcctgcaccgccggttggtcctgcacttggacagcacggtgtaaatattatggattttacaaagcagtttaatgagaaaacaaaaaatgacgctggcatgattatccctgttgttataacagtatatcaggatagatcattcacatttattactaaaactccgccggcaccggttttaattaagaaggcctgcggtcttgataaggcgtctggcgttccgaacaaaacaaaggttgcagaacttaaaaaagcagatcttaaagatattgctgagaagaagatgcaggatcttaacgccgcttctgttgaagccgctatgtcaatgattgccggaacagctcgttctatgggaatcactgttgaagagtaattattagttccgaataagacggataagtttggtgggaggaatattattattctgctgaaccacaataggaggatatagaatgaagaaaggcaaaaagtatcaagaagccgctaagcttgttgaaaagggtaaactttatgaccctcaggaagctttaagcgttgtttgtaaaaccgcaacggctaagtttgatgagacaattgagcttcatgttaagctcggtgttgattcaagacatgctgatcagcaggttagaggtgctgttgtacttcctaatggtaccggtaaaaaagtaagagttctcgtgtttgcacgtgacgataaggctgaagctgcaaaggcagccggagctgattatgtcggtgctgaagaactggctcagaaaatccagtctgagaattggtttgattttgatgtagttattgcaagccctgatatgatgggtgttgttggtagaataggtagagttcttggtcctaaaggacttatgcctaacccaaaagcaggtacggttactcctgatgttgctaaagctgttgaagaggctaaggcaggtaagattgagtatagacttgataaggcaaatattattcattgtcctatcggaaaagcttctttcggacctgaaaagctgggagctaactttaacgtattgatgggagctattataaaggctaaaccgtctgctgctaaaggtacctatttgaagtcagttactattgcttctacaatgggtccaggagttaaaatagctgcaaataagcttgaaaactaatttattttaggttgacaagttatagatattgtgttaaaatatcgacttgtcagaataattaatttgtaaaattatcttttatattccgtagacagcaggtggcagacgccataaatcctgccgaggatgatatgattatgtataattatgtccctcgcatgtctgcgagggatttttttacggaaggaggatttaaaattgccaagtgagaaagttttagaaaataaaaaagcgatggtaaaacagctgacagagagactgcaaaatgcacaggccggagttttggccgattatagaggtcttactgttgagcaggacacagaacttcgccgtaagcttcgtgaggcaaacgttgaatatacagttttaaagaacagtattatccgttttgctgctaaagaagttggtcttgaggatttagacagcgttttagaaggtcctacagctattgctacaagtaatgacgacgttatttctccggctaaggttctttgtgactttgctaagggaaatgatttgcttgaaatcaaagccggttttgttgaaggaaaagttatttcaattgatgaggttaagcagtatgcttcaattccatcaaaggaagttctcatttcaaagatgatgggttcattgcagtcacctatcagcaaacttgctcgtacattgcaggctatcgttacagaagaagctgtaccgggcggaaaagcagaagaaacagcagcacctgctgaagaggctcctgctgcagaagcgacagaaacacctgccgcagagtagtaaaatattaatttgtataaaataagctattaaatttagataatggaggaaaataaaatggcagatataacaaaaattcttgatgaaataaaagaacttacattaatggaagtaaacgatttggtaaaggctttagaagaagaattcggcgttagcgctgctgctcctgttatggttgcaggtgctgccggagctgctgaaggcggagcagaagaaaagtcagagtttgacgtagttcttgctggagcaggcgctcagaagataaaggttattaaggttgttcgtgagattacaggtcttggtcttgctgacgcaaaggctttagttgacggagctcctaagacaattaaggaagctgtatctaaggatgaagctgaagaaatgaagacaaagctcgaagaagttggagcacaaatcgaacttaaataattaaaaaattaagtttataccgctgtgattaatttcacagcggtttttgtttgatgagttatggtataaaaaaatttattaacaaaacttttagaaaaaatcatagtaatagtaaaaaggttaagggtcgaaaatatatcatttaataaaaaacatttatattagaatctcaattacatgataatttactattcatatttcacctgcttgaattttgatttaaaataattttctacatttttataacttatattttagttttattcttaatttgtttaccagatgtatcaactggatttttatcatttgtccatactataataagtaaactaactttatttttaataattgctacttaaaattcataatgtatataccatcatttaaattattatttaataaaaacttatattattatagagaaataaatgtcatacaataattattaagttatattatatagaaacatattattttataatccgtttccatcttccaaaattagagtaaatggaccatcattaattaattctaccttcatgtcggctccaaaaattccggattcaactttcttaaatttctgttttgcatattcaataaaataattatatattttttcggcatgagatggtgaacctgcgtttataaaacttggtctgttaccctttttgcagtcagcgtataatgtaaattgtgaaacaacaagcagttccccatctatctctattgatgataaatttgttttaccattactatccggaaatattctcagctttgatattttatcaactgctttttcagctttttctttatcgtcgttatcagaaattcccaaaagcgccaaatatccgttttctatcttgcctgttatcttatcttctacggatacactagcttttgatacccgttgtaaaactattttcattttatttgctccttctgttaattaaaaaatatacaaagccaattgcattttgtggttttaattactctatgttttgtatgtttctttataaggatattatcacccggagatagtttaagaatatttaaatctccatcatcgctcaatatttctaattctgcatatccggtaagaagacaaacaaactcatcctgatcttggtcataccacccggttgtatggccgtctgatattattttttctattctaatgtttgtactgtttaatagagtattaactatttcattttcaaacttatatgttggccggtcaaataaattttctatactaccaaatcctttcatattaatagattatattttatactttttttgtcaatttgtaaatatattaaattagagctttaattaatgttgtagattattaaagtttatatacattattttctgctttttgagactacgcacttaaagaggtacctatcggagctcttccgatgtttgctgaaaacaattttaatatctttgaaattaatttattatggttttacataagctatttctgttttctgagactgagcacctaaagaggtacctatcggtgctttaccgatatttgctgatataatcttaatatatttattatttattgattatgattttacctaataattttactatccatgactgcgcacctaacgaggcgtctgccgccgccctgccgatgtttgctaaaaacattttatttttactaattaattatatttagtaacaattttggttatacacctataattattaaatattatttatgtaattaaacatctaatataaacaaattaataattataaaaataataataaagtttttttagcaaacatcggcagggcggcgacagacgcctcgttaggtgcgcagtcatggatagtaaaattataaggtaaaattataaacgataagaaaaaatatataagagtgatttctagcgaacattagcagctctgttttaaatgaatagtaataaaaaaaataatataattaaaaaggaaaactataaaaaataagataattttcagcaaacatcggcagggcggcagcagacgcctcgttaggtgcgcagtcatggataacagaattattaggtaaaatcataaacgataagaaaaaatatataagagtgatttcgatttctagcgaaaattatcagctccgttttaaatggatagtagtaaaaaaaaaaatgatataattaaaactgagaactataaaaaataagataattttcagcaaacatcggtagggcggcggcagacgcctcgttaggtgcgcagtcatggataacagaattatttaggtaaaatcataatcaataaataataaatatatgagactgttttctagtgaaaattactagctccattttaaatggataggagtaaaaagaaaaaatgatataattaaaattgagaactataaaaaaataagataattttcagcaaacatcggcagggcggcggcagacgcctcgttaggtgcgcagtcatggatagcagaattaatttagataaagttataaaaatatgttaatataaaggttatatacaataaaagaaattttatttaatgtaaggtagctgtttaattattaaacatattaataattatattttattattttcaaaaaacaattagaaaaaaataaatttataatttttaataatttagactaatatattaaaacattattataataaattttatattatatttttatataatactaagcccgtaagaataaattgattcttacgggcttaaaatagattttaaatcaaaaattaacctagcagcctattatacatatcctgatatttctttgccgattcgttccatgaaaaatcctgtctcatagcatttttaattaaatcggtccaggcttttttatcactgaaaattttaatggcatatcttaatgtatacatcatatcatgagaagtatacggatagaaactaaatccgtttccctctccggtgaattcattatacggcataattgaatccttcaatcccccggtttcacgaactacgggaatggttccgtatgcaagtgaaatcatttgactgagaccgcaaggctcaaacattgacggcattaggaatatatcgcatgaagcatatactttgtgtgccagctcattgctgaacattatattagcagacattttttgtgaattgcaccacgcattatgtctaaacagattttcatactttgcttctccggttccgacaacaaccagctgaatatccatattcattagctcgcccattgcttctgctattatatcaaaacctttttggtcaacaagccttgatatgataccaatcattactttttcgccgtctacggtcaatccaagctgttgctgcagcttcatcttgttttctctttttttatttacaacgtttcttgcatcataattctcaaatatatatttgtccgttttaggattataaacattgtaatctataccgtttaaaataccatacaaagactgtgatcttgcagataataatccgtcaagcttttcgccgcccatcggggtttgtatttctgacgcatatgtcggacttacagtagtgatatagtcggaataaactataccgccttttagtaaattcgcacagccatgaaattccaatttgtcagctgtaaaaaagtcacggttaagtgagaagaaatccgaaacgatgtcaatagagtaaattccctgatagcgcaggttatgaatagtaaatacagtttttattccctgataaaacgtgtctttattataatatgcgttaagcagaacaggcaccataccggtctgccagtcatggcaatgtattatatcaggtttccagtcaagatgttttaatatttccagcgctgctttgtcaaaaaatgcaaatctttcgaggtcgttccacttgtatagataagggtcgccgaaataatattcgttgtcgataaagtaatatataacgccgtctttttcaagctcaaatactccgcagtattttcttctccatccgagcggtatatatataaaaaacttaaactccatttgttccagatattcatgaggaatacagccgtatttgggcattacaaccctgatatcatctcccagctttccgagtgctgacggcagggaaccaacaacatctcctaagccgcctgtctttgcaaacggggaaacttctgatgaaaccataaatattttactcatttgaaaacacatcctttcactaagcttttcttcagtaacattaaccgtttataaaaaaagtgagttaataattacactataatttctttaccgattaccattggatatgtatcttgacccacaagtttcttaccgcttctcaggattacacccttgtcaaatatgacgttttccaggagacagttttccattatctcagagttctgcataagaatgcagttttcaacagtggcgccttttgcgacgtgaacaccgcggaacaaaatactgttcttaaccgttccttctatcttacatccatccgctataaatgagttcgttatttctgcggatttagaatatttagttggaacggtgtcttttatttttgtaaagataggattgtttgtgtttagaccaaacaattcatctcgtatatcctttttaagaaggtctagattaaaacagtaataggattgtatactgtcaatcttctttttatagccgctgaactcatatgtagaaacttttaaacctttggaaacagccgtaagcaatatgtctttggaaattgtatgtcttccgtgtgtgactgcatattctaccatatccataagcaattcgcgtctggttataaacatatgcatatatgaacagtctgtcttttgtttgcttggataaacgtgcatgtcagtaacaattttttcatcattgatatcgagcaaaatatgtttttttacatctttagcgctcaaatgtttagcttttgtataaaccagtgtaaaatcagcttcattttttaaatgttcttcaagaaccatgtcaaagtctatattacagattgtattacaatctgaaacaagaatatattcctggttgcttttagctaaaaatgaagaaataccatgtaatatatccacaccgccgtgtgtttcaatacctgactcaccggtgtctttcggcggcagtatgtagagaccgtcgtcctttctgtccatatcccacgcttttccggtgcctaaatggtcggtaagcgactgataattaacaggagttgtaatccccacttttattattcccgaatttaccatatttgataatatgaaatctataattctgtatctccctccaaccggaacagcggcaagagctctaagacttgtgagttcgcccatactggcttccgggttttcagaaaatataacgcccagcatatcgtttttcatctatatcacctctactaaatttctatttctacttttcttcatgcacggattatacattttctgtaaccattgagcatacgccgatttcaatcttgtctcctatctctatgcctggtcctatcaatgtaatgtcatcgctgcatattttagtattataaaatgatttgtttgcgttatcggcagtgcttcctattgtggcttcttcacctattacggcgtctgaaccaataattgatttattcacaacagcgcccggtttaacagccgcgcccggaaggataatagagtctttaataacagccccgtctccgatagttacgccttcaaacaaaatggaatgttcaacccggccgtaaatttcacagccctccgtagtatagctattcttaagagaaccgttttcgcccacatattgagggggctttacaggatttctgctgaatattttccatgtatcatcatccaaatcacaacccggctggtcatctaaaagttccatattagcttcccataggctctgtatggttccaacgtctttccagtatccgtcaaatctgtgagccataagctttagtccgtcattaagcatagcaggaataatattttttccaaaatcgttttctgattcggggtcgttttcatcctctgttaaatatttcttaagaacatcccaagagaaacaataaactcccatagaagccaaattgcttttaggctcttttggtttttcctcaaattcaactatctgcatatcgtcgcttgtgttcatgataccaaatctgggagcttcatcccatggaacttcaataactgctatggttgcgtcagcatttgcctttttgtgcaccgacagcattttattataatccattttatagatatggtcacccgacaaaataataacatatttaggattaaactgttccataaaccctaaattttgatatattgcgtttgctgttcctttataccattcgcccttttctgcggatgtgtatggaggaagaacaaaaacacctccgttagtacggtccaaatcccaaggctgtccatttgcaatatatgtgttcagctcaaggggctgatactgcgtcagaactcccactgtgtcaatacccgaatgagaacagttactgagcggaaaatcaataattctatatttaccgccaaatggtactgcgggttttgctacattttgagtgagtattccgagccggcttccctgtccgccggcaagaatcatagcaacacattcttttaacctcattttatctcctcctattttacaattaacgttcgctttacttccaaaaataaatatagatttatttttcggacttttctgtttctgcaagcgctttggttttattttctattgtttttatttcgctcgtctgttttttaactaagcctacaactttttctttcttaacctttttggtcggaggcagcttttgtatataaagtgccgtaagcgccggcaaggttatatctattgaataatcaaactcgtcgcatggtatttttttagcatgatatgttttattgccgcttccatccccaccaaactttttgtcattactgtttaatacaactttgtaatcaccgttttcaggtactcctatagtgtaaatagcatggtctataggagtaaagtttatagcgaccaatatctcgtctttcttgtctttggaaagtctcagataagcgagaacgctgttttcgcaatcttgagctttaagccacttaaaaccttcccattcgccgcctgaaagctcgcgttcaatttcaaagaaggcaggatgttcctgataaaaatgtcctaaagctgcggaatattcccacatctttttatggttatcatattcttcaagcccccagtcaagctgttcggcaaaacgccactctataaactgaccaaattcaccgcccataaacaataattttttcccggggtgagaatacatataggcgtataatagtctcagttcgctgaatttttcttcatatgttccccacatcttgtcaatcagactgcgctttccatgaacaacctcatcgtgtgaaagtgcaagaatataattttcagcaaaagcgtacatcatcggaaatgtaagtttatagtggtttcctttcctaaagtatgggtcgcactgcatatagtcaagaacatcgtgcatccagcccatattccatttaaagttaaatcccagaccgcctttattcaccggagatgttactcctccccaagcggttgattcttctgcaatcatcataacgttcggcaggcgttcaaatactgccatattcagtttttgaaggaattctatagcttctagattctcttttccgccgtatttgtttggcagccactctccgtcattgcggttataatcaagatataacatgctggatacggcgtcaactctcaagccgtcgaaatggaattcctgcagccaaaataaggcgttggaaattagaaatgaccaaatttctgtctttgtccagtcaaatactaaggtgccccattctttatgttcgcctctcctgctgtcaggatgttcaaacaggcattcgccgtcaaatttggcaagggcaaagccgtctttcggaaaatgtgccggaacccagtccattattaccccaatatcattttgatggcatttgtcgataaagtatttgagttcttcaggtcttccaaaccggctgtttgcgctgtaataacctgtaacctggtatccccatgatgcgtcaaacggatattctgagagaggcataacctcaatatgcgtgtagcccatctttttcacatacggaataagttcgtccgccatttcggtataagttaaatagcttccgtcctcgtgcgttttccatgatgaaaagtgcatttcataaatgtttataggtttgtcataaggctctgtttttgtccgtttatctatccattttttgtcattccattcatagtcaagttcagttgtgatagatgcgttggccggtctgacttcgctatagaatgcgtatgggtctgatttaagaaatatatctccgcggaatgtttcaatactatatttatagcactgtcccggttcaattccttccaaaaaaacttcccatatcccaaaatccatatgtttgtacattctgcccttgtttctgtcccatccgtttccgtcacaaactacggatacgctttttgcatgaggcgcccaaacagcaaacaaataaccgtcttttccggaaaatgacttgcccctgtgggctcccagcatacggtaggattcatagtttactccctggttaaacaaatacattggagcatcgtctatataggttccggcatccctcttttttccgtttttgtaaatgtcaaaatcattcataattgtgttctcctaaaaatttattctgctccatattaaaacaatacttatagaattattatatattttatacaagtttattttatcataattagaaatttttgtctattttaaatgctcagaaagttgcacaaaatatacttttcatttttgtacgtattgataaataatattatttaatatgagcaaaaaacgtcatatcttgtggttggagaaacttttttttaacttttgccaaaatcaacaaaaaatttgagattttaaacagaaatttatatttaatacagtaaaaattatttgacaattctgtatcaataatattatgacctaaattaaaatatgtacaaataaaaaaattaatttcaaatattttcaaaatagttataaaagtttttttaactcgtccaaagttattgaattaagtttatcaatctttgatttaagcagttcttttccatctaaagcgtccttttgattttgaagaagcaggaagtttcgtctgagttcatcaaattccatgagcttaggccggttcagtgttattcccaactcttcgtctttggaagtcagcgaatcgtcatgaaatcgataaagataaagaggttctgagaactcagtatgccttatggggaaaatttcatttattctcatccagtagtcataatcttctataccaaacctatcgtttgaatactcgccgattaaatccgcaacagatgctctgtacataaatgctgcgccaatagtattattggcagttatatttagattatccgttccggttggaagtattacattgccgctcatgggcggatactcataccagcctttccctcttaatacgtttccatttttatcaatcaatttcatatttccgtaaaccatagcggcgtccttataataatcaagttcctgtaccattttttctatgaatttcggaagcaaaatattgtcatggcttatccatgttaaatactcgccttttgccattttaaaacccgaattaagtgcggtcggaaggagtcggttagcgttatgagaaataacaaatatattgttattgttttttgcgtattcttcggcaatactgccgcttttatcatctgaaccatcatcgacaataattaattctatttttttatagctctgtgatattactgaatttattgcatgttttaggtatttttcaccattatacacaggtaacacaattgagaccagcccagtttctcctaagtttttaaggtctcttacagaaatattataaatattattaaatttgtttttatactcggagaaagttaaatgatgtatgtcattattcttattcgcaaatcgagtcagccaattcaataaagccatttttttcacattccttatagtataattccagctcgtcagcgttgcttttaattaatttttcaatttcacgttctgctatttttattctttccaacgcatagtttttatcccaagccgccgggctgtatccatctttgtacagacggtaagtggtaaagattccggcttttatggtctcttttatgtgttctttggtataacgggttttatcaacgtcatgatagacaactgcttttggctctatgcctattttgcagccgcagtttaatactttaaagcatagaacggtttcctctcctcctgcatagttgttccccacacgcccatagctttcatcaaaaccgccgacagcattaaatatattgtgtctaactgaaaagttagccccgaacggaaattcatattgcttgtttatctcacggtatttggtgtaaggaacggtgtattcactccataaagtttcttttccctcaagtataatatttggtttgggttccggtgttttaagaattatttgtcctccgattattccggcattgctgtgtgcgtcaaaagcattttttattgtttcaagcagacgcggttctgcaatagcgtcgtcatcaatatagacaaggtattttccgttggatactgtcgcacccaaatttcttgcataagtcaatccttttcgttcttctttaattatttttatatcacagtcattgtattcttcaaaggtattgttaagttcctcgccgttgtttacaataataatttcatatttctccgacggaagggtttgaccgcaaagtgactttacagcattggcaagtttttcaggccgattgtatgtgcacacaataacggatatatccagtgggtatttgttatcggcaataagccgcggcggcgtcgttttgatgttacggcgcttatagcttttaagatcgcatataagttttttaatccataaacgaatattgataatttttccgccggcggcgtttaacaaagtcattgtgggcttctttctgcgtttcaaattatcacctcacataaattttgcatggagcggatattaatccaaaagtttgcggaggagcaattgatttaatctccgctgctccttcaatatactcgtaataagtgatggggagactgttcttgttttcaagacctgctgctattgtgtacttgcctgagttaaggcggttttcaaaacaaaaatttatttgattggttccgtaatgaagcggttcgtcagtttgaaaaactatcaaatcaagaccaaatttgtcttttagcgctatagacactccaagactatcaaggcttatatcatcggaaatatatacatcgactgtaatcctaacgttttcatgcagataaaactccccgttttttggtatagaaatgttttttattgctccaatatggctgccgtaatggtttaaggcaccggtgagtctctgtttttgaccgtgagctttattgccgggatttacacagctttcaatatattttgatgtaacagttgcaacatcgccgtttgcaataattttaccgttatctaaccaaattgctctggtgcagaatctgcggactgaatcaatatcgtgcgaaacataaagaattgtcttgccaattttcttaagctcctcaaattttttaaaacattttgtttgaaaacggtaatcaccgacagccagggcttcatcaactaaaataatatctgtatcaagccatatcatggacgcaaaacccaaacgcaccagcattccggaagagtaagttctaacaggcaatctggcaaattcaggtgagatttccgcaaaattcaaaattttatcaatgtctcgggtaataaaatttttactgagaccattaacagtaccgtttaagtatatgttttctatgcctgtatattccgggttgaatccaacgccgagctccagcagggaggaaactgaaccttttacttcgcatgatccattgtcatagccagaaattcctgataagattttcagcagtgtggatttgcccgagccgttttttccaatgactccgacgcattctccgggtttgacacaaaaatttatatcgttgagagcataaaaaagttctgcagagttaaatttttgagaaccaaataaagaaccaaaaatttttttaaatggacttttggattttataaatgacttgtttaaattttctatcttgataatattcataaattttgtcctaagtgtaaagaatataattgtattttaaaattatactatattaaaaattctcatgcaacacttgccaaaaatatattttttaaaaaattttaaaaaaagtgttgacaagcagtaaattctgtggtaatatatcattcgttgacgcgttaaaatattttaacggcagctgtgctggtgtagctcagttggtagagcagctgatttgtaatcagcaggtcgcgggttcgagtcccatcaccagctccagaaatttaatattaaaccactgctaaaaagcagtggttttttgtttaataatcttttttactcttcgccgaatagatttatacggagactttcaagctgttcataaagttcaaaaaaactgccgcttacaggcgtccagcggtatgccatatgataatttccatcttttactgcttcaattattatatccatcccatcagctccgctgcggtgaatctttagcggcatattccaaaaatcagtttcagagaattttttcgttactaactgagtttcttctttagtcaatgttttttcttggatttcatttgtattatccatttttgacaaagttaaattataaacatattttacggttgaagtaccgtcagaattgaggttgattcttaaaacataattgccgctaaaggtgccaaaatatgatagtcggtaaacttctccattattttggcgaagattatcctcccccatacttttgagtatggatgagatagcaggatctgaattttcacctatccctaagattatcatatcagaagaagaactatcaccaatccatctttcagttagtattggattatagttttggtcacgtaaattctgcattaattctccccaatatccacatggcactctatagccttctgtttgataaagagagtataaattaactaatgaacctttttcaatatttaatatattaaatatatcttctttgttagaagtttttctattatatatatcagttatgtttgtttggctgtcattatgttgagtaacagcatatcgtataccatctacagatgaattaggatcttcattccatatataaacatctgcaagaatataatttaactgaatagagtctttagcaacattcttagatgccgctttatcaaaatagataatttcattataatatactttgtatcccaaagcttcggctatagaccttaaaggaatataaatttctccgtcaatagttaatggctcataatcaatctttgtttttttgttattgacaaaaatcgtattgcggttaactccggcagttaaagttgtatcatattctaagcctttttgtataagcttaatagtttcatctgttatttcatatgaaaaaccggaattaaaaatcttattacaacaagaagcagggacatacgttataccgggttctaaaacaaaaggttttatatcgctaaattcggtttcaatgccgtcttttataaatattggagcttctttgcctgcagtatctgcatttgtagtatagctccataaaaaagttaaaacgatagttaaagcaaaaataaaagccatttttttcataatgtgttcctcctaaaaggatattcatttcatacttattataccatacatcattcctaataacaatatagcagtataaatataaagcttttattatgtttgtataaattatacaaaatcgtaaatagcgaatgagcaaacacgagataaagagagaaaatagctaaaataaagagtttgtgtttagctaaattaattttttgcaaaaaagtcttgacaaaattatgaaaccgtattataatagctaagcaagttagagaggacgtctttaaggagacgtcatttattttgtaaacttattaacttaattataaatttaggaggtattcattactatgtcaacttatatggctaaagctaatgaaatcgaaaagaaatggtacattatcgatgctgccggcaaacctctgggtagagttgcagctcaggctgctacaatcctgagaggaaaacaccgtccggaatatactccgggtgttgactgcggcgaatatgttatcataatcaacgctaaagacgctgttcttaccggaaacaagcttcttcaaaagaaatggtacagacataccggttatattggtcaccttaaagaagtttcttataaggacttaatggagcaaagacctgaaaaagctatggaattagctgttacaggcatgattccgcataacagtcttggcagaaaagaattaaagaaacttagaatttacgcagacgacaaacacgaacatgctgctcagtcaccgattgagtggacacgtgagttttaagaaaggggacttatataattatggcagattcagtacagtattacggaacaggcagaagaaagagttctgttgccagggttagattggtgcccggcacaggtaagattacaataaacaagagagatattgacgattactttggtcttgaaactctgaaggttgtagttcgccagccgctggacgctacaaaaaccttaggcaagtttgatgttttgattaatgttaacggcggaggatttacaggacaggccggagctatccgtcatggtatagcaagagctcttcttgaagttgatgatgagttcagacctgttttaaagagtgcaggatacctcacacgtgacccacgtatgaaggaaagaaagaaatacggactcaaagcagcccgccgtgcaccacagttctcaaagagataatcagaaatataattttaacctcccattgtttgggaggttttttattgtatcagaatatatttgttatctaaattttaaatactcaataaacttatttactgcaagcgaagcagtttttctgtccttcattgcaatcccgatatctcggtgtgccggtacatcgagttcttttattataatattatatggaaccctttttagtatcagttcaggtaaaatgctgacgcctaatccgctttctatcatagacattattgcgtagtcgtcccaggtggtgaaatgaacagacggggttaaatcattattttcaaatatttccgatacttcggcttttgcgcccttttccagaagcataaaaggctctttgcaaagagctgagacggggacatttttgttcctggataactcatgattttcaggcagtacagccaaaagcctgtcgctttccaaatataacgcgtcaaattcagaacgggttggaagacgcaaaaaaccgcagtcgacgcgtccttctgatatccagttttctatttcagtgtagtctcctagtaataattcataatctatatttgggtaatccttttgaaattcttttattatattgggaagccagtgagtggctacacttgaaaaagttccaattcttataagtcctgattgaagtccgtttaattcatctatctgtatttgaagtttttcatactcttcacagacggatttagcatatgggaaaatttttaaaccgtccgatgtgagtttaacgcctgatttgcttcgttcaaggattgaaattttccactcgtcttctaagtcgttaatcattttgctaacagccgactgagaatagctgagcatatcgccggctttagtaaagcttccgtattccaccgcggcaacaaaggccatatatttagatatattcattagtaaagctccgtccttatttattctaattagtaatgtaaaacattataaacattctcttttggaagtgatataaaaatgatataataacatatagaatttgtcaacataaaaaggacaataaatcttttgaaataagtggggtataaatatgagcttacataataatcgcgttgttattaaagtgggaacatcgactttgacggtgctttgaaggaagaaacggaactaataagaaaagttacaaaaatagataaaaatgttatgcaggcggcaggcggagcgagttttggtacaggaggtatgagaaccaagctgaaagcggcaaagctggctgtttccaaagggattaacactgtaataacaaatggtaaatcacctgatattttttataaaattttagacggtgaaaacgcaggcacattgtttgtgggaagggattagactatgaaattttcgtatgttaagtatatatttgctcttttgctgtttgggtcaaatgggatagtggcaagtttcattaatttaagcagctatgagatagtattttttagaactttaataggaagtttgtttcttatatctatattttttatcgccggaggaaggctgacgttttataaacataaaaagcaatttttatatgtcgttatatccggagctgcaatgggaacaagctggatatttctatatgaagcgtatcaacagattggtataagtgttgcatctcttgaatattactgcggacctgttatagttatggcgctgtcgcctataatatttaaggaaaaattgagttttactaaagggctagggttcgttattgtcgtttgcggattatttttgataaacgggtatacaattggagaacaaaaaaacctttgggggttgttttgcggtcttatgtcagcgttagtatatgctgtaatggttatctttaataaaaaggcgtcggatataaaagggttagaaaattcaatgctgcaattattatttagttttattactgtcgccgtgtttgtctgtcttaaacaaggttttgtaataaagactaatatttcaagtctgccgtttattttaattttgggtttatgcaatacaggtattggatgttatctttatttttcatccataggcaaactgccgatacagactgtagcaattctggggtatatagaacctttgtcagcagttatattttctgttatatttttaaatgaagttatgacgtttacgcaagctatcggagctttgctgataataggaggagcggtattgggtgaatgtatatttaacaaatcaaattatcggtgtaaaagaagatcataggcgaaagttttttacataattatagttgtaatatcaaaaatagattgctttaaaaaaaattgttacctgaaaggtttgattatttaggatataaagtaaatagttaaattcataaccgcacatagaataataaatactaaacaaagcataaaaattttaaacttttttaagcagaaagatgaagatatttttattttttaaatatagtttataaattgtaaagtatccaacagcatttataaaaattatagtatttacttttgtatttctaaattcttcttgaataattcaccttgttatgttaaaattttttataatggcggaagcaatattttaaaatactctcgtcatttatgttgtatagacgtttgattgcgaatcattattaaaattataagtgttgttataaagcaagttttatattttaataactgaatttttaaatatttttgattggtatcccggttataagtagattattcgggaattagacagggtggaaattatgcttgaaaacgtaggtcgggttttaacaaaaatagatgattttgtatgggggcttcctcttatacttttaattattgcagttggtatttatttgactgttcggctcaggggtctgcaaattaaacatttgcccaaagcgctgaaatttatagtaaaaaacgaagagaacggcgacggagaagtgtcaagttttgcggctttgtgcaccgctttgtcggcgactataggaaccggaaatattgttggtgtggcaactgcaatttgtgccggaggtccgggcgcgcttttttggatggttattgccgcactgtttggtatggcgacaaaatattcagagggtcttttggcgattaagtatagggtgattgagccggacggacatgttttgggcggcccgttttattatatagaacacggaatgggcaaaaagtggaagtggctggcaaagttgttcgcgtttttcggcgtctgcgtcggtctgctgggacttggaacattcactcagataaatggaatatcctctgctgtaaacaatttttttgaccctaacatgagcaatacggttaaaatattcggaatggaatattcatggactgttattataaccggaattattgttactgtttgtacaggacttgtaatcatcggtggaataaagagaatttcaacagtatcagaatttgtcgttccgtttatggcaatcttatatgttacggtctgcgtaattattcttattgtaaatataaaggcgataccggcggcgttcggggagattatagccggagcgttcggttttaaagcggccgcaggaggtatgcttggggcaatggttttggctatgcagaaaggcgtagccagaggaatattctcgaacgaagctggtttgggttccgcgcctatagcggcggcggcagcccaaacaaaggaaccggcgcgccagggtcttgtcactatgaccggcacatttattgatacagtcgttatctgcactatgaccggactgtgtatagttatcaccggagcatggagacctgaattggcgcttgagggggtaggtgttactacatacgcttttcaaaatggactgttttttctgcctggtgcagtgccggcctttataatcatgctgtgtctggtgttttttgcatttactactattctcggctgggattattacagtgaaaagtgtcttgagtatttatcgggtggaaatttaaaggctgtaaaggtctatagatggatttacatattagctgttttcttcgggccttatatgactatatctgccgtttggacaatagccgatatatttaacggtcttatggcgcttcctaaccttatagcgatagtggcgttaagcggcgttattgcgtcagaaacaaagaagtattttaataagtttggaaacagatagctatagtctacttagtttaagaagagttgacaaacagcagagcgcatgatataattacttaaaacataatagaaaagctgagaaggagagagtagcttttattaaccattcagagagagggacgtttgctgagagtcccttatggaagatatttgtgaaaaccactccggagccgcatatctgaacttatagtaagatttgccgtacgcctgcgttaaaggatagggtttgattgaacctaaagttaaaattctgaggtggaaccgtgcattgaactttatgcacccttaggacacataggttatctatgtgttcaagggtgcttttcttttatgtttaataatttttaggagagattattatgaagattattgagagagacggaactgtaaaagaatgcgagccggagcaagagcttcatgttctgcggcacaccgcggcgcatgtgatggctcaggcaataaaacggctttaccccgaagccgattttgcttttgggccggcgacagaacgtggtttttattatgatgtggatttaggagatacaaaacttaccgacgaggaccttttaaaaatcgaagatgaaatgcgccgtatagtaaaagaaaatctgcccataaaaccgtttatattgtctcgggaagaggcggctgaattgctgaaagagagaaacgaaaagtataagcttgaacatatagacgatttgcctgaagacgccgtaataagcttttatcagcagggcgaatatatagatatgtgcgtgggtccccacctctgctatacaaaggctttaaaagcttttaaaataacacagcagtcaggggcgtactggcgcggtgataagaataacaggatgctgacccgaataaatggaatagcttttaaaaatcaggccgaactggaggaatatttgaagctgcgtgaggaagcggagaggcgtgaccacagaaaaatcggcaaagaaatggagctgtttatgttcagtgacgagggtcccggatttccgttttttcttccaaaaggtatggagttaaaaaacgctttaatagagtactggcacgaaattcataacaggagcggttattcagaagtttcgacccctatgattatgagcagaagtttgtgggaaaccagcggtcattgggagcattataaggataatatgtatacgacgcggattgacagtgaggattattgtgtcaaaccaatgaattgtccgggtggcgttttggtttataaaagcagacctcacagctatcgcgaacttccgattagattgggcgaacttgggttagttcaccgccatgaaatgcgcggagcgcttcatggtctttttcgggttcgctgtttcactcaggacgacgcgcatatttttatgaagaaagaacagattaaggatgagattgtcagcgttattgacctaataagcgaggtttatacaaagtttgggtttaagtatactgtagaactatcaacaaggccggatgacagcatgggaagcgacgaggactgggagaacgcaacaaatgcgcttataacagcgcttgagagcaaagggctgccgtatgaggttaatgagggagacggagcgttttacggccccaaaatagattttcatttggaggacagcttagggcgtacatggcagtgcggaaccatacagcttgattttcaaatgccgctgaattttcagcttgagtatatagatgagaatgggtcaaaacagcgtccggttatgatacacagggtgtgtttcggctctatagaacgctttataggtattttaacagagcattatgcggggaaatttccggtttggcttgctccggtgcaggtaaaggtgttatcggtatctgacaaaaatttggaatatgctgaaaaagtatatcagaagctgtcagaacttggaatacgctgtgaattggattccagaaacgaaaaaatagggtatatgatacgagaggcaaggcagatagacagagttccgtatatgctgattatcggcggaagagaagcagaaaatgaaaccgtttcggtcagggacagagcaacagaccaaacggaaagtatgacctttcaggaatttgctgaacgtatacagtatgagataacaaaaagattataaaataactgttaaaacccccttatggtagtttttattctgccataagggggtcgtttttttgctgaccgttttaattacagtttttaatggtgttgttcattttttgttctgtctgcataaacctaatcacggttaccggaaacagttaaacttttattcagatatatcaggcgggccgaaattataaatttcataatacgactcaagttctgcgtcggttataggctcaacctggataagaccggtgcagtcaccgctgctgcaggcgttgccgaggttaaactttccttctatatctttaagcttttttcttttttcaaattctttcataaagcttcagctccttaaatacttatattcttagtattttgtctgcggcgttattctaaaatttgttgcggttgttattgaaaataaaaaaatgcctattgacccaattatatatttcccacttatatcttaaaatatactttaaataaaaaaacaaaggtttcttgtgttttttaccaattttgctgcgaaaaattttaccattatgacattgaaaatcaggcgtttatctgctataataatttgtataaattttatattatttatttaatatgtcaaatatttttatttattatctcctaaatgtttttgatgtttaaattataaaatagagagggtattttatataatattgaaaaaatttagggtttaagttattaattagtcgaaaggggataatcactttggtaaaaggcaatgttgttgtaggtcagtccgggggtccgacctctgttattaattcaagtttggttggtgtatttaaagccgcaaaggatgcgggagtagaaaaaatatatggtatgagaaacggaatcgaagggtttttaaataaaaaagtcgttgatatgtccgaatacgtaaaaaatgaactggacattgagcttctaaagcgcaccccgtcgtcttttttgggtacatgccgttttaaactgccgtctgtggaggaaagcgaggcaacatataaattattgttcagtattatggaagagcttgatataaaatatttcttctatataggcggaaacgattcaatggacactataaaaaagctgtcaaattatgctgaagaaatcggaagcgatattaggtttatgggagtgccgaaaactattgataacgacctggctgttacagaccacacaccgggttatggaagcgctgcaaaatatatagcgtcggcgctgaaagagataatacgcgacgtaaacacttatcccacagaatcggttacggttgtggaaattatgggcagaaacgccggctggctcactgcagcggcagctctttcaagggctgaagactgtcctggacccgatctaatttatctgccggaagtaacttttgactacgacagatttttagagcaggtgaaggctgttaaaaagaaaaaaacctctgtagttattgcggtttccgagggaataaagctggctaacggcgaatatgtttgtgaagacaataaacaggcgacctttgaggattctttcggtcataaatcacttggcggaaccgctttatatttggcggattttattggcgccaacttaggtgttaagtccaggggtattgtgttcagcacgcttcagagatgcgcgtcgcacatagtgtcaagacgtgacattaccgaggcttttatggctgggagcgaggctgttcaggcggccttaaacggcgagacaggcaagatgattatatttaccaggacgtcaaacgagccatataatataatatgctctacatatgatgtaaataaaatagccaatattgaaaaggttgttcctgacgagtggataataaatgacggaacatatgtttcggatgaatttttggcatactgccgtccgcttataataggagaactgactccgtttatggttgacggactgccgcgtcatttgttccttgattaatttgttctttgaataatatagattatttgttaacttaaattataataagatatagatttgttagggttataatagttggctattacaaggaattaaaggtcttgtttaattaagatggcgtgtttctttattataaggttatactgagatttgtcagaagcgccggagcatatcggctattaataaaagcagcctcaggaactgaggggtgctaattattggcggtgcggaaagcatagtaatattttttgaatacattgatttacgaattaatatagttgaattaaaagttaaagtaaacgcaaaacaatatcagccgcacttcgtattcgttacgaagtacggctgagtttgtatatataaccaacaatgttgataagttttgagttgtggtgttaacgcacactgttattttttgtttctacgcataaaagaaatgggctgtaactttcctgttgactttgtgacccgtaagaaaagatatttcgagttcgtattgtcttaattaactaaaaaatcggagttttagcgaacatcggaagggcgcatttatgcgcctcgttaggtgagctatcatctgaacacgcagtgttcaatatataaatttgatatataatattttgtttattaaaaataatatatatctactatgtatatgaccccatataatatatattattttacttataataggtgtttgaaccatttctttttatttgagtatacataataatgacattgcaggttatggcaaaataagaacatatgtatagcacacactttcaaggaaagtgtggtcgcactcgcaagaaaaagaaacgcttcacctgtgaccacacctgaaaggtgtgtgtaataaaaagttacttgttttaaataacctacaatgtcattattatgaatatgcaacaatttgttataatacctttatatttatcttttccgcgactgcgcgccttacgcggcagattacatctgccctaccgatgcttgctataccgaaattatatatatataactttttatttaaaatattttcttatatgctgagttttttagtgaacttcgggagggtgtgcgcaagcacacctcgttaggtgagccatcatatcacgcgcagcgtgaacatatatgcaacaatttgttataatacctttatatttatcttttccgcgactgcgcgccttacgcggcagattacatctgccctaccgatgcttgctattccactttttatatataactttttattttaaaatattttcttatatgctaagttttgttagtgaacttcgggaggacgcgcttgcgcgtctcgttaggcgagccatcatctcacgcgcagcgtgaacatacttgcaacagtttgttataatccttttaatatttgacatttccgtcttatcttattgtagtatttctttgcctttttaatgaatatcggaaggcttaaatattgccttccgatatttatttaccttacacgctttcttatataaatataagaatatcaaaattttattattctatattataactaaaatggttccgcacaacgagcgggcggaaccatgactgctaattctgcttatttatctgctgtccttttatcaaaggatatgagactaaatccttactttccaaatcctcgttatacatatttacagctgagatttggctgttttcatacgttgtataataatatattcctttatccatattgcagcaggagctgtatattgtgatttcatattttccctcctgcatacatacacatcccctctgctgtgcaacagacccgagaatgtgaaaaaactgactgatactttcagattccgaccagcctgatattgagtttaattttgtaaacgctgctttcacaaaacgggaaactgacgataaatccccaggaagaccaatccctcccataccgctgcaatactcctttaacttcaccttatttgaaaactcatttgttggctcttttttggaaactttcatatagttatttaaattaaacatctgaaaatcaaatgtgggattgtttgttaaaactcccacggaattgtcgtaaacttttatcccctcttttacacactccactgtaattgagcagtccttatcagcgataagccaatgcagcggcgtggaaatcagcttcttattaaaatttacattccatatatttacatttttcagaagtttctttgtttcttcaactgtttcacactgccctaaaatccatggaataagctcatatggagcgacgttgtccttcccctccgcaaaatctttatattcggcgttatccgggaaattcagccccgctatgctcaggcctttttcattggttgcatcataataaagcggataatcatcaaccacatatgccatgccgattatagcatagtgagattccatatttttaacgctttggaatgaaaatggatagttccgcggagttattgttactgtttcagtataagaaaaataataatcaaggtttctgccaaaatagctgtcaactgttttataagttattgccgtgcacatcttatgccgcctttcgagatttattttctcttcagatttttattcaaattatatatctattatgtcttaaacagcgtattgataatcgttttaagcagtatcgtacttaaatatattaatctgattaatctgcggccccgctctgttcaaacacttaaaaactccgcttcaaatgtcattgctttataatcataagccggcgccggtacggcatttttgagtgtatttttttaaatatataaaataattttgtgtattttaaccttgaaatttctcctatcaagcagtataataacaaatactgcagaaaaaacatatatataccaatttaaaggagaagtaatatggtcacccttgataaaatataccacgcgtcacacgtcttaaaagaaatcatcagaccgaccgagcttataaaagctccgaaaatctgtcctgactgcaatctttacataaagacagaaaatcttcaggtcacaggttcctttaaggtcagaggcgcttattataaaatctctcagctctcagatgaggaaaagaagaaaggcgtaatcgcctgctcagccggaaaccacgctcagggcgttgctcttgccgcagccaaaaacggcattaaggcaaaaatatgtattcctgacggcgccccaatatccaaagttgaggcaaccaaaagctatggcgccgaagtctgccttgtaaaaggtgtgtatgacgacgcttacgaaaaagctgtatctttggttgaagaaacaggagccacttttatacacccatttgatgatgaaatggttattgccggccaaggttcaatagggcttgagattattgaacagctgccaaaagttgacgccgtaattgttccgataggcggaggcggtctcatcagcggcgttgggtttgccctaaaatcactggacccggatattaaaatttacggcgttcaggctgagggcgccgcttcaatggtaaaatccataaaagatgatgaaatagaaactctggaagacgttcataccatcgcagacggaatcgcggtcaagacgcccggagtcaacacttttgaaatttgcagaaaatatgtagacgacattgtaaccgtaagtgatgacgaaatatctacagctattctcgaacttattgagcgtgaaaaaatgatagcagaaggcgccggcgccacatctgttgccgccgctatgttcaacaagcttcctattaaaggaaagaatgttgtttgtcttgtttcaggcggcaacatagacgttactatactttcaagagttataaacagaggtctccaaaaagccggacgtttggctgagctggtagtagaactcactgacaaaccgggtcagctattgggagtttcagaaattatttcatcctacggtgcgaacgttgtttctttggagcataaccgttcggatgaaagacttgatataaacgactgcgtgctcagaatatccatagagacaagaaaccaggaacatttggatgaaataaaagacgcccttgtaaacggcggatttaaaattaaataaatcattattcaaagataaatattacaggaggtataatgatgaacaaaatacacacaaataacgcaccggaagctataggaccttactcacaggcagttgaatgcggagggctcatatatacgtccggacagattgctataaatcccgaaagcggacagattgaaagcaatgacataaaaggtcagacaacgcaggttatgaagaatctgactgcagtgcttgaagcggccggaagctcagtagacaaggcgataaaaacagtttgctttttagcggacatgaatgattttgcctcattcaatgagatttacggagaatatttcacatccaagcctgcacgctcctgcgtagctgttaagcagcttcccaaaaatgcgcttgtagaagtggaagttatagccgaaaaataataaaacaaattatagttaaagtctatgctgaataatttaaataatgtgaactgttcagattcaacatgcaataaaatatcataatacatttatagcatatttaattttaagcatattaaagacatccagtggcaatattgccactggatgtctttatcttgtataattaattaataaaactatatctacagaaaccgcacataacgtctgccttactcctatatagaaaattaaaagccaaatacttttactgcatttcaaatgcgcctttgggacaaaacttcatacattttccgcacagtatgcacaagtcataatttatctgcggtaatgaatgactgtctttttgggtaattgcattcttagggcagacttttattgacgggcatttgtggttttgcggacacttatctttatttataattactttcatagctatgtatctcctttttattatttttaccgcaaacattaacctgccgcggatttacagcattaatatactattattcagagggcttgtcaattattgatacacaattacatttatttaccactcctttttgacttcttcctctttaattaaatatgttcaaagaatttaaaggttctataaaaaactctgacattcacaacagaaccattataatttttatttttagtcttataaatactgcacattcaggattttgttttaatgtataacgttttttataattattaaaaactacctcctctctttccttatataattaactttaaatcaatctaaattataaattgatttataaaattagtactgaagatatgctgtataaaatgtctatatttattttttattcaatatttactattttttacatcagtaataaaattatatatattttttcattaattcaacatatttattgtacaagttaaataaatatttttcgacaaactattgctatttctcatataatatattataatataaaaatatattagattaacaggagggagagaatatgaaaataaaaagaaccttttgcacatatattttattcttttccttattttttgcggtcacatttgcatgtacggctgtctgttctgctgaaaacaacagaacaataaaggtaggatatcctatacaaagtttaatgaccgattttgatgaaaatggaaattatactggatatacctacgaatatcttgaagaaatagcccaatataccggatggagttatgaatttgttgaagttccgggcacagccggcgaacaggtctccgctcttatggaaatgctgaaaaatggagaaatagacctgatgggaacaacgctttatgacgaaagcataaaccgggaatttgcctataccggtcatagttatggttctgttgagacggttctgcaaactttaatcggtcaaagtaatgataccgccgttgactcaattgttatacaaaatatgcgtatagccgttacgtcagatacagatgaacaacatatacgcgaatttaatgaatactgtgatatgaatctgattacacctgagtttgttgtctgcgcaaattatgaagaccaaatagacgcactgaaaacaggccgtgccgacgctatgctcagcaccagtttgagtgcttctgatgaacttaaaacaatagcaagttttgctcctaagcaattttattttatattatcaaaaaataacgcatatagcagtcttatggctgaactaaatgaggcaatgcttgatattgaagccgcagacccatactttacgggaaagctttataataaatattttgtttcagacgataaaaaaataaaactttcagatgaggaacttgaatatatcaaggtagccggtccaatacgggtaggagttgatacaagccgtccgccgtttgaatacaaaaataaaaataccggagaactgaaaggtatctctatagagttattgaattatatatcagaaaaaacaaatcttcattttatatttaaagaagcaaaaaatcaggacgaattatataaaatggtcaaagacggcactgtcgacataatagcagaaatgaattatgactatgataccgccagagaaaacgggctcgcaatgtcgcgtccttatacctcaagtcagtatcttctgattatgggagataatcagagtcaggaaaatattgtaggaaaacggcttgcgcttcctaaatattctttatacaagggagagaccattggaaaagttacgtggtatgattctgtttatgactgcctgattgcggtaaaaaacggcagagaagactacacttatataaactctctgaccgccgaatattatctcagccagcccggatatgaaaacttgaatatgatacctcaaacatatacgcctgcagtttcttgttttggatttcataaacccgtaaacaaaaccctgctgagcataatgaataaattaatactgacaatatctgaaaacgagcttcaggccataataaatattaacacaatacagcaaagagattataactttgaatattatatttcaaaatatcctatacagataatttccggtatagccggtatagccggtatatttttaattataatgcttctgttgataataatactggttcagcgcaacagacgaaataaagaaatgcagatagaccttcaaaagcacctcagcttatattcagtttctaacgactatttttttgaatatgactttaagaaaaacaaaatggtattcaacaatcctgatttaagcagacaagatgattcaaaactgatagaatacatttttaatgacgcagaccatgagatgtcagagaaaaaaatggaaggccgagacgcttttctaaatataatacaaagcggcaaagacggagttattgaagcgcaaatatattgctttgacgagaacctgcactggctgcgcataacaatggaaaccatacgcgacgataatggaatgcctctctatgctgtaggcagaatcaatataatcgacgaagagaaaaatgcagaagaaagtttgcttgaccaagcacagcgcgacagcctgactcatatctataacaacgaaacaagccgaagactgatttctaaaagtttgaccgaactaaccgaagccgatatgagcgccctgctgattttagatcttgacaattttaaaaatatcaatgacacatacggtcatctatggggagataaaatgcttcgcgcagttgccgatttactgaaaaacagttttcgttccaacgatatagtcgcacgtcccggcggagatgaatttttggtttacatgagcaagataagggatacaaaatcacttgctgaaaaatgcgcttccctgtgcagttcagttcacaatataaaacttgatgacagcaatcacttaaccataagcatgggtgtagcggtcgcaagagccggaatgtattatgacgttttatatcagactgccgaccaggcactttacaggtcaaaaaattcaggacgggataaatttgaaatagtggagtagcgcacatattagacgcgatgtaaataacacaagcatttgttcaaaattaaattttaacttgattataaatgagttcggtaatataccgggctcattccttttattttaataatattctattgctttattttataatattcttcatgtctgccacatctatttaccgcccaaatatcatatctacatattggacagaaataataaagtcaagtaaaataaataaattctatagtaaacagtatttttagtgaactgcggcagggcaaactttgtttgccgcgttaggtgagccatcatctcacgcaaagcgtgaacatacttggaaaagattgtattaatccttttttattacatgttttcacatgactgcgcgcctaacgcggcgtacttcgtacgtattgcgtattcatattattgacattgtaggtaaatcaaaacaagttattttgtatcacacccaccatactggtggggtcacagacattgtaggttatcaaaacatgttactttgaataacatccaccttttcaggtggagtcatacctaccgatgcttgctacaccgcattttatataactttttatttaaaatattttcatatgctgagtttttagtgaacatcggtaggtgtgaccacactttttttaaaagtgtgtgtaatacatactaacttgttttgccattacatgcaatgtcattagtatgtatactcaatgcagacaacgtctgcttcgttaggtgagccaccatctcacgcgtagcgtgaacatacttggaaaagattgtattaatcctttttgattacaaatttctccgtggctgcgcgcctaacgcggcagagtgtaaccacagccctaccatagttcgccatgtgaaaaccttaacagttctgttcattatattgtgacctctacataaatgactatataatttattactttattaaaaaaatataaataactcttgacaagcttaactgtaactgttataatcacagtataatctgtaattaatttagttacagattaaattttaggaggtgctttatatgaaatatgacgctgtaattatcggattcggcaaaggcggtaaaacacttgccgggaaactcgccaaaacaggaaagagtgttgctcttattgagaaagatccaaacatgtacggcggaacatgtataaacgttggatgtattccatccaaatccctaatacacagtgccgcttctgccaatccatatggagacgcagctgaaaaagcaaaaaaataccgtgaagctatagaagaaaaacgaagattgaccaaaatgcttagaacaaaaaattatgataaattggcttcctctcctaacataacaatttataacggcacagcccgatttgcagaaagatctaagattgaagttaaaaccggcggcaaatctattatcattgagggagataaaatatttatcaataccggttcaacgccgcgcatacctcctataagcggcctatcaacaacatccggaatatacacgagcgcggaacttatggatttagatacatttcctgaaaagctcactataatcggcggcggatacataggggtggaatttgcctctatgttcagcaattttggaagcgatgtcactgtgattcaagacggtgaaacattcttgccccttgaggacgatgatatagccggagaaataaaagctattcttgaaaagagcggcgtaacattcagacttggagccaaaattaaatatgttgatgaaggacccaaagtggtttttgaatggaataaacaagaatacagtctcgaatccgacgcagttcttgcagcaaccggacgtattcccaacacttccgaactcaactgtcaggcggcgggcatagagttaacctccaaacaagctgtcaaggtcgaccaaaatcttcgtactacagcagaaaacgtttgggctatgggagacgtgaccggcggacttcagcacacatatatatcccttgatgattcaagaatagtatggtctcaattgtcaggctcaggaaattatacagctgacagcagaaggaatgttccatacagcgtatttttatcaactccgtattcaagagttggtatgaacgaaaaagaagcgcaaaaatccggcatagattatatcaccgcagcacttccggtttcagctattccaaaagctcaggttctcaaatccactgacggtatactaaaagcgctgatagataaaaatacaaataagatattgggagctatgctgttatgcgctgaatcctatgaggttataaacattatcaaactggctatggatatggacgcggattacaccgttctgcgggaccgtatatttacgcacccaactatggcagaagctttaaacgaccttttcactttatgacaaaataaagaattgactaatccgcagtatctataaaccgtatatcaacgtctcttaaagagatgtaaaatactataattttattataagaggaggtaaaacatgaaacgtaaaataataatttgtttcattttaacagctataactcttctatcctcatgcgccgcaaaaagtgtaggcattattccttcctctgaaactcctgattctgccgccggagcgtaccacaaaatctcatccgaagaagcgaaaatcatgatggagagcggcggagttactgttgttgatgtaagaagaccggaagaatacgcagaaaaacatatccccggagcaatacttgtgtcaaatgaaactattgcagaaaaatcagacgaaatgctccctgacaaagaggcggttctgcttatatactgccacacaggagtgagaagcaaacaggcctctgataaactgataaaactaggttataaaaatatttatgactttggcggtatagcagactggcaatacgaaacggaaagcggtgtgacagaatgaacagtgaatttattgtagcagtacacgcaatggtatttcttcatcataaagcggacactttgtccagcgaaacacttgccgaaaacgtctgcacaaaccctgtgagaatacgtcgagtgcttgcgaaactgaaaaaggccggactagttgaaactcgcgaaggcagaacagccggtggatattcatatcaaaagactaggcaagtaaccttgggtcaaatagcaaaggctttaaacgtaaagtttgccgacactacctggcacagcggcaacaaggaaatgaactgtcaggtagcgtccggtatggcaggatatatcgacaatctctattcaagtctgaatcatctctgcgacgaatatttagatacgataaccattgcggacgtggaaagagaattatttaaaaaggaataatttgaaggcatgatatttatatttttcactttgcctatatgtgatataaaataaatgcagactcaaaaaactatttagaaaattaccggcagactgttttatttataccatgatgatagtctaaggtatataaaaaaatattttaaaaaaataaattataaaaatacggtttagtaagcatcggagggcaaacgcagtttgccgcgttaggcgcgcagtcgcggaaaagacaaatataaaaagaattataacaaactgttccaaatatgttcacgctacgcgtgagatgtctgctcacctaacgagacgcgcaagcgcgtccttccgatgttcactaaaaaactccgcatataagaaaagttagaaaggctatagcctttccgtcacttttacctctttgcaggaaaatcccacgcagagtttatatgcgacaacgtgtcgctgcactgtcgaagggcgcaagccttgcaccgcaggaaatcaaaatcgacttggcggttttgcccgccgccagcttgtatttgcggtattgcttgaccgcgaagtgatccgggtcacgggcttccagttcatcgaacatgacatccacgggatttttgaaggtctcatcgtcctctctggcttccgaggcattgatcatttcgagcagggtagtaaagtttttctcgtgatcgggtgcctcataccagatgtagccgatgagagctgtgtagtagagcttttccgccttgacccagaaatcttcgccggacttatcgccgtctcccttcgtgttgacgatgatcgtattggccagcttgaggatgtccttctcgctgcgaatgtagctgaacgggttgtagtgcatggatttccggaaattgatggtgttcagcgacttgatgacgtagccgcccttttcaagcatcttgccgcactccaccagcaccgtacccttcgggtcagtcacaacgtagctgctgtgcatctgcatcaggttaggtttgacgaaaaagcgcgtcttgcctgagccggaaccgccgatgacgaggatgttcttgttgcgggcgtattttggctgctttggacggctgttcatggtcaggaactccgtctgcgtcagaatgacgttgttggagaactccgggtccatgtacggcttgatgtcctctggcttgccccagcgggcagatccgtattcttcgccctgccggaacttcttgcggtttttgcccttgacgtagactgccagcttgagcagcacgccagccgacagaccgatgagaagatcgacgggatgaaagctgggcagcggatttgcaaaggcagagccgaacacggcaaagccgtttgtcagcttgtcgatgaacgctgcgccgggggcgagacgaaacacggcggcgatcttatccgcgaagtagaaggcgaagacatacggaaggttcagaagaatgagcttcttcacatcgggtttgttcacagctccacaccccgatccttggttttgaccttgaccttctccttgtgctgcgccttgctctgggctttctcctgatccagcttgtgccggatggacggctgttccttctgcttgaccgttttggcggagaactccttgaaggcggcggtcatcacatcaacgtcccgtcccttgaagaagacaagatagctgggcggctcaacggaaacgtctttcttgagcgcaaagtccagaccgtatttgctggcggtccgctcaaaggatttgatgttgccatccgtcacttcgatgttggagatggcggcattctggctcatcagatgcttgatggactgcttgccgcgataggttttaggctgcttcatctgcttctgcgccttctcgatctcctgaacgaacttgtccagagcctttttcagcacctcagcggagattttaccgcccttgatcatgattgcaacaactttggtgttgacttcatcctgcattgctgcgtttacctcctttccttggaatgattatggggactgctgccgacgctaaggcggcacaatccggcgatagatgattttcatttacactgtcctcctttccgagcaatgctcacgatggtattcattaaagagtgtcttcacaaaggctataatcgtaggtcttcggcttctttgaccctgctgatctgtcctgcccgtagaaatcatggttgacgagggcggagtagtaattgtctatcgtcagagaggcgttatacagagcggtcaacaggtacgcccggatattacggatgtctgacgggttcttgttcattgcttccagaacgtactcaatgtggctgctattcagcttgagaaagcgggacttaaccacttgctgcggcatatcctcgccattgatacggatggtcggagcggtagagcagacggcatccagcatgatgtccatgatctcccggaagcggtctttatcgaacttcggatcctgacagagaatgtcgtaatcaagattctctttgataatctcttcatactcgcttcgctcatccatcctgtccatcccatcaagattgatggattgatagttctttgagagagtatttctttcttgggtaattacttgatcagtatttatttgtgcgtacttatccccgcgtggattatccacatctggcttctccacacatggattttccgtgtgtggcttttcccgttctggtgtagactcctgcggctcttcgtatatctcaaagattgtgttgctcatcctgcctttaccgtctctctgccggtgccggacaaggtagccgtgcttttcaagctcacggagcgcggagagaatggcatccggaccttccttgcagattgcagaaagtcccttggttgagaacttccagccatcattaaacgagagcatctttgagagaagaccgactgccttgagtgacaggctcttgtctcgaaggtggaagttcgccatgaccgtatagccacgattcttgtttacgcgatagactgccacagaaatcaccttgccatcttggaaagcagctcttcgccgcactttttctggaacttcattcggatgacatccttgcccttcggcgtgaagtaggtctgagaaccggtgtagcagtacgtcacaaaatcgcggacgataaacagtccggcattgctgtccttgttgtagggaagaagctgaccggagggagatcggaacaggtacttctccctgagaagaaactggacgaacttgcgctccgggattttcagttccttcgccgtcgttcggatattggtgcagtcatccggattgatgaaggcgtcgtagtaatcggctttgggctttgccgtgttcagctcacactcaagagcctttacgcgattcttttccagaatcaacgcctgagcaaactccacaatgaccgctggttccttctgaatacgttccagaagggagtccgtcatgtagccgccggtcttgcggatcatggggatgacatcatgtgtgatccagcgtttgaaggctttggcttcgggcttacggctgctcagaataagcgtgtaaagtccaggttcgttcaccaccgtcatgttgggattgcctcgtttattaccctcatttgaaatgagggtaatcatcttctcgtccgcatccagccgtgaaatggcttgtgacgaattgccgatctccaaagccctgcatacgtctaccgccacaaaccacggctcgttttcgatcagggctgttcggatttctccaaactgttcattcttgaagacttcgattttgttatccatgattgacttcctttccggcagcagatgtgccactttggtttttgagggtagaaacgggattgcagcagtagggacactctgcaaacacgcaggactgatatttccagaaggggcgatgaaagcggcagcttcggcactcagggagaatgccatccgcgccgctgtcaaaatgctcaaagccgggtgtggtctgcatcagcaattccagtgcttgaagatcaccggctgtcatgcgtttcatgcttaaaaactcctttctttcgccgcatcgccagcaaatactccggcttttgggcaacaaaaaaagagggtttgcttcttactccaaattggagaagaaacaaaccctcttcgtttacgatgtagttcagatgatttctcggatggtatgaatgataccgagcagcagcccgatgaagaaggcgagtcctccgatgagaccgcctatgattaagttcaatgcgaaaatgccgactgagccggagatgccgtaaccgcttggaacgagccagaggcacatcctccggatgccgaatggcaagccgacgcagatccacattaggaagtagtcgcatacgccgtcaggcatatagatcggcttgagaaatgacgcgaggcagaacgcaagcgcgattggaagcacaacttccttcaagaagactttgatagcacccactatatcctccttctgccggaagtgtgcagcggcaccctccggcttgcttgattattgtgaaagtcctttgttttcggtcaaaaaaagaagggactaagccagaatgccttggttttcaaggtctttctgatttagtcctattatcgcacaataatcctttaccatgatacagtcaattcggtttgcacgtaccagatcaagaagttcctgaacagcagggcgttcaaaatttgccccactatacccgttatctacaaactccatcagttctgcatttccgtattcttctaagccggcagcgtgttcttgaaggatcatgcgctggctggaaatacttaaactgtctgttttgaaatcttccaaagacagacggatatatagagcaatcacatattttttcattgtgccaccgccttgctgtattcctgaaactctgtacggaagcggaatctgatagagacatgtttatcgtgatccacttcaatacgctcaattaaacgtgatacaagctctgcagttaatgtacatccagctttcagttctttttcgtctttttcaagcgtcttatactgttcaaactgtttttttatctctatggctactttttcacattctgcaagttctgctttggcagagctcattttatcttcatagttctttttccaaagaaagaaatcgtctttatctaccaggccgcttaccatatcttcgtacaatacctgaatacgatcctggttctgctggatcatacggctggcggtattgcggcgatcctgcaattctttttcccttttacgccattgggttccatcctcaactaaaagggcataatctcctaaagcagcggagagttcctttttcagaatgtcgatcacagtatctatcaattcattttcttttatggaaacaccgacacatttttccttatgaaccctgctgggagtaaggcattgaaaacggtaaacatctcccttttttcggcgtgctctttggcggtgcagacttctgccacaatgagaacagaagatcaatcctttaaaaatatttggagaatatggaatcttttcttgttgtttgtatttttcggcaacttctattcggtacttctggacctcatcaaaaacttccctggaaactatggcttcgtgggtaccggcgacagaaataaggttttcttttcctgcaggtctttgtttatgtgcaacagtttttgtatggccctgaaccatatcgccggtatatttttcttctttaaggatcttcattatggtacgtgtctgccagaaaccttctcctattaaattttcatgcgtgatttccccggtagaatacttataattgcttggtgcaggatagccgccttcattcagcatcagtacaatgcggttcagaccaactttttcatatgcccattgaaagatctgctggacaaccggagctgccaccggatccacaatcagcttatggcagtcatcaggatcctttttatatccaaaaggtgcacgagcgccaacaaattttccctctttcatatcctgtcttgcctgtgctttaatcttacgaccaatatcgagtgaataggcttcgtttatcatatttttcagaggaaggataattccaccgtgcaggttatcaggattttcggaatcaaactgatctgttacagcgataaacctgacattatgagaaggaaaatactgttctatgtagtatccgctgtcaatggagttacgcccaagacgagacagatcctttacgattacacagtcgatttttccggcttcaatgtcagagagcatacgctgaaatccctcacggttaaaattggttccggttgtaccattatctatgtaagtatcataaatgcgaaattccggtttgttggaaaggtagtccttcagaaccattttctgtgtttcgatagaattaccacgctttttgttatcttccacagataagcggatatataaagcggtattgataaacggagaaaccgatgtaaaaataggttctgcgatatgttttctgctctttcttgccatcttagaccaccatcctttcctgtgccggagcaatcagagaaattgctttctcatattcattctgatagttaaattcaatttgaaattcatttttcccaactaccttgatactgtgaacaagctggatcattacctttcggtccagttcttcgatttcagaaaatctcttgaagttctcaatccagcggttacgttcactgcggttttccataacatctgtccgtttttcttctaaagcggctattgcctgttcaagctgagcgatacgaacattgtaggtgttcttcaaatttaaaaactcatgcttctcgatcaatccgcttaccatattttcataaagactggttttgaatgtccgtatctgctccaactgctgattgttctgcgcgatctgtctgctgtattcccggatcagttctttattgatacggctctgattgataccggataaaatttcttccaaagaaacaacattattaacaaatccttttacactatccctgacacattccatcaggtcgctttcctttaccataacagggtttgtacagccactcttcttcccggtagggcaatagtagtagtggtactctttgtctttatagcggtttgtctttcgtatcatacgggcgccacagcagccacagatcaatatgccggaaaataaatagactttatttttaccgggagaagtacgggtatccagttgccggatcttctgcaccaggtcaaaatcgtggggctcaataatcgcttcgtgagcgtgttccacacgaatccattcggactgaggacggttttcaatttccttcagtttaaagtgctgtgagccttgttttccctgaaccagagtgccggtataagtttcgtcctgcaaaatacggacaatcgtagtagaggaccaccgacaatcttttcgatcggtatatccgtttcttgcacaaggcagaccattcattttcttataggcaagaggagaaagtgttcctaaacggttcagctcatttgcaatcgcataaggactgaaaccttccaggcgcatcctgaaaatacttcgtaccacctgagcggcatattcatctaccacaaggagattatgattttcttcggatttacgatagccgtacacggtaaaagcaccgacaaaatctccatttttacgttttgtttcaagagaactgcgggttttcaaagaaatatcgcgtgcgtaagcctcgttcataatgttttttacggagaccgtaaggtcatccccggcggactcattgattgtgtcgatattatcgttgatagcaataaaacgtacaccataagccggaaaaacacgtctcatataacggccggtttcaatatactcacgtccaagtctggaaagatcctttacaatcacacagttgatctttccctccataatgtcatccatcatttctttgaaagccgggcgatcaaaaatcacaccgctataaccgtcgtccactcgttccgaaacaagttcgatctccgggtggtggttggcaaattcctcaatcagctttctttggtttccaacactgtcactttcgtttgacttatcatccgtataagataatcggatatacttcgcagctttataaatctgcatacaaaaacactcctttcattacggaaaaatccccgcaattcaaggagtgcaatatgccttattgttattcaattccttttccgattcttattataacgctccacgcgggaaaaaacagcccctaaaatgtaaatttttatcgtaagataccatgcagacattcttctaatgtagctccgtccgtacaataagtagcacgcacaataaactttccacacctgaaatgacaggggttcttgatctgtctgacgaactcggcaattcgttcttcacgcggaagttccttgttgacggatacactgcgaatatccaccaggttatcatcataagaagtcttttgttccatttttccagctcctttccgtaaattgattctctatcaaaatcacatggataaagccggacctggacttgtaatctaagcccggcttcatagtatctgatttcgattttatatgccgtatttgccacgcatccccggcaggttctgttgacacagaacaggggttgctatgggctgcggacagcttgaccgcatcatagccccgcagtcgtcgccgctttgccagagcaagcgcacgccgcaggaactccccccaagtctttaggaggccgtgaagaagtaccattgtcatctgcgccgtcgtcgcgcccgaacctgccacagccgggttaataggttgcgtggatcgctcggacaaccgggttcatcacctcctttggctgtctgtcatggcgccgccctatatgccgctcggtacgcagaatgatgtacccatagcaacgtatattcacttgtcaaagaaccatgagggagagaaggcaatcaaagcgatccatattggaaatatatcggaacggttctgtccgatccaaccacaatggcttgtcctgccaaaaggtcccttcataatacagtacatttttaagggaaaagttagtgggcttataaattattttttaaaaaatattcttgaagctgttttaaacctctgttaatgctctgatgaactgagattttactgcagttttccactctggcaatttccgtttggctcatgccgagaaaataacgtgcatagatcctctgacgttgtttttctgatagagtagcaagtcccttatagatcatttcagtcaccctatgctgttcataaatatctgctggtgatttttgatctacaagggcttcatattcaattccatctccaaaatccaaagaaaaatatgctttgtgtcgatatgtataaatccgatatgcttcatcgcgtaatttataagctcttaaaatatcagcgacttcatccggtacttctacgattgtgtctgttgtgtaaaatgggtaatattcctttaaattgatttgtttcatataaatttcctccaatttcgatttgtttgcgtgtgaaaagctaaaaccgaaatcagagggcggggagcgacaccccacagagaacagaaagacaaaaaatttttctataaacgcaaaagtgcgcgtctgtccgatgacaggcgcgcactcatacaaccctaataattgattgaaagggaaatgttggaaaatataatattttgtcgaatggaaaaaccccgcaatccaaaaccagactacggggcataatgatagatttggccggcagcatcgaggccggcatgttgacctcggtagcataaccatgccctccctccaaatcaaggagggatagacaggcttgccaattatccgcctccttctatctatttgaaggaattatacaaacttttatgctcgttcttttcttgaaatcttccagaactgtccttgttccggcaaaatctatcataaatacaattttattcatttatttttgtatataatgtatattcggttaatctaaatcaaatttatacccaactccatatacacttttaatatagtctggtacatccggcgaaaccttgagcttttgcctgagattgcttacatggttattcactgcctttcgggaaaaggaagcatattcttcttcccataccagttccgttatcatttcataggtaaatacccgtttgggatgacggatcagtagagccagaatgtcaaattccttagcagtaagagcaatcactttattttgaatcataacaagacgctgttccaaagagaaaaacagatcatctttttcgatttcaaactttgctttgccagcatttttattcatgcagcaaataacatgggaaccaaaagaacaagataaaatatctgctagtcttatttttccacactcaatatccataataaattgtttcaattcctgctgttgctttgtacttaaaaggataaacaatttttctccaatttctttaccagattccgatatatcaaacacaactaacttcccatgtcatcaccgcctttgtttctaaaatttccttcttgtattgctgtttcttttagtcgagcaaaactttcgctactgataacatgttccatccggcaggcatcgacttctgcaatttcaggatcaacaccagctgcaataagctgttccgtaaagaagcaatgacgttcataaattttttcagcaaccttgcgacctacatcggttaagtagagaaagtaatcttcatccatcgtgagaaagccgccgtctcgcaagttagccaccgcatggcacacgctgggctttgacaccttcatgtgccgggctacatctacggagcgcaccatacctaatttcttttggagaacaaggatggtttccagatagtcctccccagacgcatgaagtttcatggaacatctcctttctaaaacaatttacacagcccaaccaagactctcctgttggatatggaacagtttatggtacaatccgttctttttcatcaattcatcatgtgtaccatgttccaccagtctaccgttatcaagaacgagaatttgatcggcatccgcaacggtacgaagccggtgtgcaatcataataaccgtcttgccctccaccagttttgcaatggccctctggattaaaacctcgttttctgggtcaagggatgcggttgcctcatccagaagaataataggggcatctttcagcagagcgcgggcaatggaaatccgctgacgctcaccgccggaaagggtgctgccgttttccccaaggacagtctgataaccgtccggcaatcgctggataaattcgtcacagtatgccgcctttgccgctgtcataacctgctcctcagtagcattcatgttacctacgcggatattattaaaaacagtatcgttgaacagggttacatcctgaaatacaaaggacatacagcgcataaggtgttccggctcaatggttctgacatccataccgccaatggtaatctgaccttttcttacatcccaaaagcgggcaatcagtttggaaatcgtgctctttccactaccggagggtcctaccagagctgttatactgccagcaggaatagagaaagacacatccttgataacatcatcacggttatatccgaaagtgacatttttcagttcaatgtcatacttggatacatccttatcctcgccctccatagcgggagtggtcagcagagtacgcatacggttggtgacagttcccaagtggaacagagaagtcaactgcgaaaggatggcaaggatcggaccgtaaatttgcgtggagaacatgagcagaaccaatagaggaagcagttcaatctcgccgccggttatcagcaccgttccaatgaaaatggtgatgccaagccccgcttgcaggaccaggctggctccctgaaccagaatgccggaggccagttccaccttaatagcgatttttctcatggcttggagtgctttatccagcgtggagaaacgggaaccgccaaggccgcaggatttgatgatcttgataccttccaggtattcttgaatctggctggacgcctctaatttcacatctacctgtttgtcaaacaggcggagttgcagcttgcgtccgcaccagatgatgaggaatgtaatcggcatcgtgcagaaaatcgcaagagccattctccagtcaaaaaacgccagacaaatacaggtcagggtgacggaaataatattcgcaatcaacggcggaattgtactgctgagcatggattccatgctgctacaatcagccatcatatttgtggtaatatcagataaatctttcgtgttaaagaagctcatggggagcttgcgaagatgctctgcaatccgaagtctggtcgtgctggcctccttataggaggcaatataggttttgcggtaatcgtttttggcggccagaaagaccaggatggccgctaccactcccaatcccaataacttccacagcgcgacccacgaaattgtttctccggtaaacggcttcagtagctcccaaaagagcaggcaggctatcgttgcaggaagtagaagcgcaatattggttattgtgcaggctgtaatcgcttttttcaggtcggagtagcctttctccgacagcattaacttttctttcagcttactcatagatcacaccacctttcctgtgctaattttccagttgattgactccgtatagctgctccacatctgcgcgtattttccgcccttcttcagcaactcgtcatgagtgccggattcaatcaggcatcctttttccataacaagaatctggtcagcgttacgaatcgtagacagacgatgggcaatcattacaaccgttttattctgaattagcttttcaaaggctttttgaatcaggtactcattttccgggtcgctgaatgcagttgcttcgtccagcacaatgattggggcatcctttacgatagctcttgcaatggcaatacgctggcgttcaccacctgagagatgaacaccggtgcttccaattacagtctgataaccgtttggaagctgctcaataaattcgtggcatcttgccgcctttgccgccgcaatcacctgttcctccgtagcatctggatttcccatgcggatgttgtccaggatgctctgcttaaagaggaatgtatcctgaaacacaaagctgaccttatccatcagcgcatccagcggaatattccgaatgtcaacaccgccgatttgaatacttccatccgtcacatcataaaatcgggagatcaggttggctatggtactcttaccgccaccggaaggaccaacaacggctgttaccttgccctgaggcgcaaggaaagagacatgagccaaggctttgacctgggaatcagtttcataagaaaaactgacatcctgaaaagcaatatcatagttttggatttcagccgttgtattcttttccggcaagaccgggatacgcaagatttcatccatgcgctctacactgccatcaatctgcgtaaaggactccgagatatacataatcttattcaggatgccagaaatcgcatggacaataatcaggtagaaaatgaatgtcaacgaatactctctgaaatccgtagtgtgcatcccgatcagaacacccaccgggattaaaaacagataaatattgttgatgattgtggtaaatgcaggcatacagttttgccaacccaatgcgtactccagcacgaaagatgtatagtccgtaatggatttgctcagcctcttaaaagaatctgcggtctgattaaatgctttgatctccggcataccgcgcacatattccacagaggcgctgttcatgttttcttgggcagtctgaaagcggtgcattttttcctttgcttcgccgttgaagcccgcaaactgaacgatgaaagccagaataataccgaccagacaaaccacaccataccgccagtcaatcccaagaagaataataaccagaacaagcggcgcaaccaaagaggctacaaaatctgggagctggtgagcaataaatttctcaacgctttcaatgttttcgtccatgatttttctcagcttgccgctgcccaaggtcaaatgatacccaagtggaatttgcatgatgtgatcggcaaaggccaccttcaattcataaagcgttccaaacgctgcaatgtgggaacacaatagggcaaaaaagtaaaatacgatgttccccaaaattccagccagggcaagccagccccaggttgagattgtagaaacattcaagagcgacatatccggataaacaaacaggatttcccgaatgatgtaataaattgataaataaggtacaaaagaacaaattgcagccagtgcagccaaaaaacctgatagaaacacaagtcctttatgacctgaagccaattccaggcagcgtgccagcccggttttagccttcggctgctgtttattttgctgtgccatttctaaccctccttttggttatacccaattttttctaaaaggagctttgctcctctgatttgaaaatcatcggtaatgcaaccgttttcaaggcgtattgcccgctcacagcaggcaagcgcacactccgcgtcatgggtaatgacgataatggtgcgccccatcttcgccagtttgcggatcatccggctgacatttcgcatatttgtaccgtccagcccacttgtaggttcatcaagtatgataataggcgcttcgtgcattagggctacgccaagagccagccgctgcttttgccctcctgacagcgtagagggatgctgtttgataaacggcgtcagttccagagcctccaggatttcttccgctgcttgtttccgttccggactgacctcagcgccggtagtcagttcgtccagcaaatcctcaccgaatagctgactgtctaaatcctggggaatgtaccagacctttcctaagcggcttttgggtctgcaatgctttccgaataaaacgacttcgccggatttttctttcaaaagccctgccaagattcgccctatggtgcttttgcccgtcccgttgggaccaatcagggcaatcacttctccctgatggcattgaaagtcaatatcctcagctacaatcgttttaccaaaagagtggttcagttttttcacttccaggacaacttctttggttgccgcagactggatttctgtctgctcaatctgatgcagatcaggagtgcggagccccagcgtctgaatttcctgattagtcagagctttcatctgctgtgcggtaaattcccgcacaatttttcctttctgcacacacaggaagcggtctgccagatccatcagataataaagccggtgttccgctatgataatggtttttccctgttgtttcaaatcgcagataatgtccgcaaagcgataagtagatgcaatatccagattggcggacggttcatccatgacatagatttccgggtcaatcgcctctgccgatgctattgcaaccttctggcgcattccataagacagactgtgcagactataatccagaatgtcctgaatcttaatgtccgccgccgcccggtgaacatggttccgaatttcctcatgggaataaccgtagttttcacagccgaaagcaacctcaccagcaacctcattggcaaaaaactggctcctggggtcttggaatacattccctacgattttgccgcgctcccaggacggaatttctttcagcggtttcccgtccacaaaaacatccccgcttaattccccctcgtaaaaatagggaatcagtccgttaatcactcttgtcaaagagctttttccacttcctgatgggccggtcataacaatgacttctccggcagcaatgtctaacgatatatgttccagttgatttccgttcccgccataggaaaaggtgaggtcacggatcattatttcttttcccattccattcctcctataaaagacagcagcacacagtggctcccacgctgacaacaatcaaaaagcaatccagcgcagcaatccggctgacatagtaactttctttcttgtaggggctttcaattcccctgactatggcagaagcggctaactcgtccgcgatctttaaggagcgaaataccatcgggacaatggcgtattccaatgtgtccattgggtgtttcaaaacactgccaaccgattttaagaaaccacgaattttcatggcttctttgacttctccaaattcatgcagcacagtcggagcaaaacgaagcattacgatcaatacaagcatgatacgggtaggaatcggcattttccgcaggctggctgtcaatttcccggacgggattttagccagaagataggctggcatggcgggaagtaaaagtttgtaaatcatactgagtaacagcggagagggaatgctgacctgatactttgtttcgatcatcagccatacaatcgccgccaaatagaccgcaaaacatcccaaagcctgcttatacaagccaaaccagcagaggatcaaaaaaatccaaaaggtaaaaattccatgttcccaaaaactggttgcgagaaaggtcacgatgcaggcgcacagcgtcagaaaaagaactgtgcgcccgtcgatctggtcaatccgcctttgttttttttcttcggccatcatcctacaatgcctgctttttggaaatgctttctgagcaaccgctggccgaacaatgtaccaagaattgcaagagccgcagtaatgacaacacccagaagcatcagtgccggagaagtcaccatagagagctgcatattcaaggtatttgcatcaaaaccgctgcttgctgccatttcctgatagctgtcccaagaccaccacagcggtacggcacagcctacaaaatttccgattgagttgaccatccagccaattcggttgcgaactgcacttcggtatgtattcttgccaaccatgcataactcggcaatgagggctacaatcaagaaatagggaaccaagaacatataacccataacaccttggattagtccataaaccgcagcccaagcaaacaacaatccgtgtttgttgatacgatttgccgcaaccaaataaaatgttgctccaataaaggcatcaataccggcagagccgtataaatatactgctgggaaaggcaatgtaaccataccaatcaccattgcaattgcgaaattgatgaccatcattgcggcaatcgtcataatatcgcgaacgcctatttttttctttaccgtttgttccattccagaatcctccttaaatataatagcgtcgtgattagccataactaaccacgacactattatacagtagttcgcatccgctaactactccaaatgaaaaggcagtttcccaaaacagcccaaaagttaatttaatttttttactttacgataatcctttggaagcattctaaacacttcttgaaaagctctcgcaaacttactaatatttgaatatccaagttctccagctatttgggtgatggattgatctgtttcctgtaaataaacagccgcaagattcattttgtaattcttgatatgcgcatagggcgtgtcgccataaatctgtttgaaaatagcttgaaatgtaaccttgctcattggctctctttgcaggagttcttctatggacatttttttgtccaggttttctataagctgatgtcggacacgcttaatgatttcaatttgctctttggaataatacgttgcttcatattgatcttcaattcgcagttgtttgatatggtaaaagagttccaatagttttatacggaagtaatcttttccttccacgcctttggcagtgtataattcatcaaagatatgtaacaatcgctgtggtgtccggcataaaaaccactttttttctacttccaattcttgtccaagatttaagatatcaatattatagtaagaaaaaatttgttttgttttcgcatcaatagaatctttgtcaatcacacaactcaatccaacactatatccaaaggggaaggaatacgccgcaggaatatttgcaagagcattaatgcaaaattctccttctttcatgtggaacactttgttatttcttaactcaaactcaacacgtcctttttggtaatgccggatttcaatgatattcttattaggaataggctcatggaaaatatctgaacaattaaaatccataaaaatcaagtcaataccagggaaaaggtcatagtcatataggcttcctgttccattgcatttatactccacttgaacataatcattatacttatttttaattacagcatattccccataccattctggtttgtggagttcactcatgctcatttccacctccctatcagttgatataaactaaatatataatagtttttttggtagtttcattaccaattagaaaaaatcaccccgtgcttaatttttatttgagtaatacatcctcgctctaattcattgaaaagcaaatcactgtagagttgattgaggtaacaattattatatgtcataacaagatttcacctcttttctttttcgcgcaaaagtatctataatttcaactgtatcatcttcaccatgcagaaccgatcagaaaccgccatactgacctttgtggatagctttaagccatttttagggatgtaacgatagtatggttcctccgcaatcaccttcacattacccccgatctttgctgccagttcttccgctgaatccacataaaagaacatctgtgcatcggcatggccgacctgtttcatatattttttcttcatcatggtcatgcctcttttgttcaccgtatcaaaaacaacttccatatttccaaattgcccaatcatacgcagaagggcaatgaccttatgttcctcaaaataatgaaataatccgcctgcagtaacgagaataggagcatcaagtacatcattgcgaacttttttgatccaatcctttgcaaaggcatccccggaaatatagaattccctctctggttcgggaagaagtccccgccggtattcgatcacatgaggcagatccacggcataccagtgtgtctttccgttatcacatcggtgataggttgtctccagaccacagcccagctggacaatcgcaccgtccggtctgcgttccagaaaagcccgaataacccgatccatattaacaaaccgggaagcagaggccaagagggtatactgattctgcacattctgttcaatcaagtctaacggcagcttgttcttcaattccaatgcttttttatcatataaaatttgcgggcaatgctcactggcatagattctgcccagcatagggataaacaaggtatcctccaaaacgcctaatttttgcataaccagtcctcattttccttctttacccaagtttccaattctgactttctgtctgcagttttaccatatgggcatatacgccattcttttctgccagatcctttggtgatccttcttctgccacggtgccatcagaaaggactacgatcttatctgcgccggccactgtacgcatccgatgggcaatcaccagtaccgtcttatccgcgatcaggcgggaaagggcagtctggatcagtgtttcattctccacatcaagagaagcagtggcttcatccagaaggatgatcggagaatctttcagaaaagcccttgcaatggaaatccgctgacgctctcctccggacagttcacagccgttttccccgatattggtatgccatccatccggcagtttttccgcaaattcatccacattggcaagtttcgcagcagcaatgacctgttcatctgtggcgtctttgtttccgattcggatattttccagaattgtattgtcaaacagtgtaacatcctggaatacgatggaatacagagaaagcagtgtttccgggtcaattcgggatacatccatgcctcccacggtaatctttcctctgttaatatcccagaaccttgcagccagccgggatacggttgtttttccgccgccagatgggccgaccaaagccgtaacctctccctgttttgccgtaaaggaaacatctttcaatacggtttctccggtattgtaggcaaacccaacatggtcaaagacaatatcatacccctgattggaaagcctgtcactgccttgttggatcggatgatcgagaatctcattcatacgggcaatgttggttcgtgtactgatgactgccgcaagattctggagtgcgccctgcagagggtcatacaaacgggatactaccagaaggaacataaagaatgtaagcacggagaggctcccttgcatgagcagaacagctcccaccagcacaaccgttgcaataccaagcttcagcaccagtgacgcggaaaccacaaaagcagcaagaccaaattcattgaggatggaacgatgctccacagcacggatcttcttttccagcccttttaaatatgcctgctccgcattgttcgctttcagatcacgaactgtttcaatacactcctgtatcccgtctgcgcaggccatcttcacatccatcgctttctgattcagattttcctgaatctttgcggaaaatcccacaatcgcaaaggcaaccggcagaacccataaggcagccagcgccattctccagtccgtaaagagcagaccgatagaaatcagaaccgtagaaatgatcgaacccgcaagctcagggataaaatgtgaaaaactctgttccaggaaggtacagtccgccataatggtactggtaagatcggctaaatccttttttccgaaaaaagaaagaggtattttgcgcagatgctctgccagggtaatgcggcggataccgctttctttgtaagtggcaaaataggtcgcattgtattgaaagaaagtggtcagcagaatcaagccgatacacatcacgcagcctgccacataaaatggaattttcccaccgggaacacccccgttcatcagatcgctgaccaggtaatataaaagtcctaccgggaacataaaagacagattctgaaggacacaggccaggcagcctttgatcaggtcttttgctccctgttcagacagggcatattttttctgcagttttttgatcatatcactgcacctcctttgttaccttccattgcacggaagtctggtaatttttccacatacggctgaaaatgccgtcttttgcaagcaattcacgactgttcccgcactcggcaacctgtccgtcctgaatgacaaaaatctgatccacatttgttacggtagaaagcctgtgggcaatcataatcactgtctttccctcggaaagttttgagaaagcagcctgtacacggctttcgttatccgggtcagcaaaggcagtggcttcatccagaatgatgatcggtgcatttttcagcatcacacgggcaatggcaatccgctgctgctcgccgccggaaagatagacaccttttgtaccgatgaccgtatccgctccctgtgggagtttttccagaatatcatcgcattgtgcgtgatgaagggcagccagaacttcctcacgggtagcttccggtttccccatacgcacattttccagaatagacgccttgatcagacggctgttctgaaatacgaaagacaccgtattcatgagtttctctttcggaatgtctttcacattgacaccaccgatttttaccatcccgctctggggatcaaagaatcgggaaatcaggttggcaagggttgttttaccaccgccggacgggccgacaaaagctacggttcggccttcaggaatggtcaatgaaatatcttttaatacttctttttctccatcatagctgaaatgaaccgatttcagttccacggaagcattttgcgggtgcattgggtgtttggtttcctccagaggcttcaaatgcaaaacgctgtcaattctctgtaaagcgtcatctacgatcatggcattttcactttggaacatgatgcgtgtcagtgtaacagaaataaccggcgtaataatgatatagaaaatgagatccagtaagaaaccggaagttacaccgtcttgtgtcagcaacagtcctccggcgatcagtgtggcaaaaactccgttgattgcagctgtatagaacatcatcggtgtccgaagctgcttggtataggcgatcacccatactttatagcggtcaatggaatctttaaacttcttaaaggaaaagatcgtctgaccaaaggtttttaccaccggaataccgcggacatactctaccgcttcattggacatatcatccagcgcattctggtattctttcatcttttcctgcatctgctttccggtcattgccatcataatcagaaagcccagcacaaccggaacaaggctcaacagccccagtctccagtcaaacacgaacaacagcaccaaaagaccgcagggggttgcaatggcattggctctgtcgggaagctgatgggcgagataggtttcggtggctgcgctggattcgttgacgattttacgcagttttccgctgccaaatctttcggcaaatccaagaggaagcttaacaatatgctccatggtctggatacgcaggtttgtggcaatacgaaatgcccctaaatgggaacacataagcccggctatgtaaacaagcaccgccaggactgcaaacaatactgccatccagccattgccggtcaggttctgtgcctgaccaaaatctggtgccacctccagtacttccttgatcattttccagatgtaatagaatggcaccagagcaatgagggcactgatggcagaaagcacccaggaagcataggtcaggtacttatggctgcctgcaatttccagcagccgtgataaattggattgttttttcaaaaaaattcctccttttctttgtgtttatgataaagagaacacgtctatgttcttacaatatccgaatttaggttagttaatgctaacttacaggcaaaaattataaggcattactgccccataattttcatccatcccgccgtataaaaggcgcgcatttctctgacgtagttttcggcatctttgagcggcatttcgtggatgatcaattcaaaaaaagtatgaaacattccggtgattagaatatgctccagcgagggatcgatatgaggagaggatcttccaagtctccttaaaacatcttgataggcatgggttccatttgtttcaatttctaccatttcatcaataaactctgcaaattttgttccttccgagcagcagaggagcagtttacattcctctaaatgttcatacgcataatgaagaatatcatccatgcaaagccccgaaatatcactcatgacttccggctgctgtacagctggaagctcggcaaactcctgctgcgcttttataaaacggttgagaatatattcgtaatgctcactaacaatggcttcaaagagttcttctttgcttttatagtaaccgtaaaaagcaccggtggtcattcccacggatttcacaatatttcgtagggaagcgtctttgtatcctttttctaaaaattctgctttcgctgcccggtggatacgttctaaagtagtctgactttctttgattctattcacctccataacactgttatatatcactgttatattatatgatgtatagagagttttgtcaagaatctgtttctattttacaagttcgcaagcaatgcaatcttccgtaagattgcgtattttagaggatttcccgttgccgtgaaaccctctaaaatgcttgttggtgacatatccccaaacccctgagatcgccacctgcggtgacggctgcgcgttccttcggaacgctgaaaacccaaagcaacataaaactattgtcgggatttttgcttgtctttctgctgctcctgagacgcaggaatgtccagcagatagtccacattggccttgatattgtgaagctccttcatatcagaccgggcctgcttataggcggcataggctttccgtttctgttccagcagaccggcgtattcctctcggagcgatttgacggagggcagtttcgtgattcctatgctgtcaaaatatttcttcgccgcctggtgtaatagaatatccgcctcatgctccgcccggaactttttactataaccagccttgcggtattccacatagaccgcccgcgtcttggcatagttcacgatctgtttctgcaattctccattggcggtcatctgcgattccagttccttgatctttgccgacagtgcattaaagctgatggtagccgcagcagctttttcctgcaaatcttcatagctcatatctccatgctctttcaggtagatcaccgcctgggagagctgttttaagttaaataccttcgcccagcgttcatagcccggtcccttgccggcccggaccgctgcctcaatatccaccagcagcccaacctttggaacgggcttttgcgaaaaagtacggcggggttttgccgtgcgggtgccctcgatccgttcctgtatcgcctgctcggtatagtcgcctttcagcgtattgcaccgggtatagtttttctgccccggcacccggagccggaggttcttgcgttcccggttgacttcgattccggcagcctccagctttttcagaaattcctcaaagcctttcggcctttcttccagggccgcgtcgattgcccggcgtagctgctcctggaaggagggctgtttcgtatttcccagccatgtgccatagtggtccctgctgggttttggattttccacgatagacagaccgtgctccagacacagcttgtcattcatgcgccggatcgcccaggtagagccccagaagttgcggaatttccgggtgcagtcaagggcggtggaattgatgataatgtgattatgaacatggtgcttatccacatgggtacacaccacaaaggcatgattgccctttgtcagtttcagtgcgagctcccgcccgatctggttcgcttcttccggcgtgacttcgccgggcttgaaggcttgccggaggtggtaggcgatcacatcatctgcgccccggtcccgcccggtcaggttcaaatactgccgcttggaaagaaggaactccgcatccgcaatccgggtatcacacgcatagccataaataaattttccaaaatccgttttctgcggattctccacatagtcaatgatgtccacaatggccgtagacacatcccggccttttcccacatgcagcggcattagtcttgtggtcgctatcaggatcacccccttgtcaaaatgaaagagctgcccggaaggacagcccttagtatgtattcgttataacgccggtgtatctttttgctttggcacccgcccgccgcatttccatagcgccatcgggtgatgttcaatacgcgggagaatatcagcatcgtcaaacaaaaggcccggctgatagtttccctctgcaaaagcctgccagaaggacagctccgtatcttccggttttagaatcgcggctaaataatcctttacctgtttctgcgcggaggccaggtcaaagcgttctccacggcgcagcaccggtgtaaggtccgtcctgattttccgtgcggatatgttgccaataccatcaaggtcaaagtgttccggcacggtttccgaagcaatcgccgcgtagaacataatacactttctgaaaagcggttcctgcgtctcgtcaaacaatccatacttctgcatattgaacatatcatataaatcccgcggggccgcccggtttaagagggcaaccgtctttgcggagaagatttccagaggatcaacgcttaatactgtaagctcctgatcgttccacggcaaataaaccggtctgcgggaaacaggcagcgtatgacagcggagcatatagttgatctctattttcaggttgtctttcattcctccggcattcacatactcgtacacgaaggaatccagcgcgtggtattgctttgatttcaaactcagcgtatagccggaagccgccatgtatttttgtatgtgttcattgatctgctcccgctccgccagcatgggttcccttgatacatcctttgagaaatcgaggtctatatcaaccgacaggcggggcagatcaaaaatcgtcaaattgattgccgtgccgcctttcagggcaaggctgtccgcaagcagcccatcgctttccataaaagaaagaacgtccgcgaggcggcagaccttctcaaaggtgtcacggacaaagccgagttctttggcctgtctgccaagcgtaatacggtcaaagcgcatcataatcagttacccccttacttatgatcgttttcaaatcctttggagcaaatagtttccatctgttatgaaggacaaaatcgccctgcttttcaaaaagataggttttactggcagaagaccgtttttcacattccgcaaaaaacggttccggtaaagacagttcctctttccatacttcaagaatatatccggccttttgatatagctgcgcccggccatacagttccagcgcgtcaagcagtttgttacaatcaagcgaaggaatcaggagaaggcagcgcagcaattcttccaggcctccgatcttttcaaaatccgctatactgtctatcacggtccgctctaaagaagtcacgcggatgccggtgtctatttttatgatgtctgcatttccccggcaggccatcgggcagtaatttacgccgtcataagagaatgggcggacgcgcttttcagtggtgaagtacacatcataaaaaacttggttcgcatatccgtagtattcaaaggcgctgtggtgggacacacaggcatcgtctgtcacgcgggaagctatctggtagcggttcgggatcgcctgtccggtttccatgctgatgaccgcatatagattgcggcgcacacgctcgatatatcctttttgcagataactctttatctgccatacagcggagctttctgatccggcgagctgcaccatatcatcgtgtgtaaaacagcgcaaagcggcaagttctttgtatagttccattgcatagcctcctttttgtttttattataacgcaaagcaagagaaaatacaacggttttgaacggattcagaaataatcgttttttgaactgcacgaaacaatagggaaaatatctgttttgtgcgaatttgaaaatgtattaacgttccggctctttccgttttgttggtgcatgtacggctgccgtctgctctgtattctgttttatgctttcgcggatcgagacttttttcccatgttcctttgtataatcgagccgggcctgcgtaagaaagagatcgacaagtccggggtggctgtggtccaccacaaagtaaacattccgatcttggccgaagccgtccgggttctcgtagaccggaatggttttcgcccaggctttattatcgcgggaaatacgcccatcccaatctttttcccggaccgtgcccgcaagcacataaaacatccggtcatagccgaactgttccaaaacctgatgtactgcctccgtgccgaggcggttatcccggtagtgatcggcaatggcctgttcgattgcctccttacaggcgatatttgccttataggaagcacggtattgttccagttctccatgctcacgcgcataggaagccggataaatatatagctgtgttgtgtctttcatttgatccctccaaatagaaaatgctgccttgtgagacagccctgaatagtgaaaaagagggcgggacactgaaaatgccccgcccgtaagtttatccaaatacaaaatccttgagcgcgtggtttgctccgccaatcatcccgaccagccaggccgccgccattggcagaccgtagggacttatcagaaacgcgatcaccagccatgcaagcccggcccacactccggcagtaaagaacagcaccagcgacgccagaaatacaatgcctgataaaatccccagcaccgcgccggacacgatcaccaggaacttgcatatcagataaagaagccccgtaaccaggacaaagggaaacgccaacagtttgaatatcagacgcataagtcaagcctccttccgcgggaaaatatcatatccctctaccaaaattctaccgtgccggtttccggaaagcaacggctattttcaccgtttacgaaatgtttgcaaatccccggagcagcttatccatgctattccacaggtcatccagccgggtacgcagatcttccacatccgcagcataaacgctgccggtttcattggcacgccgggtgtactggtttaagttgttggagcagatacgaaggaggcgtatcatttcctgaatgtcgcccatatccaggtgaatgatgtaaccgtccaccgccattttgcgaagataagcggaaaggttggtgatccccagctctgccatgcgctcttttatcaaagcagactccgcctcggtcagaacaaactccacacggacagaccgcttatcccgtccgcccttcatcgttccagccccttgttcggggagggcggcttcggggaagctgcggtggctgttcgcgcttctttgagcctgccgcgcatggacgccttttttaatttttccatgtattcctgaacattgcccggctttgcatggtaatcccgtttcagccgttcccggcgcaggatcaccgccagctcccgctcgctttccggcgcgtactgcatggattttggcgtgccgtgctccggcataagctcattgatctgccgtctccgtgactggtacggcaaagtaaactgtacgccgtccttgaatgtcaccgttacccggtcaatgggacaggacagcaatttcacccgctccacatgggaagggtaatccagggggtagatggtgccggtcacttttccatcctgcaaaccatccaatgtaagggcataagctaaaatcgggtcattcgtctgctcatggtagaacatccatactttattttcattgctttcctgtagatacacctcccgctcgctcaaacaataggtgccgcagggccgtgacatccagagaaggcgccggtcctccggttctcccaataaggccagttttagaatcagctctttatccatatcaaaatcatctttataatgctgcgtatgcagttctacgacctgccccagaaagtccagcacgtcaacgccttcaaattttgtccccatactcaaagccccctttccgggacaggcggtgtgatctgcctcgcctcatactccgggcgctcggatttcaggcggtccaggacagagggcttttctttcggcaaggtctccggggcaagctcccggatttcctcgtgggtctggccgtctgtcaggtccggttttaccgggggctcgttgttcatcctgccgtccagcatattataattgccggtctgtccttcctcgtaaagctccgcgttccgtagatagctttcgggcggctggaagggctgcccggcgaacaggatttcccgctgcgcttcaaactgccggaggagaccgttttgcagccgggcaaactccgcatactgatccgctgtaagcccgcgctccagcatttccgcctgagaatgggcccagccctcaccgtagaggaaataatacatatccgcccggtctgtaataaagcacagggaaccgtcgccgttatcgtaataggaagtaagcccgtcctgatagtgatagcgttcctcacggcccagatagacccggttgtctgccgcaagcatggcgaccatgccggcataattgctgtgtaccgcggaacggatttccaccaaagggtccggctctttcggaagctgcctgccgggaatctcattcagtttttccaccgccgcgtttcgtggcgtctgttcctcatgggcacgggcagctctgtccggctgtgttccgtcctttcggacagcacccggttccggttccttttcctttacaaaatagtggacgttggcagtcgtgcggctgttacattcctttgcgtaagcctcggctgcctcctgggaagcaaattgaaggggcttgtcgtcctccttgcaccaactttccgcccgtccaaagattgaagcggcgctgcgtaccgcccatacgccgtaagtcttttctttttccatcggcacctcctgttatcgttcctgctgtttttccggttttggtcgggcagacggttccgctgttttcgtttctttaagctgctgccggagggagggcctttgttccggctccgtatctgtgatattgacgtactcgccgatgatacaaagcgcctcgccatagctgccggaagcaaatacccggtccttcatttcctttgcctggtctgtaagcccatgctcccgcaaagtgcgggcagcgatccccaccaggttaaaaatattgccatcctgcccgatcagcgcgcagtccggcttttccggctccggcgccggttccccgataaacccgcccaggcggttgggaacaaaatcagagagccatgtgccgccgaaagtatcatgggtctgtaaacgccacatggcaagttttccaatctccaggtccacaccctcaaagggatagagcagacaggtaaggccgtcatactcaaaagcggaaatatcctggaacttcgcgccgtttttcagaataccggcctcgatgaacatttcattgatcccgtcaagccattcctgcagctcgccgccgcagccctgcaagatcaggccgtcttttccctccatacggcgaaggtcctctgtttcaatatggttgatactcaaaaaatcgcctcctatcgttgttgttggttttctttcctgtgccggacagctttgccctccggcgttttctttagctgctgccggagggagggcttttgttcctctttctgtaaatccgtaaggatcgcagataagggctgttcccaccggctcccgaagccccgtaccactgttccagccagagcaccgttttccctgaacatttccagagtgtcaaaagcccggtcaaaaagagaaatgtttccggaatctacacatggggcaaagtggatcacccctttgggatagttcctgccagtcccgatccagccccgtacaaagctatcaaaatcctttatgataccagcagccgccagttcttccgcatggctgcctggaagtcccttcgtttttccaaactgttttcccaggaccagcgcaccggtctttggattgaacagaaagcgccggttgtcgatctgctgcatgtcaatggcctgcgtcccggtatcgatccgcatgatctctggcacaatcggtattttttctataggcatccctccaaactgtcataaaaatagagtgccaaaaagcgccctttgtccgcaacttaaccccatttcagaggccgggagtattctaatataggcgccccgtaaacagggccttaaaacccttgaaaacactggcttgattgagctaagttgcggacacatcatcccctgttttgccgcctgcgccgtttccgttcccgctcggatttccgtctggcaaaggtccggcaataatcggagcaatacgcctggcttgtgaccggaaggtaagcctttccgcagaccgggcatatcttctgcctgagagaagtatcttcaccggtcagggcagattccagctttggctccgtaggcagcaccgccgcccggaaataacggcagaacgcgccggtccaccatttattcagcatgaaacagggacagtccaggggaaggcagagcttatcctggcagtcatagttggcgcacagattcgttaccagcctgcggaccgccgctcgctcggatcgtgtcagttccctttccggtggggcgctcatttgcgcccgcctttcctcgccggaaattccagcttgaaattcacatacttgccgcccgtatcatccagcaccacaaccgcgtcataggtccggcctgttttttcactgtaaagcccggacatagaaacgcggccctctttcagaagggccgccgcaacggtttttgtcagggttttcttcttacctgtaaagaatttattgtctttccagagggcaaaggagcagtcccgattttcacagaaaaatccctttttgccctcatacacagtgccgccgcagcggggacaggtgccgacagcctcgcgccgggttccttttgcgtaagggaacaggccggcaaaccgttcctccggtgcggtatgttctttgacaagcgcccggttcatatcggcgatcccttccatgaaagcctccgcactgatttcgccgcgctccacctgttttagtctggattcccattccgcggtaagcagcggggatttaatattatccggcaggaccataatcaggttggttcccttttccgtgggaatgagctgttttttctttctctgcacaaagccggttgttaccagcttttccagtgtagccgcacgggtagccggggtgcctaaacccttgcgctctgcatcctccggtgcgtctgccgcgcctgccgtttccatagctgccaacagggaatcctccgtatagtgctttggcggggaggtcttgccttcccggacgcttgctgccaccggttcaaaggtctggccctgggtaagctccggcaaggccgcgtctgcggggtcctccttttccggttccgcctgtttcagccccatgcggtagagccgttcaatttccttccaacccgcctgcaagacagtctttccctttgccgtaaaggaatgacttgcacaatccagtaccgccgtgaccgcctcaaagcggtgcgtctggccggtggcgcaaaggagcctcatggcgatcagcgccaaaacatcccgttccccggaagggagagcagacaggtccgtccgggcgatctccacggtggggataatggcgtggtggtcggtaactttgctgccgtccgttacccggtcaatatccggttcacccaggcagcctttcccgaaaggcatgttgtcccgcagccacaggatcagggaggcggcggttgcctgcatatcctcggtcaaatactggctgtcggtgcggggataggtcgccagctttttctcatagagggattgcaggtaatcaagggtctgctgggcggtgtagccgtagatacggttacattcccgctgcaaggtcgtcagatcgtagaggcggggaggctgtacggtctttgtctgcttttccattgaaaggacagaagccgcctgcccgtcacatttcctgcggaccgcctctgccgcctgtttctccgccagcttatcaccggaagcagtaaaaccaccgcaggtgatcaccgggacatagaagggcttgctggtaaatgcctgaatctctgtctcgcgctgtaccaaaagcgccagcgttggggacatgacgcgcccgacattcagggtgacgccgtacaagacagaaaacagcctggtcgcattgatcccaaccagccagtccgcaccggcccggcagaccgcggcgtcatagaggcggtcataatccttaccggggcgcaggtgttcaaatccgttccggattgccgcgtcctccatactggaaatccagaggcgttccatcggtttcctgcacccggcatactcatagaccagacggaagatcagctcaccctcgcgtccggcgtcagtggcgcacaccacggaatccacccgtttgtccttcatcagccgacacaggaggtcaagctgtttcttcttgtccttcggcacctcatatttccattcgtccggcaggatcggcagatcgccatagcgccatctggcatactgttccccgtaggcttcaggctgcgccagctccagaaggtggccgacgcaccagctcaccaggtagccactgccctccagataaccgtcctttttctcatttgcgcccaataccgccgccaacgccatagcgacagagggcttttctgcaattactaatttcacttgtcatcctccatttctttgaatatagaaaaggcagccgcatagctgcccttataaactcggttcctgttttgccgctttttttgcctttggtgttttttctgcatgttcttttacctgcgctttattttctgccagccgttccaggagccctttttcctgtttccggccaagagtttttgccgcccggtcataatactgtaccttatcagaaagaaggtcagcaggagcgacctgggtcgcattcacttccttaaccatgctttccagttcccttgcctgcatatcgtcattatccggtacgatcagcacctcatgtatagacgaagggagaacatagaaattctttccaagcagctcaccgattttatccagaaccccgtcccgcgcaagaatcccggaaccgtttactttgctggtatttgtcagaacatacattggcatagtagctgcatccaacggttctgtgcgctcaaacagattttccggttttgacgagaacatgatttcgtccatcatatcttccatactgtaaaaacagacagggcttcttgctgtttctgccgcaaccgcgtcctgatgaagctgctctttagtaacaccccacaattccatcatacgatctgtaacaacagcagaggcaacaccctctttgctctccatgacctgaatccggtagaccgccgccaactctccacacggggtaaacggtttatctttcaaatactcccggttttgttcggggtcgcatagacgtatagtaagcataggcttcacttgtccgtaattcattaagtccgatacttcaaagggaatcctggtatcttgctcagttctgatctgtacgatttctcgcatgatttcattcattggccgcccctgcgcaagctgcttggtatagggttccaaatagattgtcgggacagtgatttcaccgtcgtttcggatcaaaaggccggtaagcctccggtcatttccttttgtcacttcttccagagtgatatgagcctcctgatactccggcggtaaatactcccggatatggtttttgatatattccgcaatttcagtattcattcgttatccctccgttccatattttcgtaaccttcatccgccatttttcctgcctgcatcagacagaacagcacaacgccggccactgtaccggcaataaatgcaataaagtgtgttatgatactccacataaaaatgcctcctttcgggcaaaagaaaacgcccactgttcaagtgagcgatgtgccaagtttttctatcctgttttactttttcgggagatagatttctcccacgggaatttcccgcagttcttttttcatttggtgtgcgaaacggattgtccttacggttccgccttgttctcgcccgtcatacaccgcgatcacccggtcagagtgttctaccatatagcggttgcggtgggaatagacgctgggctggtattcctcccgtatcacaaccacatcacggcaagcctccagcatttcataagtatggcctttttctttaaggttctctaaccgtttctgatacggtaatacagcgatcaattccaattctggattgtccttctgtttttccataactatttccacaaaatactgatccacgccctccgcgaccccactcatgaagcaggtaaagccatccgcaaccgctttttcaatttcatgcagcagggcagcctttacatagttgatctgattctgcggtaaatccctgtgtcccgtgacacagcatgttttctttttcatctggcacctccgataatagattaaaactaccgccttgctatattgtagtaggtttattttagcaagtcaacgcaaataccctttttcatctaccgaatatttgcctcctgtaaggtacaatctattatgcagaaggaggtgactatgatgtatgaagattttgtcccggaacggctggcaaagctaagggcgctaaagggtgtatctgcccgtgacatgtctttgtcgctgggccaggcgaacaattacatcaataacattgagaataggaagtcacttccatctatgcagtcctttttctacctttgtgaatttctcggcgtaacaccccaggaattctttgatgaaggaaatgcctgcccgcagacgctacaggaattcatggctgaggccaaaaaattggactcaaaatcaatggaatacattctcggcattatgaaagaactcaatagcaaacggtagagcggccagcggttggccgcttttctttttattgtacccggtaatgtcctgataatgtccattccctataccggcgataatccttgttttgtcctaaattgagccgtcttttgtctgacggctcaaattcctgctgcattttatcatttccctgtgctgccaaaggctccggtgccccgctgctccccaagctctgtcacaaaatccgcgatcactaccggtgtaatgacgagctggccgatccttgaacctttgggaatgtgctgcgtccggctgctcacattgctaaggattgcatggatttccccacggtagccggaatctacaggcggcagctcgcagaccagccctttgacggccatgctgctgcgggggaacacatatccggcaaacccatccggcacctcgatcccaaatcccaggggaattttcgcaatctcgccgggctgtagggtgcagtcatagggcatatacacatccgcgccggcatcgttcccatgtggccggtagggtctctgatcctccggcacgccaaaatcgatcagcttaatcttcatgggcgccgccttccataagcagcgggtaatccgccgccaaaatcccgctgggcgtcatgctgcccgcgatctttcttttgcagctcattttcccctccagacattgatctctctggcagaaagggccggtaagatcgggagcaaagagtaccgggctcaatgaaaaaagctcctgccagattttcaggagcacgatccgggtctcgtccgtattgcgccggcatacccgctggccgatgatatgtttccactggtagggcgtggcgctaataatcagcacattcctaaggccctggggcgtggcatagcccgccgcgtcgtgcccgatccctgccgcgcacagttcttcgtaacaatccatatcggatttacagctttccagatacatttcctgaattgccttcggcgcagtcaaaatctcatagggtacagcaaaatccgcctgtcccgcatagttgctgtactgtaaggacgcgctcataaactttacctcgttctggtgcctggtgatctgcgcaaggaaacgcctgcttgcgcctacaatggcaacggtgataaccgcgaatttctggaccgtggggtgcgggagcttgctgatcgccgttacggtatcattgctgaacgacttttcataaagggccgtcaggtcctccattgtattgatcttatgcccgcgctgggtaagcctggccgcaaacaccatgtttttctcggcctccgccaccgcctggcagttcaaaacctttacttcaattctgttgattggtctgtccctcctttacaatcgctttcagtaaaaacagatagttaagactgtctgtgatcttctcgtcccatgtgccggcgtcaaagctcatgccgtcggcaaagcacatgtcatacagggaaacgatatgctttgccagcatcccggcaagggcacgctccggtgtcgtgtgctgtaaagcagcggcagccttgaaagcccccagccggtccgtatcgtcccctgtgtattcctttgttttcttttgcaggatttccctgcatagagccacctgaccgtcaaaaacggcattgacctctttctgcgtgataaggcatccctcctttgaaaatggttttgtcccgaatcctgtatagaatccgtgacagtttacgcgcttggcagataaatccagtcgtgcatcaggcacacgctcggctcgtcctccctggggaccagccggtaggtacattccccgtacacggtccgcttgtcctcgatctccatttcataagccttgtaaaagcggtattcgatattggagataatacatttaagcgtctgcaatgcctcccgctgggaagtcacgatcaggtcacggtccacgctgcgctgtaggaacagcagcgacttgtaaagctgtacctccgtgcggtagggccggcagtccatcgtctccagccagtggcagaaagctaccaggccgctctcaaccagttcccgctccgggtggtaatactcgtagcagtccaggttggccgtgttcagcaggtacagcatttccctgatctcattttccggcatgtcgtaaaacctaagaagggagcggtacaaatgcacatagccgggtattgaaacaatggtattcaccatagaaaaaatcctccttgtaaatgactggtgcgggagcacatgcccccgcaccggttttcagtctgttcagttgtttacttccaccagctttgccatgacgatgaagcggctcgcgcctccgggcgtgcaggtggaaagggtcagcaccttatcgctgcttgtcaccgtgacgtccgtttccacaacagaacgctccgccatagcggtaagccaggtcgtataagcgccgtcatccttccagctaagacgccagggagaggtatcgctgccggattcggaaggctttgccacaaacgccgcgaaaacctcacagagataaccgccctccggggtcacaaggtacatctgcttatgggtatcaaagtagctctgttcgtcatactcattcagggcggcgaacatggagccgtcccgcatgttatgtccgtaaataatggtgttccggtcagaaaaatccgccttgttctcataatccgcgaacaggcatcccaccttattgtaggtgccgtcatacaggtggtgcaggtaatactcgttgtcatccgcctgcgttaccgggtagttgatcaccgtatcgggaagggtaagccacccgatgatgtccggcccgctttcccgcaaagattcaaaatccaccataggaagaaccacggaaggggctgacccagcaggttccgtttcaatgggtgcggtcccggtctccatatcctccggtgtttcggtccgctccggcagctccaccagtcctgcaaggtcatcataagccccggcgctttcactgtactggcagaggtcacggaccatcaggaagccgctgcctaacgccagtgccgcgcagagggagagggccgcaatgcccgcagcctttgtcttaggggtctgtctgctgtatttccccttcttgaaatagagggcagtaaacatcccaccgccgatcagagccagcgccagaaggccgccgtacaggaaaatgaaattgtcatcaccggtctgcggtactgccttatcaggattagacggtgtggaaggcttggacggtgttttcggattatcaggagtttccggtttttccggtttctcattaaagaactggaccgttgcggtctggtccgccttgatctccaccgtggccgcgtcaggaatgatataatccttgcttgcacgattggaaagctcggttacggtataaatgccgacgcgcagccccttgacctcgatcacgccggatttcggtgtggtgaaggtctcacagtaagaaccgtctgcgctcttgacctcaatggcaaatccgtccttgcgtccgtcactggaatctttggtgattttcaggttgccgcggtatgcctcattggtaaatccccggcctgcctcgccgttttcgattacaacggtctggccgtcctcggtgatcgcaaagtaataagccttttcgtcaggctggtagccctccggcgctttcttttcctttacgaaatagcccttagccagaagtccctccgccatgtggaatccgccgtctgtctctttcagggtgccgaccagcgtatcttcggcatccagctccttgttgccgttggtgtcctcatacagttcaaacaccgcgccggagaggaagcgcaggaaagtattctccttgtcggtctccacggaagaaggttcatccaccgcctcggtcttatggagctgcacccgtccgcggatcagggtatcgtccacacggatttcgattgcctggccgtccacaccgatataaatatggtgttcctccgggctcactgtgtagagcgcgggagcagagatttcctttacgatccagtggccgtaagggatattctcaaaggcaaagctgctgtcctcgccggtggttacggtaagcagcgcgttttcttcggtaaattcttcggtgtcaggcttaaacaggcccatcaccgcgccggccagcttcacatcttcgccaacctccgtgctctcgccatatttcacaccgtcaatgcgtccgcggagcaggtcattgggaacagcctcgccctcatttaccaggatagagacaagaacagcctcctgacccgcatattcaaaaactaccgggtatttggtatcggaaagcacataggcgctgttggtggtgcgctcctgcacataatagctgccaaacggaaggtcggaatcaaagcaagcgtcatagccgcccgcctcatttgcggaaacggagaccacttccagaagcccgcctgccgggatcacgctgccatccgccgccgtcaagtcagtggaagcatacagaccaaaggaaatgtccttgtattcctcattcatgccaagcccgaaaagctcgtctgtttccagggctttgaacagggcgacatccactttctggcgctcgtcatacaaccctactgcggtctgcgtgacctccacggtctcgcccgcgtaggtcagctccgcatattccgggacagcatttacgaccatgccagccggcgcctgccgttcttccagacggtagcggcccaggtacagaagtacgcttgtggcggttccatcttccccggtggtaagggtctctacaactgtgtcctttgctactcggagggtcccgtcgccggtataaatatcctcgtcggcgatcacatcatagaccgcaccgggaagcccggccacttcatacaccggctgatacaggccgtcgttttcctggacggaagcgaacacctcgccggtctttgtaatggtgagccggcccttctggggcatgttgtgctgtgtgacggtcacaaccgcctcgctgccgtcaatggtgaacggtacgggctcactggaaatgacataaccgtaaggagccgccacctcgtaaagttcataatccccggtatgcagaggttccggcagcatgagccagccttcgtccgaaacatagaaggtatcaagggtctccgggtttgggtagaagatttcctgggtgacaaattccccggtggaaaggtccttgatctggaagcccgtgccggtcatcggaataatgttcccggtttcggcgtcgcatttctccactttgagccttgcggtaatggtgcggttattcaggatatagctgtaggtgaagccattctcattgatgaaaaccgtaaaatcaggaatgaacgccttgccttcctcgccggctgtctggtggaccgtataatggccgtaagggagcattttggaggaagcaaagccgtcgctgtccgtggtgagcaggtcgcgctcgctttccttcgccgcttcatagctgcccgccgccttcaggtagatttcaaagaccgcgccggcctccgggcgctcgaccacaccctcattcggttcttccgtattttcatcttcggacacatccgggtccgggtcgtccgtatgcttgacaagctgaatattgccatagatcacggtttccgtgacctggttctccgtagtgttcagctccacctcgtacagcgccggggaagcgcccacctcatagaccgtatcattcagaagataaccggtgctgggctcgatttcccgtaccgtccagctatcgccgcagacatagtaacgggtcataaagctgccttccggcccggtggtataggtatctaccagctcgccattgttataaatcccataggtcgccccggcaagggtggcgtcgccctgggcggtcccggtgtccgcgtcgctctttaccacatgcacgcggaatttcttcaggatattgctgaaatggacggaagaagtctggccgctctcaatggtgatgtactgtgcggaaggggtcacatagcggtcaaccgggatttccgtcaccagataggtgccgggcaggaatttcttttccacctggccgttatccccggtagtaacagtctcattgacttcatttcccaaaatatccgtgccggaaatgcggaaggaaatgccggacacaatgccgtcctcactggtcttgacgatcttcgcggtgccgtaggtctccgttttgatgttcataaagaaggaaaccgggtcgctggcgccggtcatcatggtctgataaccagggcggccccagatcagcatgtcattggcaaccggaatatcttttctgaactcaaaactcaccggatccataatcatgttcttgctggtgaaggtgtactggttgccgttcctgctcacggtcacgccgctgccggaaagcatttgcaggtcgatattcaggttgttggtgtcggtaacagtcagggtatagacctttctgctggtgtcccatttcagttccagaacaggggcatcccccttattcgccgcggtaaaggaagggacggtggagtgggacgccacctgttccagaatccagttgtatgccttttccgcaggacgcccggcaaccacgctgtaatactggtccgccgaagcatgaccgttactgtgtctgttgtaggggtcgctccgaagctgttgctggtattcccagaggatgatctgcgttgcaatcttataatcgtcctcattgatcccggaaacaggaagggaggcgccgggtttccagccatagatcgccgtcagggtaatgccgcgcttggcagcagaagggagcatattcaggtaatcgctgttggtcccgttctccgaagtataggtattttcggaagtgttgtagggaatcccgctctccacgcagtagaccgaatgggtcacgccgtccgaatctgtcagcatgtagtgccggtaggcgctgccgccggagccggaacgtttatccgtggtcccgtctgaattgtaagcaaggaaattggtaggcgccggggaataataatgctgcccgtcagaacctacatactggtcgcccagccaggagcttgccttctggcccacgcctgccgcaaacgcctgggcgggaagcagactaaagacgcataccgcgcagagtaaaaatgccacgatcctgtgcaaaccgcggcggtgtgtattcgttttcatattcacgatagaaagacctcacttttataaaataggtaaggacggcgcattactcgccgtcctcatgggtgctatcctcaaagtcatcctcggagagatattccggttcgccgtaagcctcgtccgggtcaaagccctccccgtagccgtcgtcctcgtcaaattcgtcctcgtccgccgtctgctgcttcgggcgcacgatcttcacataatagctgacgcctccgactgcaagcagggcgacgatgataaagatgatcgtgccgacgctgccggtatctttctttggctgttccggttcagccggttcctccggctctgccggcttttcctttccggtgcagccgcttaaatcattcttgcagaccgggcagcttgtattgacttgcccggcctcgcatttctccgtgcaggtgcagacctccgcagccgggatcacgctcacgctgccgtcgctcttttccgcaagggccatcaggtccgcctcggtgacgccattcagaaagtaaacgttgttgtcgtcacgcttgccgtcaatgataaggtagaacacattcccggcctcggtggtaatggtgtaaaactgtttatccccatcctcgccggtggcgctgtccagcacggtcccggtcccctccggggtgaaagcgccctccgggacggaggaagtggtgggctccggtgtgccggaatttcctgtactgccggagctgccgccctgggagcttgtgccgcccgaagccgttcccgtattggaactgctgctttgggtgcccgtgctgccggaagaagctgcctgggtctgtaccggttttgttgccggggtgctgctctggctgggctgtgtggtggcagccggcttttccgtggacaccggttccttgtaataggggttgtcaaattgcacggcatcagaacggttgccggcataatccaccgcgtagacgctcacttttttatctgtgccggcataatccttcagcgcgacagaggatttcccgtctaccagggaattgacacgggtcttgtcaatatagaccgcctccacgccggaattgtcgtcgctgcttacgatctttacggtttccccatccagcaccgccgtaagcgtgggcggcgtggtgtccttccccccggcggcaaaagccgtcatgggcaaggtcatggcgcctatgagaaagacaagcgccataaggagagagattcgtttagtcctcatgcacttcctcctgttcctgcggcgaaggctcctgcgccatctgccgcgtttttaagaattcggccagttcctggggcgtcaggtggtagctgcgggccaccgccacaaaatcggtgttctccagctccgttttctgtttctccaaatcccggagcctggcctgctgctccgcgatcttcgccttggtcttttcaatgtcttttgccagtttttcaattttagggttcaagttgttacctccattctgttaaggcagacggccaaaggtgtaaaaatgctgctgccagtaacttgtattgatatttgcgtaagagatcgggtccccgcagtggatcatcatgccgcctcccacatagattcccacatggcttgcgccgctggtgttataggtcccctggaagaaaatcaggtcgccaggtcttgcgtccgcactcgatacaggcgtacacacgcctaaaagcccgtccgcggtaagccgcccgaagttccagccggtatggttgactacccaggaaacgaagcctgaacagtcaaaggaagtggaagggcttgcgccgccccacacatacggatagcctaagtatttctccgcctccgcgattatggccgcgaactgttcatccgcaagggcctccggcggaatatcgtaatcaaagtagctgccgcctccgcctgcgccaatggctggcagcccggtactgccggtgtcgccggtatccgcaaaatacagcgggttcaaatactgcccgtccaccaatacctccaggtgcaggtgcggcccggtggaattgccggtgctgccgaccttcgcgattacatccccggcctttacttcctggcccacggacacaagaagctgtgaacagtggccgtatttcgtggtaagggtatgcccctcgtaagcctcgccttcaatggcgacacacaggccgtagccgcccgcgtttcctgccagcgtaaccgtaccgtcatggccggctaagatttccgtgccctgggccacgccgatgtcaacgccggtatggtagttcttttccccgctgatggggtgtacccggtagccgtagtagctggtgacatagggcagccagtttatcccaaagacatttttcacatactgccggttgcccttggtctgcaatagaatctcaaagatttctttctgctcggcgctcatgcgctgcaccaccaggtttgcaagaggcgtggccgtgagctttacattcaggatgtgccactcatacggtacttcttcctcggtttcctcgccggtctccgggtcaacatgggtctctgtccggtagcggatttccgtttcctccgtaaaggtaagggaatactgctcattaaaaagctgccgcaggacgccctcgatctgctcataggtgaaattctgataggcagaagtgagatagcccatcaggatataggggtcatgctcgattgcgccgatgttatagcggtactcgtcataaccgggccggtctgtctccacacggtctatttccatttgcaggtctgtttcccactcggtatagataagctccgcgttgttgatgtcctggtcctccgccagataggtagaggcggcgatacttcccaggcccccggtcccgatattggaaaacgaggaaaacagcgaagtaatgagaaataccaccaaaagcaacaggagcagaatgccgcagatcaccgggtggcgcttgacagcatttacaacagagacagcgatcttttccgtggtgacggctgcgtcctttgcccgctttccggttttctgtgcctcccttgcggctttggcatactgccgtttcagcttttgcttctgccacatccgggcaaggaaatttttctttagctccgggtgttccgaaagggtctgccggtaggcaagctgcgcgttagccctcgctgatttctgctgtaactttgttacccggcggtatggcgctgttttatggcggtggtacagggtgcgcgcccaggcctcacccacaagctcggtgcggtgggcggctttcacgccgacattttcttcctccgcctggtagattttcttatgcgcataaccgacagccgtatttgcagcggcctttaccgggcgcatgggaagggagccctttacatgcgcccgctgggattttacttcctgctcaaatttcagccgcttttttgctttgccggtctccgggtcggaagccgtctccatccgcagttttttccgggaaggcagacgcgcctcggcgtcctccagcttcttttccacacgctcggccctgcgccttgcctgggtcagctttttatccgccgcctccggtggcagctcgtcagcggtaaattccagcttggaaggccgtttcggttctccttcggctgcccccggctgtttctcctggggttcctcggcttttgccgcctcctggaaacgctgctggtatttgttgccgtgctggtgcgtccggcgtctgcccggtgtttccccggcatttgtactgccagcctccgaattgccaaagccagacaactcctggccgccgcgcctggaaaaatctgcatcccggcgctgaaacctgccggaatcactgtgcccggaatcctgctgcctgctttcgcggaagctgtcacgcccggaaaaatccggcccgctttgctgcggatcgccgcggctgtcctgaatgaagctgtcagaacccccggacgactgccgggaagcagcagaatccacactggaatccgctgccggaaccgcgccgtcctccgaagccccttgatacaggttccgccctttatagcggttatcttcctgcacaggcgcgtcacgggcccggcgcagatcaaaatccgggccgcgcacctcgccggcccggacgtcgctttccgtttttcttgccggctgccgggccgcgtcttttgcccgtctgaattctttatcacgggatatatccatcacctccagtctgaattatctttgttagtctgccggcgctcatgcgcctgccacttcatccggccttgtggtaaggaccgaatacagaagggtgtccttcgggaagtgatcgacaaatggaataatcacgttgccgaaaaacaaaaggccctcgccggggccggaatgggtcacataggaaagctggtggggcgaaatgcctaactgcttcgccaaaatctgccggtctccctgggcctggttgagcatgtagataaaatccgagttctcaaaaatgttctcgatttccctggaagccagtaggtccttcacattctgcgttaaaccgctgggaatcccgccccattttcggaatcttttccatatctccacgctgaaacttccggtctggcctttcagcaggaggtggaattcgtcgatatagaaccaggtcgtcttatgcttggagcggttggccgtaacacggttccataccgcgtcctgcatgataagaaggccgatctctttcagggcctttcccagcgacttcaactggaagcacagtacccggtggttatccatctggatattggaacggtggttaaatacatttagggaaccgttgacatagatttccagcgccgtggcgatattctgcgcctccggctcgccctgtttgcgaagaagatcgtacaggtcccccaggatcggcatgttttccgggcgcgggtcctgcaaatagtcccggtacacaagccttgtgcagcggtcaatgatcgtcttttcaataggggaaagcccctccttgccgccgatgataaggtcacacagagacaggataaaatcacttttcagggtgatcgggttttcatcgtccgaatagtccaggtttatatccatcggattgatgtagttagtggagttaggggaaatgtcaatgatctgcccctgggctccaaactgctttaccaaaggcccgtactcattttccgggtctgctatgataatgtcgtcctccgtcagaaggaacacattgacgatctcacgcttggcagagaaagatttgccgctgccgggcgtccccagaaacaggccattggggtttttcaggttcttgcggttcgccataatcaggttgttgctaagggcgttgagaccgtaatacaaagcctcaccctcctggaacagctcgcaggtggtaaacggcacaaaaatggccgtgctgctggtggtaagcccccgctcgatctcgatctggttctgccccaggcataaggaggacataaggccctgctcctgctggaagtccagacgtttcagggcacagttgtatttctgcgccacaccggaagcggaaaaaatatccgtaaacagctttttgcgcttcggggcgatattctccaccagcaccgtcacaaggaacatcctttcattccggctctgtaaatcctgcaagagatttttcgcttcttccccataagtggcaaggtcggtaggtatgatgtccatgtcatagccggagcggaccgctttcttctgttcctcaatcgtcatcttctgcaaatcagacatcttgcgtttgatgttcttgatcgcctgggcctggtcgatagactggatatgtaggttgattgtcacggcgtcatccaggtcaagcagttccgccagcagccgatccgtcagctccggggccaaaatctgcaagaaggacaccgcgccggaatggtcgcccacccggaaggtcttgccgtcctgggagaaggagagaccggaaggggcgatatagtcctttgtggagagcccggttttcggcaaatccgaccagttaaaatgaagtttctcctggccgtccgggtggagctggctgtgcagaagctccagacgttccagcccgtttaaggaccttgcctgcgcgcccagggctttgaagttccccagcacgtccgtttcgatccgttccagacgcattttcgccgtgcgaaggtcctccgcttcaatcccgaaggtgatgtatttccgcttggtaaggccgttgttgcccttttggagctggttctttaacatatccgcgtactccctgcggattccgtcgtactcgtcgccacgggcaggaatctctatgctgtgaacaaagtcctgcatattggcccgctggttgatgaaggtgagctgcacatggatcgaggcgtcaaagtaattgagaaaatcgcagtagccctcaaaaatctgcgccttgtcgtccgcctgtgcgagctggtagttaatatcaaagaactgcaccgtcttggtgtaataattgccgctcacacggcagataccgtcccggtacatttccttatagggaatactctgctggaccgtctgcggggcgtccgctttcagcccggaaaaaaagccgggctttttcttcggcccggcaggagaggcagttttacttcctgcctttcttgcttcggtgcgggtcttttttgcctgctttacgtttctttgtagacgtttttcctgcgcctcctgctgtctggtttttggcaatctgtgatacctcctttttggatatggatttgtagaagttttctgtccggtaagggcggtccttcggccagagcttatagcggagccggttccttaacagcttttccgccggctgcccgtccttctcatacatggcaaagaagaaaaagggcatcatcaggccgatcataaggagcaccgccgccgaattgccgatggcgccgcgggtaaggaaatataccggcagccccaccagcgcggccagactgaaacaaataagctggcgctttgtcaggccagcggctactttggtcttgactttggttaagtctttgggtacgggtacataaggcatttcgttgtcacctccgatctgcgagaatcttttttatccgttttgcggcattgtaatactgcaatccacttcattgccccatacatcccagccaggggtctgctgcctggcaaaaagctccaccctgggctgatcgcccatgagctttatgatcttgtcccgcacttcatcgggtttcttgctgtgctgctcgatatgggagatcacaaactggtggattcccgcacactggcgtttcgggtgcccgcgtgttgccagcaggcacacctccgcgttagagcgggtccagaagcccatcccataaaaccagttatcggctttccggttctgcttcagccacagaaacgccagggtcttatactggaagccccacgcctcgatcacccggaacgcctcattaagctgtgggaaggtagcccatagaaaaagcgcactgtctttggccgcaaggtctgcaaccggcagtgcgcatatttcgtccatgctcatggtggggtaatggttttccgccacgcctttgccgcgcttcatgtcatagcgccagggcgggtctgcgtacacaatgccatatttcttagcctccgccatcagcgggcctgctcactcttggtaggtgcgggctttgccggctgcgtcttgaccttcccggcattttctttcagggcgccggtcagggaaggcttttccgccgcgcccctggtcgcttcaagggtggtctgcaaattttcaatcgcctggccgtacccttcgatcagggcgtcgttgagctgcctgcgaaagtccgccgtcaccggccagcacacatccctccattttccctgcttatcctgggtggaaggcatgttgacatacaggccgttctcgccggagcagatacggaagccgtcgatcttgaaacagtcgccaatcgtcacgttggcaaaggccaagaggttccccatcggggcaatcgggcgcacggttacatccagcttcaagccttcggacgcctgagtgtccggctgcatgggttcggtattggttttactcataatgaaagttcctccttgttaaaatgtagttgttacccactaatgcgagttgaatatacttttagataacgagcctgtcttaaagagggcgaaggccagcagtacggtatatcctgccgtgccccagatcgcaccgtgaatatcgccggacgaggggatcgactggaccagcaccgcgtagatcgcgacgcataccagaattaagaacccctggaatcccagagcgaacagggaacgaaggtaattcgtccccatctgtccccattcacggtttgccattgtggaaaacggtatgggtgccaggctgaccgtgagatatatttcaatcatgcggccatagacaatgacaaagatcacaatagacagtacccacatgcacaggttgatgatgttggtttccagccataagccgatcagctcccacatccccattgcttcaagctgcgtttccaggtcagccagcgccgccgtgacatccagatttccgtttatcacgccggcgctccgcgataccacattttgggcgacatcaaacaccgccatgacaatcgtaaagcagttggtgagcaggtaggtggctacaaaggtcttgaagatccacttgaagatgttgaacgtatcaaaatcgtgcatattgttcttttccaaaatcatctgaatcagctcatataccagcacaaaggtcaggatcatgcccgcaatgggaatgacgacggtttcagaaagattctggatcatactgaacacgccgccattccagccctgcggggtctgtccgacctgcccggccacatctgcgacctggctgtttaccgattcaaaaatactggtgtactgcccggtgatcgcttcgatcaggccctctttgatccagtctgttatccaatcaaacagactgcccatcggctattaactgaacaggccggacaggagcggaatcagcgtggcacccaccagggcgataccgccgcccgccataagctgcttgatcccctgggattttgcaccggggttgtcgttgccgtaaccttccaaaaggttgatgacaccccatgcgccgagacccgtgcccagggcgatcacgagaattttcagcgtgtcaatcgcgcttgtaaaaaaagccataaagttaatcctccttaatgttcatagaatttattgttgtggccgcattgggccggaaacgaaaaaagccgccgccatgttcaaatagaaaacctacaaaaacatgacggcagcataaggggcaggacaagacctgcgggggatattcagttgtcagggagaatcacgaatccgcaataggcgcctcctttccaaatggtatagaaaaacccgccatacaataaggaaatgatacggcgggattttacgcgcttgtctgcgctgccagttcttccggcgtgatctcatagttggggtacagctctccgggacgtacaggcagtcttgtagacaggtatttctctatgtcaaaggcgttcttttcgtcaaaatccgaaagatatttgtaattcgggtgtttggtaatgtcatacttccgggacaggaagggacgcacgcccctgatctgcaggaggcattttccgccgtccatcaccgcaagctcgtcaacggacatcaaatcttttcccagcttttgaaagttctgcccgtgggattcctgggtgcccttcgtgacgctggtgttatacatatcaatggtttctttccccagcagggagttccagcttttcaaggtggtttcctccttaccgcccaggaaaagagaagaatcacagttgcctatgatcgtgtccatgttgtccttataaagcgctttgagctggctctgtgcctgcaataccaggcaggcggatatttccctggaacggatcgttgccatcagcttttccaggtttgggatttgaccgatattggccgcctcgtcgatcaggcaccgcacatggaccgggagcctgcccccgaacttatcatccgcccgctcacagagcaggttgaatagctgggtataagccatactgacaaggaaattaaaggtcgcgtccgtatcactgatgataaagaacagcgccgttttcctgtcgcccaccaggtcaagctccagctcgtcatacatggtgatttcccggacttccttaaatagcgataggtaatcctttgatgttatctccggattttcccccgccctaaaccgggcatgaacctttcagctcacccggcttgccatcaggaacagaatttatttcatctcaataactctcaacgtggacaaggcttcttaacttattgagtttttctttctgcttttggtcaaggcctaggatttccatatactttctgataatatcagggtttgtagcatgaatcaggtgatgtacatcttcacataccaacaccagattttgataattgtccttgccgcctaaataccgtggcactttgtgatggcaatgaatatcgccaatagaaagcactttgccagatacggcgcattttcccatttgggccgaatacagtgaaagcctgttatcgttgtattcgatagtacggtacagaaccgggttcctcattaagtaatgaagaaccgtcatgtcgattctgtccagattcttatggatttcggctctgccctcgggcatataggaattgattttgcggttcatggactttgggggcttgtgccgtatgtagccaatcgggacaactgcgtgtccggctacatatcggagctgtttgcttttcccataccgttccctgataactttcggaacttcacacggaatcttcctttttctgacctgttttgcagttttaacccgttctttcagtcttgcccgcaggctcttgtggacagataaggcgaatggcgtaaggtcatcgcagacctttgtggctaattgatagtagtcatggattcccattacataaacgttgtagcggcaaatcgcctgatattcagtacgtttgccttgtgacgggaactcaatgtcgtaaatcagccgttttaagtttggttttattttcgcaatagatttctctctgatatggctctctactacatatttggcgcgtccgttgctccgtttcccacgggggataacctttaacttgaaaccaagaaactctgaatactgctctttcaggttaatcaccttcgatttttcaggactgatttcaagagaaagcctttcatggagccagcttttggttgcgtggaataacttcaccgcattttgatagctgttcgtgaatatcttaaaatcatcagcgtatcggacgcaggtgacttctttcagccttgtcctccgcagtgcggcaaatttatggctcttgctcacgcttccgttgtaattgaccgattccttgtaagggaactccgttggtatttcttcccattggctggcaagccaccaatccaattcgtttagaactacattggatagcaggggagagataatacctccctgcggcgtacccacctccgggaatcctatcccggccacctccgcttttagcatagctgatataatactaagcagcttcttgtcttggattcccattgtccagagctgtttcagcagttttccgtggttcacgttgtcaaagaaccccttaacatctatgtctacgacatagtggagattgcttctctgcatatttttgtgaacctgggcgattgcgtgctgttggtttcggttagggcggaatccataactgtggtcgtggaatttcgcctcacatatcggctccatgacctgcaatacgcactgttgtatcagcctgtccataatcgtcggtattccgagcgggcgcttcttcattgggtcatttcctttcggaatttctacccgccggacgctttgtgggacataccagtttaatttgcgctgtatggcgcatataagctgttcatcagagagtgctgataattctgtgattgtttttccatctgtgccgggcgtcgtactcccgtggttcttcttgatgttgcggtatgccagccgtatgttttcgggtaatgcaatgatttcaaccagatgtttgaaaactttgcctttattgctgtcggcatacagcttatcttgaattgcctggaagtcataatactcggcgtgccttaacttatctttcttctttgcctttcctgttgccatagtcggttacttatccccactttcgtttggattttcgcctttcttagtcctactcgaacctatgcgtgtttattgaatatgattttgtttctgttcctgactacagcccgtccctccaccgcttactttgttcacggcttcacaggtagcatggctgctctttcctcccggattaagaacggttataccgcacctcccataaaaggcggcacgattttcccgcccattgcttcatcatgcgtatccactccacatccggggctttccacgttccgatattcctatctttgcataatacccttaaccctgccctttaggcctgtatgcctgatggtgcctgtaacaccatagggaatttcatatcgacaaatcttactttaccccacatacgccgttttcacggctatggcatttctgccatatcccgttatagacctgtacattcgggcttttgtcagcggtagtcagccgcattctggacataggtactttatagacctccggcctaacacccccggccacctctggctcggctttgctttatcccccaaaggggacagtcgcgggtgcagacagccgacttcagcgtgctgtgtcagtcgcgggaaatacgtcccgtttcttccaacgcagtatcaagggaagcgtttcagggcgttaccccgccattccacttctcggaatatcagttagaaaggctatagcctttccgtcacttttacctctttgcaggaaaatcccacgcagagtttatatgcgacaacgtgtcgctgcactgtcaagtgcttgctcgcttaggtcgcctgcggctccaaggggcgctcgcccccgctaatttcatcttgaatctgcgcttcaagatgaaaaagccttgtaactttcccgttgactatgtgtactgccgtgaataaagatattccgagttcttatttctttaattcacaaaaatgctgagggtcagcgagcatcggtagggcgcatttatgcgcctcgttaggtgagctatcatctgaacacgtagtgttcaatatacaattatctttattataactatatacatagtaaataaaaaagcacctgtcattcgtgtttacgtaataacaggtgctttagtcttttttaatatcatttagaatttcaaaaaaataatctaattgacgtggtgacaaggaaaataatatattcaatatcttttgtattttatcatcatctttaatataataattaaagaactcatatggtgtaacttctaaaaattcacaaatataaaagaatccacttaatgatggtaaagaatatccggattcaattttatttatatatccttcactttgaccgataaactcattcatccggatatgagttaatattattagtgcgatttaataagtaatcggttgaggtattgtaaaagtcggcaagtttcactagaaaatgtagaggtatagtttgaaaacctcgctcataacgagagtatacagtttgttgtattcctaaaatatcagcaatatctgtttgttttagtccagcatttatgcgcagaatttttaatcttttcaagtacattttaacatatcctccattaaacttctgagttttaatcttgttcatcaatattaaaataggacgagggcaaattaagattaagcaagtcgccgggtttaacctctaaaatatcggcaatattaaagaaaacttctaaagagaaggaagaagatatattaggagcttcaatagagctaagatgtgaacggctaatatgtgctttctcagcaagttcatgttgtgtatatcccttagcttttctcaaagcagaaatcattaatcctaattcaacgaatcggtctctgttttcaaaaccaacttctttacgcatttttatatcctcctaaaaaattattaaatatgtttttgtatattgaacactgcgtgttcagatggttgctcacctaacgaggcgcataaatgcgcaatacatcacaactaagtaatttattggcgtttaaggctatggcaaaagaagtcactttgtatcacacccaccaaaggtggggtcacacctaccgatgttcactgaaaaaactgtctttttgtactttagtctaaattaaacacccaacttttctttaaattaaaataattggaactcggtaaatctttattcacggtagtacacaaagtcaacgggaaagttacagggctttttcatcttgaagcgcaggttcaagatgaaattagcgggggcgagcgcccattggagccgtaggcgacctaagcgagcaagcactttttcttttatttgagtattcatattattgacatcgtaggttattcaaaacaagtaactttttattacacacacctttcaggtgtggtcacaggtgaagcgtttctttttcttgcgagaaaaagaaatggttcaaacaccctattatgtaataataaatttttttatatggggtcatatacaaagttaattataataaatatcttctttatatattgaacactgcgtgttcagatgatagctcacctaacgcgcttgctaacgcaagcctaccgatgttcactgaaaaacccgcttttttagtgtaataattaaatggttcaaacactttattatgtaataataaaattttatatgggtcattacaaagtatagttttaaagagctataagctaagttataaaaaagagtattatgaacccaaagtcaaatgtaagtatacattgactgcaaatatattatatcatattgaataggcaattttattccatgaaaaggagtaaattaacaaatgtatgtcaaataaggaaatgttatagtttttatatgtcataaatagccttacgacaaaataaaaaacaaaaaagggagccatagcggctcccataaaaaattacttctttttatcatacaacccggcgcggtcattgattaccaataacctcatcaaatcctcagttagccccagcttgccttcctcatcaccttttaaaaatcccttatctaccagcttagttattgtaggaattgcccattcaggcatgttctcatcaatataatcataggtcgctagctgtgctttgatataatctatctctttggtgttgttcaaaatatcagcgccgattgcgtcaataactttatcctgactttcgtcctttttctttaactcttcatattcgctgctcaaaagttcgtcaccgctttctaatttatattctactccaaaatagttgcagatacctttataaattcccactgcacatttatattttccgtcgtcgctggctaaaaacctgttgtcgtcataattgtctataaatgcagtctctaccagtatcgccggcatgtttgtgtgttttataaccgcaaagttcgctgactttactcccctgttgcaaagccctgtctcttttgcaagctccggctgtacacagtcagctaatcttctgcccttagagctgccggtataatagtaagtctcgcacccatatgcttttgtgtttgctgagttgcaatggatagaaacaaatatatcagcgtcccagctgttggcggcgttgtatctgcctgcaagactggcgtttaggccctccgctaccgtgtcctttaagctgtttcggctcatcttaacttcaaaaccgtttctttcaagcaaaggttttaattttaatgctatttctacagtaacatcctgctctttgagcccgtaacctacggctcctgtgtcgtttccggttgggttgtgtcccgggtcaataaaaatttttgtcatattacttcacctccttcactcttgttctgctctttgagctgttttaaaacttcgtccgcttttacagcgtttggggtgaaactattgtttttccaccaagcccaaacagacgcgccaattgtgaataataggctgaccgtctgatagatatcattatcagcgatgctaaccgcctgcttgccgctcatggccaatatttggttcagcagcgctaccagcagaacaattgtgcgcgctaccgctccagctgttactttgctcattgtttcacctcctcgtttagttcatcaatccgtttgtgcgcagactttgtggactgctccactgctgtcatgcgttccaccaggtcgttgtgcttctctacttctttttcaagcaaacttatcctgtagcttgtgagcctgtttgctgtaagaactcctgttacagaaccaaacatagttccaaacagtgccaggcccgcaacaactatttcgggtgtgataaagctcattattttgctcctttacaaatgtattggcgaatacatttatagtatagcaaatatcgcctgccatgaagtgccatgtgttttcgcttgacaaagggcttccggtagagtagaattatcgtaaattgcaaataattctgtcataggatgtgattataatggaaaaaacaccaatggcaatgcgtaaacatgttgctattttcggcgatactaatgttggaaaatccacattgtttaataaacttttaggacaggaggcggctattgtttccgatgtcagcggaacaaccaccgaccctgtgaccaaggcgatggagcttatcccttacggacctatcgcgcttattgacacggcaggtttgggggacaagtcagttcttggagaacagagagaagccaaaaccctggaaattattaaacgtactgacctaatattatatgttcaagatgtcagttgtgagaacgttttaaatccacgcccgattgacaaaaatattccgactatatttgtttttacaaaatgcgacttggcaaatgctaagatgctgaacagtgccagcgctaaatatccggattcagtgctgatttttgactataacgagaagagcatggatagtttgagaaataagatggttgaggaactgacaaagcaggaaagggacgatgagacgcttatcggaaagcttctgcctaaggacagcagtcttgttttggtctgccctatagacagcgaggctcctaagggcaggctgatacagcctcaggttcagcttatcagggattgtcttgaccacaatatgaaagcatatgtaacaaatgagattacactggcggacgctcttgaagatttaaagcgtgtagatttggttgtcacagattcacaggcgtttaagacagttgataaaattgttcctaaagaaataaaactaacatcgttttctatgcttttggcgtatcagaaaggtaatttcaggcagcttttagacggcgcgtcagcgattgacaaacttagcgctgattcaaaggtgctggtgcttgagggctgtactcacaatacttcgcatgaggatataggaaaggttaagatacccgctctgataaagaattatctaggcggtgaaacgcccgaatatgagttttacaccgggtataacctgccgggaagtttttcggattatgaccttattatccagtgcggaatgtgtatggtaaacaaaaaggaagttgtcagccgattaaaagaggcggaggaagcaagcgtcccggtgaccaactatgggattgcgctggctaagctaaacggtattttggatagggcatgtgaaatttttgcagaggaagattaatgtgttatgaaatttacaaaaagcgaagctcttgagattataaaacagaataaagaagtcttatcggaggaactcagagaaaaatccctcgccgtgtgcagggagaatttcggtaactcggtatatgtcagagggcttatagagtttactaattattgcaggaacaactgcaagtattgcggcattagagccggcaacagaaatgttcaccgttataggctcacaagagaggaaattttggattgctgccgtgtcggcgcaggtttagggtttaagacatatgttcttcagggaggagaggacccaggattttcggataatgagctttgttcaattgtttcggaaatcaagacggagtttcctgaatcggcggttactctatcagttggcgagcgttcgaaagatgtatatagggagttttttaaggccggggcggacaggtttttactgaggcatgaaacttcggttgacgagcattacagtctgctccatccgtctgatttaagtttaaaaaacagaaaaagatgcctttatgatttaaaagatatagggtttcaggttggggcagggtttatggtaggctcgccgtttcagaaagacgaatatttggctgaggacattatgtttttacaggagcttaagccgcatatggtggggataggtccgtttataccccataaggatacggaatttaaagatttccctcagggaacattaaatatgactttagtaatgctgtgtattacaagattagctctgccgaaagtgctgctgccgtctactactgcgctggggacaatttctccgaccggcagagaagacggtctgcgctgcggcgctaacgttgttatgccgaatttgtcgcctataggcgtaaggcgggattattcgttatatgacggaaagatatgtatgggcgacgaagcggctgagtgtataaaatgtttgggagctagagtggagacagtgggatgcaggctggatttttcacggggcgacagtccgttgatatagggattaaaacaaaatttcagcattatacaagaatagaatgtgcggctgatgttaaaattgatatgacgaaaaaaagacaaaaataaaaaacacctctgcggtgtttttatttttataaaattatgtttgccaaagcctcgcagtgtttataaaagcttcgcaaaacaccggctttgtgaaactttaaattcaagactaaaccgctctgtcaaccttgcctgatcttatgcatctggtacaagcgtaaacttttttaggagtaccatcgacaatagctctgacacgtctaacgtttggtttccaaaccttatttgatctacggtgtgagtgagatactttgataccaaagctaacgccctttccgcaaatttcgcactttgccatatatatacacctccttaatagtttaaaaattaactcaactcgaaatattataacagaaactattttataatgcaagtactttttcaaaaaattttacattttatttatatatttttatatttattactttaaaactctgcctgtgagttcttataattctgcaaaatatcttatgtattaaactttagtaagctgatgacgctatgttatcagcttttattatttaaagttatattgatttacttaatataaacaatgtttataaagttataaagcaaattatttagctgttattttaaacagataaagcgaaaatgttatttttactaaataataaaaatattttaattatatattgtgcaaaacgctaaagtgtgctataataccagtaaggggtttcaggtaaattttaccaataataaagggggagtatttatgaaaagaaaagtggcagtaattattttgtgcgtcgtttttttggttggaacattttacgtttttgccagtgacgcactgattaatcaagaggataaaacagatgttttggaaattgcagaaaccgctgaacctgctgaacctgaatccacaacggaaatagtgatcgaaacatctcctgagccggattcggaaattgctgaaccgactgcttctgcggctgcggaggaagaggatttgagcggtcaggccggagagaatgaaactgagacaacagcgtcacagtatccatcaaatttttatgagttagctcaggttttaaataatagagatataaacactgcaggcgtttgcgatattttaacaagttatttatatctgcgggacgtatacggtctcagtaatcaggagcttgaatacatcgcaggactgattatcggcggcgctgaacctagcaatattatggaagccgcatatttttggctggatacctgcgaggatatatcaattattgaacagatatacaataagaaaagtgaatatgaaggcggtaagttttgggttgaaaacgcttacaacgacgtgactgaatatatacatggcgagctgtctgtggacgacgttaattattatcttgaggcgggtgcagccgctgttgatatacagaatgctaatgttttgagcagaaggggagtttataccattcagcagatactggacagaatcatcggcggcgaaacaatagtagatgttatgaatgacgtttatgggactaatataactcagcctgtcagtttatttgggcttaatgaaaatgaggaagcggatgaaaatattttagacagtaaagaattggccgggcttgaaaataagcagattgaggaatctgccgaagaaatattgtctgacagcggcgtttcggaaagactttctaagaaaagaaatgagaaaaacgcagggcttgtagaacagcttgtaattaacggaatcatctcgggtagaattgatgaggatttgggggtgatttttgatgagtaagctgaaatattttttgtttatttctgtactgattgtaagctgctttagcatttcgtgttatgcttcaacatccgattcgctttatgagcagtctttggttgaaagcatgatagctcaaactggttcgaattattaaagtccgtttatagccacgggcggcaatgtggaattaagcgacggaaatgtcaacgtaaatgaggttgatttgagcctgccggggaaaaatggtatggacgttaatatcaggcgtattcattatgttaacggcaaaccgggcagctactacggagtaagcactagtggaagtgtggcaacaagtccgatgtatttatataattacgttttaaacggagtttcaaaaaccgcatatgtggcctttaataaggaagaaaatttaacagatgagttttatacaacatcttcattgctgagttcaaatatgagcactgatactcatggaacaaaatactacgaatattccagtataaaaagtgtttctggaatattaatgactagggataagaataaaccttcggttcaaaattatcagctgtcgaatgaagtgtttgcgtatatgggcaaaagttccgatgttgaaattggttatggctggtatgtcgcgatgccgcagataagccaagtaaatgtttcggggagcagttatataaaaagatatacctatctgtttgaggatgaaaacggacagacgatgaattttacatatgagtttgaccttgagggaacaaagtgggtgtttgacccggaaagctgcaatgtgtcggcgcctgacagccagtacaatgctcaagtttacagcgataatcagacgcatgctttgggatttcaatacgatgttgttataacagatggagacggaaagtcatattactttttaaaggggataaataaaaattgtcttcctgccgccattatagacaggtacggaaacactgtccgctatgccgcaaacagcagcggtgttgctgtgacagatactttcggcagaaacattcaggtatcgtcatcaggtataaccgttaccaaaggcagttctgtcaaaagcgttgagtatcggatgttaaggtcaaatgacacaaccagggatccatcggggctgctcagctgtttttcaaaatattctttgcaggtgagaaaatataatggctcgggatatgagactacagaatatgtgtcacacaaaagctcaattcaatttataagcaaagaggtttactattatgataaaatcgaaaagataatatatccgacaaacgcttcggtggaatatgagtatgagacaacgccgacagtgaaaaagttctcttcaagcacaggacggtataaaatttcacataaggattatcatattaaaaaagaaattgcttatgaagacgggtcagaaaagtattcaaaaacatacagcttctatcagtacatacaaaatgccgctatggtgccgggtgataaggagcgctatgtgacggttaatgaaacttatgacgacggttcaagtaagagcatgaattataactatgattatgccggaagactatatgagataaaaggaagtattgacggaaaggtgtataacgagcagtatacatattccagtaattccaataaagatttgagcagtcttggttcatcaacgatgcttgcactgagaaaagcgaatatgcaaagcgttataactacctatggcgggaatatcataaatgttacatataataactataataatagaaatcagccgacatattcacttaatggtgagaaagaaacaacttatacttatgacgacagcttcgggcttctgctgacaaagaattataaaaaggatgacagtacgcccataagtatacaaaacagtaaaacctcagacggaaagagtatagcaagctctaaaatttatgaaaataatgcagagaagtcaacgacttcatatacatataacagtgacggtacaatagcaagtcagacagtaactccgtcagtgggggctcaggtgacaaccgtatatagctatacatacaatccggacggctcatatagattaacagcaactgtcaataatgtgtctgatactgacgggaataattcgtcggtgactactgttcagaattatgactggctgggaaatctagtatccgcaaccgaccctaacggaaatactttctcatatcagtatgacggtttggggcgtttagtaaagcagataaaccctgacggaacataccagacagctagctataatatagcagacaacagcgtaacggtaacggacgagaatgggaatataacaactcaggactatactcctcttggatatttggataaaatatatttggataataatcagaataatatagccgccaaatatacatatgacaatcacggaagaaagacgagcgagactgcataccaaagcataggcggaaaaaaggtaactgaaaattatacgtatgaccagtttgacagagtggtatcacaaacaagcaaagaggataatactgcgctggatacagtgggatatgagtatagttatggagacggtttttcaaaaagtgaatctaatattacaataacggttccgtcaagcgcaaaaaaacttttggcggtatttcataacacatcggtatcagcaagttcagcagtcagtgttaaaaacggaagcactgtatactttgccggctcggtttcggcaaaaggagcgcgctcggtattggtggatgtgtcaaatctgtcaactgtatcgcttaataaaatgtacggaaaaatatattataaatatttgactgacgatgatttatcaaagaatataacactgctgggaggagccagccaaacggtaaaggccacatacacaggagacagcacatatgtaaagccgacagttgagacagtgctggacggtttgggcaataaggcgtctgagacgtactataagcatggaacgagtacggtactgaataaaaacacatataagtatgactatatgggaaacgtcctggagacaaaaggcggcagaacctatactgaaaacctgggagactatacgtcgaaagcggaatatgattatatgggaaatccgacaaaaacctacagaaccgacggaagctatatgaccgctgcatatgacggatacggaaatgtattgagccaaactgactatatgggaaacacaaccacaatggaatacgacaggctgggaagagcgataaaggcagcggcgccgtttaatggttcagaaaagagcaaaaccctgacatactatgacggaaacggaaatgttgtaaagaccaaacagcagaacaatgagcccgggaaagcggagagttatgcggtaacggagtatgaatatgatagcagaaacagattggtgacggtaaaacagaatgacggaaccagggatatatatactcaatatgcgtacgacaatgcaggaaatatggtgaagacagtaacaggacagacaagcaaaatagctgatctgtacgggacactgccgggtgcagcggccagccaaacatatgagtatgacagattcggaaacgtgataaaggcaaccgacggactgggaaaaagcagtacggcagcgtataatctaatgggactgccggtgacagagacagacagaaacggaaacgtaaagacaatgacctacaacgcgtacggaagtccgctgacggtgagcgtaacaaatggagagacaataacaaatacatacagcaaaaacaatctgctgataagcgccaaacagggaagcagcatggtgtcgtacacgtatgacgactatggatatgtaaagacggagaacagcaacggtatagtaaacacatacacaaacgatgtagaagaaaatagaaggaactatacccaaaaagagggaacaaatacatatattaatgcgtcatatacatatgacaaactaagcagaatgacgaatgtaaattttggaaacgggataagcgcgggatatacatataacgcaaataatcaggtaacaagcgaaaactgtggagtgattgaaacaacttatggatataacaaagcgggtctaaacacatcagtgtataatacctggggaggagaaaataaagattatgtatacagttacaatttagcaggcaaccaggtaaaaaaatatgaaataaatacagatgaagaaataacaacaacatatacatatgataatttgggacaactgttgaccgagacgtcacctaattactacgcagcatatatgtatgatacgagaggaaatatagaagaaaagaaagaaggagacaactacccgacatattatagatacgataaaaacaataggttagtatattcatataatgaatatgaagcgtggaactatatagatatagcatattcgtatgacggaaacggaaatatgacggaaaagagctggatagattattatgatgacggagatggatatacaaacgaacataaaagatggttggagaaatttgaatataatggctataatcaaatggtgaaatatgaagacacaggagaaggagaagtaaatgcggaatataaatatgacgcaataggaagacgcgcaagtaaaaaagtagatggttatacgacaacgcatcgttgggatggaagcagcatagtaggagacagcggaacaggagcaggaacgtattacagaggaatgaacttaataggacaaaacagaaataatacggtaaattactatgtgaatgatggacacggaaatataaccgcactgacgaatgctgatggaacaacagcaggcaaacgggattatagcgcatatggaaatatgacaacattaggaggagaaatgaacacagtgtttaattactgtggagagtatcaagattcagagagcgggatgatatatttaagaaacagatattatagtatatcaatgtgccgcttcacgcaggaagacccggcaaaagacggactaaattggtacgcatactgcggtaataatcctgtgaactttgttgatccttgaggattaatgattagcgatatattaaactcaaaaaatatttctgaacattattctgatgattatgtgcaatttgctgaaagagtattcacagagtctataatgaaaactgtaactactactaatccaataacaatagttgaaaattctagcagtataataatatatgcatatatatatgtctcaggaccagaagctgatactataattcctggtacgcaaaatgaaaatggaactggcggcattacatatagggaagctacggttaatggaataaaaaaatattggagtggtgaatatgatggaaaaaaagttaaggttattaattgtagatttaaatgatggaaatactcgagatttaaaaattgggcaaaaaagtttaagtgtaacagtaaatagtggaaaaaggaatatcaaatttaactgattggtattcatatgctgatccaggacaaatcaatatgtttcaaggtgataatagaaatggagtaacatattcattagatgattttgaaagaactattgcacatgaatttggtcacgcattaggaatagctgatttgtatgacgatataggtattccgctaatgtttccgtcaataatgaataaccagtgggaggtaaatggagcacaatcggtagattatgctatgatgtttaatgcgtatcgtttaggtgtgtttcaaaggtggagtgaaaataaaagattattagatagaatggggattacttattataaaaagtcttaatctttaaaggagaaaaaatgaaaaataatattgtaaaaattatggttttaatgattgcattaattttatttatgacattaacatatgccagtaatgaacttatagcaaaagtagagcaatataaaataatagtaaatggagaagaaaaaatttttaatatgccaatagtaacaataaatgataggacatatataccgctaagagagacagcagaaactttagatatggatgttagatgggacgatgagaaacaagaaattaatataaataatatgattgaagaggatgaactatatgtattttataaaaacgggttatatggatatatagataaagacttcaatataattatacaacctaaatattattatgcagaagattttagtgaaggtttggctttggtgagaacaagtaattcgcaaaatggacaatatagatatataaataagaaaggggaaatagtgataccagaggcttattcaatggcatatagtttccatgatggaatagcgttggtagatttgggagaagcagctataactgatgatagtttgtttacatatatagataaacaaggaaatagaataacagataaagaatttggactggcaagtagtttttcggaaaaatatgcagttgttttaaaggagggatacggtttcccagtaccaccaagcatgaaagtgaaaaacaaatggtcatatattaacaccttaggagaatatccaacagagcaagtatatgaagaggcgagagatttttccaatggttatgcagcagtaaaaaataatggaaaatggggactgattaatacaaagtttaagttagttatagattatatatatgatgatattcacaaagtttaaatgaaggaataatgccggtaaaattaggaaataaatggggttgtgtagatataaacaataatgtgatagttgagtgtaagtatgacagaattgattcatattcagagggattagcctgctttttgaaaaatgataaatgtggatatcttgatacaaatggaaatgaagttatatcagcagaatttgaaaatgcaggtaatttttcagaaggaatagcaacagtaaaaacaaacggtaaatggggatgtatagataagaaaggggaatttgtaatacaaccccaatattttattttaggtgactgtaaaaatggtcttatggaagtatatgacgaatcttatttgataaaaggctatataaataaggatggcaaggaggtaattttataagtataataatacttaaataacatgagggcacaatgttttgtgccctcaataacaagttcggttaagataagcgtacgcataaaaaactgaaacggagtaaaaaacaccggaaagtttttgtatatataaaaataattaactatttaaaatataatccatcaaacacttccattttgaatggttgagaacacatataactccgtttcagttttttatgcatatatagaaatatatttagaaagtataatacaattttatgagtttatctaaacaataaagaaagatttctataaggctattatttaactacagaagaagtagggttagaagtcaaatacaatatggcgattatcctgatatattaaataaatatgttccgggttggaaatatgaatgagaggagaaaaaatatgaaatataaaaaagtgttttatagtgttatttttatatgtgtaatatcatttatagtgaacgtaaatgttagaggaaacgaaagcagtaacagcggtaatatagatgaaatagacagtagatatgaaataataaatttaactgaaccgataatagacgcaaaagattattggctttatgattgtgataataatggcgtttggataggtgtatataatcataaagatgattgtgtatatgattactttataggatatgatggaaataattatggaatacctactttgtttcatgatggcgttgcaaaagtgagacaaaacgataaatttggatatataaatacaaattatgagtggattttgcctcctgtttatgatagttatagaattagtgagtttgcagatggatatggtgccgcaacaaaagatggtacatacaacagtaaatatatagttgacaataatggcaatataaaacatttcttatgtcctgatagggagcaacagtttatcggagataaagagatagggactcaatatattgttgataaaaatcaaaaagtaaatataattcatacagaggatatggtaaaagatttaaatccggatgattataacagatattggggatatgagcagtttgggggaactacgctttatcaagtaaatattgctgagactgaagattctccaactataaataaagtatattatatgtttggagatgatggtctattaaaatataaatatgaagtaagcttgctcgaaaacaatcctgatatatactccggttattataatccaataatactgaataatgggaatgttatatttcttgataaagataaagaaaataaaaattatacgaaacatatacacatttctagatttggcaatgtaattggagaaaaaagtttaaaatatccaatagttaattttgaaaaccaacttttatacagttacggagaaaacatgctggaataccatggagagtttttaggaatggattttaaaccgttagtttcattaaatcaagaatataatggatacagtcttttaaatacggaagcatatttgccgtcatcggagattaaagataaaatatgggaagataaagaaagagatataatagtatattttttaggcaaaaagcatgaggaaccaaattataataaatctgcagatatatatcaactattggttgtatatacaaatgaaacagaaataaatcacaaacctgttgtagttgatgaaggaaggataccaatatacgagaaacctgaaaaaataacaacatatttaaacaatgaacaacttaactttgatatcctgccgataacagaaaacgatagaacattagtaccaatgagagcaatattcgaagcattgggagcagaagtagaatgggaaaatgaaacccaaacggcaacagcaaccatccctttcggaatgttgtccccctcctaaaggcaggttactcacgcgttactcacccgtccgccgctttccatccttatcttctccccgaagggatccgttaaaaatttctcgctcgacttgcatgtgttaggcacgccgccagcgttcgtcctgagccaggatcaaactctcgattattattgttatatatccaggctttcgccttccaatatactcgattgtttgttagctcttatcgaatactaacgttcgtcgcagcccgcttcgcttttcccataaatttgtaaacaaatttatgctcttcgctccgcagcagctcctcttaaatcaaaagcaagcttttgatttattcttaacccccgcagaactttgttccgcagctgcaacttgtaaagttcgctaaaacttttttggaattgacaaagtctccactcttgcgagtttcttaccttgtgcaattgtcgtaataagtacatctaaatgtatctttattaccgctttttcactatttatttttcaaacatctgctttctgtttctctcgaaacagcttgactataataacacatttaaattatcttgtcaagactttttttaactttttttgaaaaaatttttaaaacttaaaaattgcttcttcatcaagttatgtatgtttgttcttcaaaacatataggtcttttcgaacaacttgtttagtatagcagagacaaattattttgtcaagacttttttcttcttttttttatttattttttaaattagctgatttttcccgtttttacgttgtttattgtcctacttccgcttcccgcattatattatttattagtatatttctaaaatacttataataacttacgttatatttaatactatatctttacagttttccattctcattccgttaggtatttttcataattcaaactatgtataaataataaaaacaaaagatcagagaatgccttcaagcattatttatgctatgattgataaatcaaatttattactcactctattacactattgctcttttaattcagtatcactttttttaagaaaagtacaaaactgttttaagtaatactgaaagtactttctacttaaaaagcgataaataaaagaggggataattaccccctcttattaatatgctattgttttaattttggaactaaaatctcatctctttctatttttttactttatcttcaacaatacttccggttagcttgtcattttcttctaatactgcatagctgtctgattgactttcattttctgtttgtgttccttctccttcatatagtactttatcctcagcaacacttccagttaacttatcattctctcccaaaattgcatagatatctgctttttcactattcaaaacattatcctttccttcagaaattgataaaactctgtcttgaactatttgaccgagtaactcaccatgatttagtgtttccatacggttatccgctccggcggcaaaagctgatcccgctgcggctgtcactgccaatcctaaaactactgatagtacttgtttcttcataagcaattcaatcatttttcggatttgccgtatttttatctttggcttctactgataataaagtctgacctcatttattacttatcataccagacttatttttgtctctctttttagtccgggaattttaacaatgcatccggctttattcccaatgcatcagaaatacaaaatagcatttctaaagaaatcggcttaataatgcttgccgcttctataacgctgataaatgaccggctgatattcgccttttcagctaattccaactgcgtcatgccgagcctttttctgtaatgcgaaatatttaatccaagctctatataataatccatatgctcaaactttattggctttgatcttgacatatatatttacctcttgtgtagtttaataatattttatattattattacaaagcataaactttctattaaaaagctattgctttttaatagaaagcatgatattatttatatcagaaagtgttttatattacatttttattattgattttgttattatcaagtttgtttttccaatgttattctgttatagatataatgaaaaaagtccgaaagaacttttgtttttattttgtctataacaaagcctatatttaaggcttaatgtattaaaaattaaaaatatttaggaggagtcaattatgaagaaaaaaacattatcggttttatttgtatcaatttgtattatcttgtcaacatttatcactgcagccgcagctgaaaacccatacaattactcatcagagccgtcgagagccatttattatgtattgccgactatgaagggcaatgatgtcaaatgggttcagtcggcattaaacgcatttggtaattatggtctatcaattgacggaagtttcggtccggcttgcaaaaaggcaacaaaaaagtttcagtcttcaatgggtatttcccaagacgggtcattcggtccggcaacaaggagcacaatggttaattggcttaaacaaaatggttatgcttccggtaataatttaagctcggctgtttcacaaaaggctttttacagacagtcttccggcggatgctatacagcaagtgcggcaatgataatgactaatctcaacgcatggtggaatggaagcacagccacatattggaacgtatatacagccaatggaaatactgcatatttacaaggagaaactccaggaaaatttggctgcagccgctggaatatttccgcctctaaatcatctgtaatagatgctgtaaaaaaatatcctcagggagttatggtagcgtttaatcagccaaacaaaggatgggcacattgcatggtagctgtaggattaaattcaagcggagaaccactgttttttgatccggctatagacaatggtaataatggcggttacggatacaccttgcctgagacttctgccggaggttcatacggaggagcaggttggggaaacattattcaagtttctgttataacgaaataatttagaattaatactttcaataacattggaattacaaaatatatatacgctgtgctttttcaacaatattgccattaaccgacaacaaattaaatacagccgtattttttattaacctaaacctgcaataaagtaatattataaataattaaaaaatagttatatcaaaaagggagagaagatcatgaaaaataacagaaatcttgtggctttgttattgtcatttattctattatttagtttttctacagtaagcgcagaagggtttaacctgcttagtccaaatttttcatttaatgatgtaaccagtgaaaatcctaattatgattccattactgcgcttgaaagcatgcagttcgttattggaatagcagaggacatttatgcaccggatgatttaactacgcgctctgaatttttaaaaatgttactgtatgctacagaaaatcaagacagtaactgtactgctgaacctcaaataagcgacgtaacaaaagagcattgggcatatgactatataatgattggaagccagctcggcatatttagtttagatgaactgtatgataataatttttatcctgatgattacatagacagagaaacagcagcagtctggatagcaaatgccacaggttattatgttgatactgacgcagtctttgccgacgagaaggatattcttaatttaaatgatgttaaaagtattgttgccttaggatttttagatgttcagaacaaccagttcagacctaaagataactttatacgttctgaggcagcggttataataaaaaaagtatatgacaattacaccgaatcacagaaagaaagggatgaaaccgtaaatgtcgagtatcaagacaacgtaaaattaattactgttgacaaaggtaacaatatagagaatgacacggaaagtaaaacagacttttctaatatcaccgatgaaatgcgtagactgaacacaggagatataattttaatactaccgtgtgaaacccttgcagacggatatatcgcgttaataaaagatattgtaattaatagcacaaacgccacaataaccaaaggcgaattagactcaaatgatatcttcaaaactatagacatatataaaaaatattcagttcttgatgatacttccggtttcactttagccgacggcataacattcaacaaacctgaagaaataaaagttttagataacaacaacatcaatattggtgttctggctgattctaagccggttggtcttaacgttattggcttacaagtcggaaaatttaaattaaacggaaatattaatataaacgactttaatataacacctgatataaaaggttttaatgactataatataaacgctgatatttcaattaccgaagatttaactgccaaatataatatagaagaagatgcagatgtttatggagcaggcggatattggaagagttacaattcctacattaaccaaagctatagcaaagacgaatttagtaaagatttagaagaagcaaaaaaagatattgctgaaacaagtataattatacacggaactccatttattatatatgtaactatttcagtttgtgtatcagctgagggaaaaatctgctttgaagttaataatactactaaagtagattttgaaattgaaaatttgaacggaaatctttcttttaaaaggaatattaataataatcctaatatttcattggctgcaagcggaattgtaaagtcaggtttagaacttcagctcggtttaagcatatgccgtctaattggtattgagggtgttgttcaaggcggtattggagcaaaatctgagataaatacgaatgataacaacccaaatcacctatgttcactctgtttagacggcgatttatatacatatttacagcttggatatgatattgagcttgcttatttagacccaaagcctgtttatttaaaaccatggatgtcgaaatttgctgattactattattcatttgattacggagattttggctttaaaacttgtcctcatataaaacaaaataatcagcccgttatcggcgccgctaacgaaggttcggctcccggagttgtaacaacagacggcacatatatgtacttcccaatagatgggaatatatggagagaaaacattgacggaagcaatagaactccaatatttaatataaacccagaaactactccaatgaatatacattacagatacaaatataaggatttacagtataacgatggatacttatattgctatggaagccatgattcatatatttcagcagcaaaaacttacagattcaaactctctgatttactcagagaagaatctgaatataattcaaacaattttacgcgaagatatttcgatgattcaatgaaagcccaagaatccggacttacgcaaaaatacggcggcaaatcctggcacatagaaaaagaatatctgttcggcagacaaccgctgaatttatattgcgaaaatgaatcaggagataaacaattgattattaaagatatagaattatattgtgtatataacggtttcgtctattacatacaaaatgacgcattgtacagctataatctcgaaagcggagaaacgcagctgttgaacagcactccacttaactttgaaggaatattcagcaataatatcacttcaggttcctatcaattaaatacagtaggtgaatggatttatttatatagaaagccaaaaggtctaacaggcgatttaggcgaactttaccgtgcaaaaataggagaatatagtttcgaactgctgaaagaaagcgaagaggacaaaaataatttcacatctaactatacactaaatgacagcaatataaacgataataacactagtacaaataatgaatccagtaatagtttaaataacaacggcgtatcaaacgagaatacctttattaaaaataaccatggcgggtatcagctcgacttcaacaacgacggtattcccgaaaatatttacattgaagaaagcgatataaacagcggcacatacgctgtaactatttacaacagcgcaaaaggagagggtgaatttggcctatgcggtgattttgtgcagaccggaaaggcaagcgaatgctatatagtatatgattctaatacaaacttatattatattaaaacagtgacagctttttccgacgcgagagacataacaaaaatatatgcgttaaacggtgttgatttccaatgtattgacacttggggaatttttacaaacaaagatatacccggggactataggaccttatatcgcacaggttttgaagctgtggaattaggctatacctccaatggttcttatgaagcttctgaaagcgaatatgaagaatataaaaatcaatatagtctggatgaaatatactattttggaaacgatataaaataatattttataaacagcaattattttttaagctgttttcagataaatataaataaatccgaaccggcgctgtttaaacaaaaactatattaatataatatttcagcggcggattaatccgccgctgaaatataagagcatttgaatttattactcatataaaattatatcaaaaacattttatacttcattttatttcttttattatattaaacatttgtttcttcccaatacagacttactatgaataatttaagtttaaagcaaaaattaacacccaccgggcgcctaacccggaacaattaaattggaggattgaaaaaatgaaaaatttaagaaaagtattgtgcagtattttaacctgtgtactggctgtgaatctggtctatggcttacagcctgccattgtaaacgccgaaaaagaaatgactgtttctgctgaaacagctcctgaaaatggaaaaaccataactgaaaatattcagcccaacaattcagacgagtacaacttcttggaagatagtgctgcggctgaaaaagaatcttctgaaacagtaaccgatgaaacagccgaacttgcagctgcaaattccaactggattacagcggaaaaattaagcgaaaatgaaaaaaagcaatttacaattaatagtacagatgaagcgctatggtacaaagttaccctgaccggcaatgatgaaactataaaacttaccatagacaaagacggctgggcttttaacgaattaaaatatcgtatttatactgaacaaactctggttgaaggaaaagacaatatcattggttatgattatttttctaatactttcattaaaaacttcaaaacgtctcagcccggaaactactatgttaaaatatatggcgacgttaacgaggaacctttaaatatcagttacactatagttcctcccgatgaaaatgaaaataatgacacctggcagaatgctgctttactatccgaaaatcaagctaaacaattcactataacagccaataacggtatcggttcaattcctgactatgactggtttaagatatccgtgcctaatgataatcaggcaataaaaattaaaatctataacgacgatggttctgattttgaaaacgatttacagtgctcgctgtatgacgaaaaaactcttaaagctaacgggtcatcttatattgcgtacaaaaattacatttcaaaatacaataattttaatatggccaaagtggatgccgggaattattatcttaaaatatatggcggaattaatttaaaaccggtgaatatttcctacgcccttgttccgcctggcgcaaacgaaacaaacgacacctggctgaccgccacatcgcttcagaccgatgtatccagtcagttcacaatcaatgccccaaacgacacagactggtttaaaataggcgttccaaaggcgggtgaaaatgtttcgcttaccattcaaagtctggacgggctggattttgataatcagattttctttaatgtatatactgaggcgactttaagagccaatggttcaagcacagttaaatcaggatacagaacaaaatttatttctgacacatttaccgcggcagattccggaaactattatataaagataaccagcaatgttcatgaacggccattattgattacatactctttaggctcagtaattaccggggtgaccggcgtaagccttgacaaacaatctgtgacactgccgcttgatgaatctatccagctgtatgcacagaccattccggcaaacgcaacaaacaaaggctttgaatggactagctcaaacgtgaatgttgcgactgttgacgcatatggcacggttaaacccaacaatacaaccggaacatccagaataacagttaccacaaaagaaggcgggtttactgcatactgtgacgttaacgttgttcaatcctcaattgtaaaggtaaccggtctttccattgataaaacatcagccgatttgcggaaaggcgaaacactaaatcttaaaacaaatataacgccttcaaacgcaacaaacaaaaacattcgatggaacaccagcaatataaatgttgcatccgtatctaacggaactgttacagctaaagcgcagggaaccgctgaaataacagcaacgtcagaagacggcggctttaaatcagtctgcctggtaaacgtaacagccccggacgcaaaggctgaaggtgtacagctggacaaacacactctctcaatagccgcaggcggcgctgcctcattaaatgtaacattcattccgatttacgcctctaaccaaaatgttacttggagttctgacaatacagccgtagtttcggtagacaaaaacggtaaaataacagcaatatcagcaggaagcgcaaacgtaaccgtaaaatccgaagacggaggcttcacggacacttgttctgtaactgttaacgaatcgccgaaaacatatgattacagtattgaagatttggaaattctgtcagaaaccggagaagcactttcttcaatccccgaaaacggcaatttcataatacaggcatcctataaaaagaacacaaaccgaaatacaaacgactattttattatcgcttattatgatacaaagggctcaatgattggatttaattactctcttatgaatcccgtctcaggaaaaaatgttgctttcggaactttaataccgcagaaggataaaaaagtgtcaaaagttaaggcttttgtgtgggacggtttatcttcaatgaattccttggcggaaagtattgagagataaagatgctcatatttaaatttctttgacatagaaaatagaaaaacgtgttgaagattagatccaaataaagccgcttaaactacccaactgcatccgccctgcaacgcaagtaaccgactgtgttttccgagcatcagcttttctctgagctgtgttgtaattgcctagaattacgtaacactgacagatattttttattttaatattttatttttaccataaatatacgaaaataaaactgctcaaggcttggaaatattttaacttatcgtgacgctgaataaaaataggacttcattataattgaacagatatccaaaggttagaccaaaaatctaacaattggagggtcagctcatattatttgaagccctatttttgtcgctgttatataaaatgactgccattttttgtccatttatacaacggctcttttcaacgttttagccaacgggtaaaaataccagcaatgtgcagacaaaacagatgtgaatacctttgctggataatgtaaatatcgaaactgcatagtgtaaataccggagctggatttaaatctgtattaaataatacataatttgttttttaaatttgtcccatcttatttaacacctttgtctttttcagcgcaaaaagaattacggcggctatcacagttcctcctgctgagctgacaaagaacgggagtatgtacgtccacagcaccgcctcttttcccataagcagagccgcaattggatatgcgcagattcctcccagaactgatgtgccgaacagctctcctatacacgttaaaggtatgtttttggaatatttatataccagtccgcaaagcagcgctccgcacatgcttccgggaaacgccagcaaagtgccagtccccattaagacccttatcagagatgtgacaaacgccattcccactccgtaaaacggtcccaataaaaccgccgccaaaatattcaccaaatgctgaaccgggaaacatcttgaagctccaaccggtatgctgagaggcgaacaaaccacgcatactgctatcaatactcctgctaccgccatcttccacgctattgtctttttcatacaaaacctcctgattttaattttagacacaaaaagggaagcacctcaggtggtgctcccctatatctgtatcagatgaaagaattttatcataaactcacgattatgtcaatagattttttcacttaacaattttagtttcataaataggctgtttatagccgcatttcttacaaagaatatttaaactctttctgtctgaattcacagttaagtttccattaaacttcattccatctttacacctctcttttgttcgttttcaaattcttttatgttattgtcactgctgaacacagctgcaataattccagatatatcagcacctgctttttcgagtatataactttgcattttctcttgatattcagacggcaataccattccgccgtttatgcagacaataataccgtttacagcaaacactctgcctgggttataaaaattctgaaatattttttatatcaaacagtacagtctgataaatggaccgatattatcttctgcaataacagacaatcaaattgtttgtttcctcctttactttaacagcagaatcttcaaaattttctattttctctgtcttccttaatccgattcgtaatctatttgaattaatccaatactaaaatttttatttcaatacattttacaaaaattatggtcgtactaaataagtaattgtatattaacttaattgttttatgttggaacaggtgctataatataacaatataaaattttattagaaagagaaatcaaacatgaaaaacaaacttacatcaacctacactatttgtttcggggctatgctcagctgtctcctatggggaagcgccgctccatgtataaaaatcggctattcgctttttgaaataagcggaactgcgtcccagctgctgtttgccggaatcagatttattatcgccggaattttaacaattttattcggcagtatattgagccgcaaaattttaataccgcaaaagtcgtcaattcccgatgttttcaagctcgccatggttcagaccgtgctccaatacatattctactatatcgggctggctaacacaagcggcgtaaacgcttctattataaacgcctcaaacgtttttgtttcactgcttttctcatgccttctatttagattcgaaaagctcacaacgcgaaaaatattcgggtctgttatcggattcctcggggtaatacttatcaatataagcggcgcggcaataaacggaaacttcagttttgccggcgagggggctatttttatgtcctgcttatcctacgggctttcatcctgcttgataaagcggtattcacagcgtgagaatcctgtgaccctaagcggatatcagttcttcacagggggaatagtccttaccattatcggatttttgtgcggtggacggattactcatgtttcaacccaagctgttatgcttttgatttatttggctcttgtttcctcgatagcatacactttgtggggaatactgctgaaatacaatcctgtcggaaaagtggcggtttttggtttcatgaacccaatttttggcgttatactctcagcatggcttttgggcgaacaaaatcaagcattcagcataatcggagttgtttcgcttctgctgacctgtataggaatttatattgttaattcaaattcaaagattaaaaatttatcatagacttcaacagctcatataaattttaaacgctgggatagcaacatgaataaatactgtcgttttagcactaagcagattttgttaatcacacagattgaaaataataatgcagtattacttgtcaagatataaataagtcagtatttacacaagtattctgcaataaattttatttttaagaattaaactatttatcctcatttttggagattataattatttgtataaattaaagcggaaaccatgcggcttccgctttaaatatgttatttataaaattatatgataagtatctataatataataattaattttatttaatccttatcaacatctaacatgcaaaatacactattagtataaaatccgtcatattattttcttatacataaaatacgtaaaacaagtttattgatatataaaactaaatcaaaaagctttaccgggactgcgcgccttgcgcggcaaactgcgtttgtgttgcgtattcatattattgtttgcgtattcatattattgaccttgtaggtaaatcaaaacaagttattttgtatcacacccaccatgctggtggggtcacagacattgtaggtttatcaatacaagttattttgtatcaaacacacctactggtggggtcacagacattgtaggtttatcaaaacaagtcactttgtatcacaaccaccatgctggtgggggtcacagacattgtaggtaaatcaaaacaagttattttgtatcacaaccaccatactggtggggtcacagacattgtaggtttatcaatgcaaagtgatttgtattacacacacttttttaagtgtggtcacagccctccgatgcttgccataccacattttttatatatgaactttgatatttccgtctgctttattgcggactttccgcattatagttggaaagctaataaaaaccaaaaatgttcactataaacacatttattttttctgtctgtttttctgtttaccttccaataccctattttaataaatcagaaagctgcttgtcagtctcttgcagtaaactctgtatctgtcctgtaatataagttatattttcattaatagatctcgtgccatccactcttatcacaggacactctaatgattgcacccattcctcaacatatctccctgttcgggaacttactttatcgtaaaatgttttttcctgctcgtacatatctcctcccggtaaaattctactaccgaatttctgcaaagagcgctgttttattctttccaaacgaacctctttcggaacatcaatcaaaactgcataattataaaacgacaaaacatcttttccatacgctccttttacagctgcaaacacaaagtttttatatgttacgacttcattcaaaaggatcttttctacctctttatcagaacgtgataaaccactgctataattggaagctgtctgttgaaaaaatagattttcaatatcaataaaatgaatttcaagtttctccgcaagcgcttttcctaacgtactctttccgctaccattcaagccgcacacaataattcctattcccatatatatcatctttccatttttattaataaaaatataaccgcgaataagacagcgcacaacaaacaataattttaatatatattttaagttggctcacaattaaaaaattttttgcatttatctatcttatatttaattatattgaaaatccaccttataagattttataagttcctttgccaaaggctataaacccttatggaatcgacatttttgcttatcaattaagtttccatcgcataatcttataaaatcaagcagaaaattggcggaagttttcttattttgtccacactaatacaatcaatagaatccatacttatcggcttttaagccttgacatacttatttaaacctgacaattaaaacttataccgccgctgtttatgtccaagttgaaatatcatactcaattgcttttggttttaaagtaattatcaacaccgacagcaatcgccctgcctatagtttccgaatcgtttgtcagcacttctaagtcggatgcattatcaaaaaatccaatttccaaataggctatcggtacgggacttttgcagaacaaaaccgcggttgggaaaccttcatatctcccgtctacaaaagcggacagctgtgtgtctgaaacgatttgattatttataagctgacccaaaatattgctctctgatatatattccgccggcgcaagaacaccgctttggtcatacactcccgacaaagccatatacgcgctgccctgacctccgccggcattggaatggatacacacaaagacgtccgcgtccggctcagtagaagtgtcgccgcccgaataacaatacgtaagccgttttgtcattgacgggttttcatcgttcgaatttcttgtgagccttacctcataacccatttcctcaagatattttttggcgtttagggtattgtttaaatttatttccggctcaatatccctgtctccattttcaattggataccagcagcttcctccgtcagggtgccggccgctgcatccgcttccgcggcaatcatcccaaacagttcctgacttccaatggcgccattctccccagccgcctttttctgtgcttaaaacccagccgtcagcagatttgtcttcttcgctcatattaccggaatccttcccatgacccgggtcaagaacaacaatctgctttttaggcgtttgagttggcaatgcgctcgcctctgcagttggaatacttatttcatttttttcggcttcaaaagtctgtctggtaatcgttccgttcagaacaagaccaaaaactattatcaatcctgcgagaataataccgagcgctataactaagcctatcaaatattttctcataatcaatcaaaggtaagatatatctgttttgaatatccaaccgtgcctccataagatattttatagaacgtattgtttggagtgtccaggtacgtaaccttagaacccacaggtatctccataattatattagcgtctgacgcctcagacggcgtgcttcttaagtatatagcatatttcacattggttaccgtcatggtatcagaccatgctcttcctccgctgtacccggcgttgggactgacgctcgacagatattcacgcttggaatatccaatccgcccgttataattaatcttggcaaaaactgaatccgcattttcaataaatccaacctgagttcccaatggtatttcagttatgatattgctgtcgttctcctcaggcaagcttctcaaatatatagagtattttacgtttgccacatacatatatgacaccactgtggtgtttgaacttacgttatatgacggtacattctgaaccggaggcgctgcgggcgcctgagcagccggagccgctgtagccggacttattgttggagcttcagtagcgacaacgggattttgctgaccctatggcaagatataaagagataacagagcaaacaacaaaatcgaatcctgaaacaatgggcagatttcatacaaattggctcaatatgatgtatcccagattgaggttagcagcaaatttgcttagagatgacggcgttatctttattagtattgatgataatgaagtgtttaatcttaaaaaggtttgtgatgaagtatttggagaggaaaattgttgtggtattgtttcgcgtttaatgaaaagtggcggagcaaaaggacgatttttttcacctaatattgagtatatcttagtttatgcaaaaaatatgacaaaaataggttgttttagagagtctatttcagatgaaataattaaaaaattgtatacatcggttgaagaatgtggagagcgaaaaggtgaaaaatatcgtccctttggtctatatcaatcttctttagatgcaagacctaatcagcggtattatatagaatgtccagatggaacattagtaattccgccgggcgaaactatgccagcaatccacaaagacggtgagatggttataccaaaaaaaacagatggttgttggcggtggagtagagaacgatatattgaagaaaagctaaagggaaatattgcttataaaaaatcaaaaggtgtgttgcttaattcggatggacaaccggcagaatggaacatatatacaaagatttggttaaatgaccgtcaagaggaaggaatggttcctgttgatttaattacaaagtgggaaaatagacaaagtaaaaaagaattacaacagttggggataccttttgaatttgcaaaacctgttgacttaattaattatcttataagtattgttgggaatacaaaagacagtattattcttgactttttctcaggttcggcaacaaccgcacatgctgttatgcagttaaatgcagaggacggaggaaacagaagatttatatgtgtgcaattgccggaactttgtgatgaaaaatcagaggcgtataaagcaggttataagaacatctgtgaaataggcaaagaacgtattcgacgtgccggaaagaaaatcattgaagaaaaaggcggtcagattggaatagacgacgaagaaaagaagccgcttgatataggttttaaggtattcaaacttgatacctcaaatcttagaatatgggataatacgccgattacgggtgataatcagatagagatgtttacagagcgtatgaactctatgatagacagtatcaaagacgacagaaccgatatggatgttgtctatgaggttatgctgaaaatgggagttccgcttgatattcctgttcaatacatagaagttaacggaaaagtagtttatattgtgggcgatttccttttaatgattgcactatttgataatataacagcagaagatattgaggcaatagctgaatatgctccggcaaaaatcatttgtgccgaacacggatttgcagatgattccgcgctgtcgaatgcacattatattttaaaggatagacaaattgaattgaaactgatatgatgtacatgggttccgtaggggcggattccatatccgcccgaataatcaaaaacacatttatacaaacaattgacatgtatgaatatatattgtccgatttttgttgtaatgcaaaaccatttccgttgtataattgcaatccaaagggatgtggaaacccgggcggatatggaatctacgggcggatatggaatccgcccctacggaaccatatatattttgtgggttgattatattgaaaaattttaacggttcaaataatgaattgttataatcttaaggtgataaatgatgaaactaaaatttaaaaatcaagactttcagacggacgctgtaaatgctgttgcaggtttatttcaggggcaggaaaaactacagtctactttcgaaattgttcaggatgcgcagatagggttatttcagaatgatttgggtattggtaatgctataaatatatccgatgagcagttgtctcaaaatatgcaggaagttcagcgacggaacaatcttcctacaacggagataactgacgatatgcgttctttctgtattgaaatggaaacaggaacaggtaaaacctacgtatacactaaaacaatttttgagctgcacaagcgttacggctttacaaagtttattatcgtcgtgccgtcagttgcaatccgtgaaggtgtatataaatcatttgaaataacaaaagaacattttatgaatcaatacgacaatgtgccgtgcagatattttatatacaactctgcaaagctgtccgatgtaaagcagtttgcaacaagcagcaatattgaaattatgataataaatatagatgcttttaaaaagagccaaaatattataaatcaggcacaggataaactgaacggcgaaacagctatgcggtacattcaagacacaaatcctattgttataattgatgagccgcagagcgttgacaacacgccaaaggcaaaagaagctattgcttcacttaatcccatgtgtgtatttagatattctgcaacacacagagataagatgaatttgctttatcgattaacccctgttgatgcttatcaaatggggcttgtaaagcagatttgcgtatcttcaaacacggtggcaaatgattttaataagccgtatataaagctggtgtctgtatcaaatgataacggcttcaaggcaaagcttgagcttgatatacagaataaagccggtgctgtttcaagaaaaacagtaacggtaaagccgaataatgatttgttcctcatatccggaggcagagatttatatgaggggtattctgttgccggaatagattgtacgcccggaaaggaaagcatcgaattttcaaatgcggaatatgtcgcgcttggtaaggctatcggaagtgttgacgagaatataattaaggaagcacaaatcagacgaacaatacaggctcatttagacaaggaattgcgatataccgaaaaaggaattaaggtgctgtcgctgttctttatcgacgaggttaaaaagtacagaacagcagacggcgaacagggaatttatgctgaaatgtttgagcgctgttatgaggagcttatcaataatccgaaatatgctccattgaaaagtcaatttccagcaagcgtggaaaatgtccatgacggatatttttcacaggataagaaaggaaccttgaaaaatacaaagggtgatacactggcggactatgatacatataacaccattatgaaggataaggaatggcttttatctttcgattgtcctctccgctttatattctctcattctgcactcaaagaggggtgggataacccgaatgtatttcaggtatgtaccttgattgaccagaaatcaacctttacttgccgtcagaaaatcggcagaggtctcagactttgtgtaaatcaggacggagagcgcattgaggataaaaacatcaatatccttcatgttatggccaacgagagttttgcggagttcgcagaaacacttcaaaaagaaattgaaacagaaacaggcgttaagtttggaacgcttcagataagtttattcagcggcatgaaatataccgagacaaatacggttgagcgtactatcacgcaggagcaggcgcaaaagacaattgaagccttaaaacagtcaggcgccatatccgaaagcggaaaggttgagaagaagcttgaagaaataaaagaaattgaaatcccgcaggagcttgagcctgccaagagtgagattattaaggtgattgaaactgccggagaagtcgacacagaaactcttaccgggacaacttacaccgaaacgataattgaagaaaaagaagtctcctatgacgatgcgaaggagcttatacagcattttgagaataagggctatgtttcaaaatccggaaagatgaaggacactatgaaaaatgcgcttttaacaggtacgcttgatttgcctaaaaagtttgaagccgccagagaacgattagaaagtgttgttaaaaaggcagacagtaaattgccgattcgggatgcttcaaaagaggttattgtacatctaaaaaaacaggcgatgttgtcccctgaatttttggaattatgggataaaatcaagcagaaaacagcgtatcgtgtacagatagatactgaaaaacttgtagaaaacagcgttaaagatttaaaaaatatgccgcctataccaaaggcacggcttgtatctcaaacagcagaaataagtattcggaatcccggtgttacatatatcgaaagggaagtgagaaccgccgatatagcagatacatattcaagccttccttatatagtcggtattattagtgaagaaacacttattaaaaaggctacagttgtaagaattataaatgaaagcggcagagcgcaggactttctgaacaatcctcagacatttatggaaaaatgtcttgaaatcatcaggcacaacagacattctttggcaattgacggaataaagtatgtgaagcttgacggtcagcaatactatgcacaggaaatattcgattcagaagagcttgtggctaatcttgataaaaatgctgttgcggtaaataggagcgtatatgaccatattatatatgacagctcaacaattgagaagccatttgctaaggctcttgacgatgatccggatgtaaagatgttctttaagataccaaatcgttttaagattgaaacgccgattggaacctataatcccgattgggcagtatatttagagcgagacggagaaaagaaactgttctttgttttggaaacgaaaggaacgactgaattattcggacttcgaacgccggaacaacttaaaatccattgtggaacagagcattttaaggcgcttgaaaatgatgtcgaaatgagagtggcaaaggactggaaggaatttaaggttcagaattaaaataataatcgaaagattaactattattatacagaataaagtcaaatatttatgagaagtataaaaacatattgtttccggattttgaaatatacaattaaacgttggtctgatacgtttgatttgatataaacaatgatgcttatggttttacaaatttataatagatagaaaagcctgtcggtttagaaatcgacaggtttttttgttgcagtagtttatgggaagcttttggagattataggggaaatatttttattataataaaatcgttagatagaaggtgttgttaagccatcctgtctgccggaatgggcaaaaaacaaactggagcttgaacataaaactaaaacaaagaaaaaatcacataaggaaattgaaagataggagatacctatgttttttttaagaattaaaattgaggttacaaagggcttgtataatgtcatacttgcggaaataaatcagtatatagaaataacggacggtgaggataagacggaggctgatatattctatagtgaacaaaaatgaagatacattgggaatggtaaaccgactttgcagaagtgtatattgtatggacgggtgtgttgaagagatatttgtaagagcgctgagagcaggaaaaataaagtattaagcatggcttgtgagcagctgaaatgctaagaaaaggtgtgaaaaaagtataagcaaataaaaatatatttaaacttaaagaacatattttaaataaaaactattattgttgtctatattaaataatataagattactgcataaggagaaaaaatatggaagatataattaaaaacatttcaagggcagaggtagtaaagctaaaggatgagatatccagtcataaaggacaggtggttagtaagactttagcacagaatgaggcagtgagtgttacattatttgcattttcagacggagaggaaataagcacacatgaatcgggcggggatgcttttgtaacctgtttggaaggagtagggaaaataactattgacggtgttgattatgaaattagcgagggtgaatcaatagtaatgcctgcccgacatccacatgccgtatatgggattgaaaattttaaaatgtttttagtcgttatattttaatatgaggaataatgaatttgcagagtattgaattaaatcaatactctgtttttatatatgggaggtgaaacaaatggcgaataaagtaaagtacatatcggagctgtcaaagtcaacatcaaatgagctgtccggttatgaaagctggacagcttttttacgcagtgcagcatggtagtataaatatccgtttgaggaccagcttctgatttatgcacagcgtcctgatgcaaaagcatgtgcaagtatggaaatatggaataggaatcttcatagatggataaataaaggcgcaaagggtatagcgctgcttagggaaaacggaaaccgctatcatcttgattatgtgtttgatgtagcagatacaaatagctcatataaccgtgaggttagtttgtggcagtatgatgagcgttacgaaaatgctgtaatagaaacgctcagcaattcctttggggatttaaaagttgatgtcacagtacgggatgcggttatttgcgcagtacataatgcggtacaggataatgaggctgattatcttaatgaattaaaatatgcaaaagaaaacagctttctggaaggtttggatgatgtgaatcttaaccttagatttagacagacagcggagacctcagctgcatatatgattatgcagcgaatgaatcttcgtgacatgtttgatgaatatgaatttcaatatatcagggattttaatacgccagagaccatatcaatcttaggtaatatggtaagcgcaatttctgaggaagcgttaagagatatttcccaaacgatacgcgcagagcaaaaacgggaaagaaatcagccggaattttttgcggaaaataaaaacagggtatataatatagacagagaaacagataataatgaaaggaatgaggaaaatgacagaagaaataatctacagccggaacggagattatcagataccgaacttaacggtaccgcaggaggaatatcagataggcaaatacggaatgatgaggaaaacgtatctgaagcagtaccgcagaagcctgtactcgtcgttgatgataaaaggcgagctgttgagccatttagcggagatagacaggacagcgacagaacagatacagcagatagtaccgaaaatggtagaagcggagggagtaaccgaagcaatgaaagtcaaatacccaatgatgtagacagggttaatgaacaactttctgcattctgcggaagaaacagtactgtcggagctggtatacagctaagtcttgacgatatatttccaaacctagagcggcagcagaatattgtaaggcaagcggagcaggcggtaaacggctccgctttttctatgcccgaacagattatagacgaagtcttgacttcaggaggaaatcatcgtgacagtatacttgaaattgctgtacagtacagtaaaaacaaatcaaacaatattgaatttttaaaagagcattacagcacaggcggcaaagggtttattttcaataacagaaaggtatctgcttggtggaacccggacggaatgcgtatatcatacggtgatactgcaatcgggaaaggtcagcttttatcatgggagcagatagatagaagaatatccgagctgctcgaactcggcagatttgcaccgcaggaaacacttgataaaatcaatcaatatgaacgcagcaaagcggcaagcgcattttggtatatggagcgtggaaaatacatcggtttagcaggtccatctctgcgttagagacatattctgtaataattttagttttccattttaattttgaataacttgtagactctatattcaaatcattttatttaatttgttcaataaaattcttttgcttaatatttttctccttttctttattttgtaatattagctcctactaaattatcgattccagaaggatgtttatgaacttttataatttcattcccatttttttgaattcttttttggaattatattatatatgctattgacataattctgtaaaagaattataatcgatttattgatagaaaaaaatataatagaacagagggaggattttaatatgaaaaaaatgtttttgtgtttaagcatcataggtatgatgcttattggaatatgcggtggtacgcttaaagcaaatgcagctttaaatgaaagaaaaactgtttatgtcaattcagtagaggagtttaatactgcacttgcgtctgatacagaaattattctatctgccggaaaatacaattttgggcagagaccggttgaaattataggacttagcaatatagaaattagaggaaccgatatgacacaagtggtggttgaaacaggagatgagtgtatattttatgtagaaagctctgataacatctgttttgataatttgacaattggccatgagcttcaagattaccaaaattcattttgtcctgcagctgtgatatctatatttgattcttatgatattagcatagaaatgtgtgatatatacggatgcggcaataaaggctttgttgcttcacaatctcagaatttatctgtatttgcgacaactatcagagattgttctaagagcatagcacaacttaatgaaagtgatgtatgctttttagcatgtacattttcaggaaacggttactatcaatatccaagcaattatgcatttgatacaatgacttataccaaagataaaagtgtagatattatttgcagatattgtaatttcactgacaataaaaatcctgaattaattgatttaactgaaaaatatcacactgtcaacgctttgttcgaagactgtagatataataataatagtttttcagactttaataattatgaatcagatcctaaccttattattaatagttatcatatgaaaaatggcatgattacaattaattatttcagttttaatttcacttccgaagaaatagttgtgcctgacgatttcgcgggctatcccattatagctatagccgactatgcgtgttccagcgattatgttaaaaaaataaccttgcccgaagggttaaaaaaagtagggaataatgcatttgctgaatgcggcagcttagaatatatatatatgccaagcagcgtcacatttatcggggaaaatgcactgccttctaatagtaatatttcaatttatggagaagaaggaagctatgcacagacatatgcagaggaaaatggttttttatttaataaaaattcacatgatgtatcgaatattttcacatacataattgaaaatggcaaaataacaatagctacttgtaaaaaggatgcaagaggtactattattattccttctgaaattgaaggttatccagttacagctattgcggaaagtgcgtttgatagctgtacaaacttaaaggaaattgaaatcgcagacagtgttgaaagcattgatgatgaggcatttcacaattgccaaagcttagcttcaatacatttacctaaaagcttaaaaagtattggaaatgtaaaaattccgtgctatgttttttcgggttgtacttcattgaaggaatttaccatagatgaggactgtgaatatttttcagtaaaggacggcattttatataataaaaatataaccggaattgtatccataccgcctgggaaagaagagctttgtattccggcatctgtagaggaacatttgaccggtgattttgatagcgtatataaccaacacattacatatcctattcaagaagcggtgtcattaaaaaaaattgatgtagatgagagtaatctaaacctagcgtctgacagcatcgctctttacagcaaggatatgtcaactattatcgcttatcctcgcggaagaaagggctcatacaaaataagtgatgcgacaacaacaattggtggcgcgacatttacacattctaaaaacataacagagctttttgttcctcaaacagtaacagaagcaaaaataggctatggtcattattttggattggtatcttgccccaatattaacatttgtggatacaccggatcttttatagaaactgtggcgcaaaaagaaaaaattccctttaccccggttcagacaatggcagaaataataggaattaaaaagacagaaaaaggatataaggtagatctaaaaattgatcatgatacttctcaggatttacaaaattgcagggttctgtcagcagcatacatggatgaagaaaataaggaaataataggattttcaagtaaaggctttcaatttaataatggtgaaacttctttagatactattgaggttgcagcaaacgaaaaagtaattaagaaaatcaggatttacttttgggatagtatagattcaatgaaagcatattcagcgccatatgaagtttatatagaagaatagaataaatccataaaaaaaccgaatcaaagcttaactcaatcttttttcaaaaacttgcaaactcattttcaaacattttataaaataaaacaggagttaccgacagaagcgctgatactgaatacgtaaacaagaacatgcctgcgatgaataagtttacggatataaaagataagagctactgggcattttatgatattattgaagcaagtaacacgcatatggctgttaaaaactccgacaatgaaacttgggtgaagtaaatttcactaaatattgcatagggcagtttgaatttataattgccctattgctgtatttgtagtataatatatctaacaacaaaatctaagtttatgtgaaagtaggttaaggattaaaatgactaatacagatgaagcagtgaaatatttgtcataatattcattggaggatgttctatctggaataatcgaaatgcagatgttgttatatggtgatggtgtggattcgttgatacctgcatctgaatattttgcaactaatgcgttatttgcatgtaaaaagagtggaaataagccgtttcaatgggaagattatctggaattagaaaaccattgtaaacagctttttattccaattattgaagaattgttgatgaaatactggattttttagatgcagcagatgaagaaaaagagtcgtttttacagtctctaaacatgaaactcaaaaataagatatttcgtggtgatggatatattcatcaacttattagttttgcagaaagcttgtattctaaattagattcggaaataaaagccgaattgggtttttcttttacctcgtgtaaaaaaatgatcttatatattttcaatacatacggagccagaagcgtaaaagcgtgcttggaagactataaaaatgaaaatatgatggaagtagttaatggaaatagtaaactgcaattatcaagtataaaagagggatatattttcagaataaataaaagtgacttgcgaaaagttattaattcaaaagaagtagattgtatttgtgattattttagcgttaaagccttttcgggagattacaaaaaggtggatttagaaggatttaaaatattggtatcaaagccgtttgttgattttggagattatatatacatgccgctgttattttcgacattactaaatttgccaaagctctttcattatacttttatagcagaaaaattttttgataaaaaagtggtaggaatatatactaaaaatagaggtgatgttatagaagatttaacacaactgtattttgaacgattagttaataaagaatatatatttaaatctctgaagtatacagatggtgaggctgatgtgactgtatgtatgccggaaggaactcttttttgtgagtgcaaaagtaaactgttgacgcttaattcattaaatggagtaaatgacaatattaaagaggatgtgtataaagcaattggtgcggcgtatatccaaagcgttcgttcaataaaacgggtactaagtggaaaatcatttataaaatatgctaatggaacagagcagaatgtatatattgaggatacagaagtaaaatatgttatttgtgtgactgctgaacattttggaattatcccttcggaaattacagaatatgttgagattgataaagatgtcaatataataccatatgttgtaaatatttatgatttggatattattacacaggagtgtgattcgtatgaagaatttctagggtatcttaattttaggcaaataaatcataaacttatttcagctgtagatgaattggttgtgtttggtttatataaaaaatacggtaatagaaaaatggatattaaagatgatagtctgtatataacagattacacgcaacagttcgatgaaaagtatgccaaaaaagataaggagtgtttacaaaattttataattaattaaaatataaagtttagtttattagattatataaattatcatgagggcaatccgaaaaaaggactgctcttttttcatgccgcaaaaggaggagataacaataaaaaacagagatgattgggggaatagcagttgaacagacaggagaatacaaaaaccataataatattgcttgcggctcttttcccggtagtaatatggcttgcgttaatagcggcgggctgctatgagccggaactaaaactgtttgatttgattcaaaagtttacacaagcattaaacagaccgacagaaatacatataaacgagtatagcttaaaaactgtactcgtttttgtatttctctacgctatgggtataggcgcatatttttcaaaccgtgagaaccgtcgtcccggagaggagcacggctctgcaaaatggggcaatgtttcaagtattgtaagaaagtataaggataaatccgatagatttcaaaacctcatattatctcaaaatatgagactgggacttaacgcaaaaaagcaccggcgtaatcttaacgttcttgttgtaggcggctccggagccggcaaaacccgattttatgcaaagccgaatataatgcagtgcaacacatcatatataattgctgacccaaagggggaaatgctccgtgccgcggcaccgcttctgctggagaatggatatgatgttaaggtgtttaacttaattaacccggaggattcagacggatacaacccttttacatatatccgtacagatgaggatgttataaaactggtaagcaatttgatacagaatacaacaccgaagaacgcacagcagaacgatccgttttgggagaaatctgagattgcgcttgatacagcgttaatgctgtatttactgcatgaagctccgccgtatgagcagaactttgaaatgctgatgttcttaattgagaatacggcagtaaacgaggacgatgaggaacagtatcaatcgcccgtagatatgctgtttgatggattggaggaagaaaatccggagcatatagcattaaagcaatataaaatatttaaacaggcgtcgggcaaaactgcaaagtctattcttatttcggcagcggtaagacttgccgcttttaatttacctgacattgcaaggatgacttcatatgacaatcttgatttgggcagtctgggagagaaaaagtgggctatattctgtgttattcctgataatgataactcctttaactatcttgtcggaatgttatacacgcaagcttttcaagagctgtactatcgtgcagaccacgaatacggtggtgagctgccaatacctgttcatgtaatgatggatgaatttgcgaatgttgcattgcctgataattttgagaggatacttgcaaccatgcgctcaagacgtatttcagtaagtataataattcaaaatatggcgcagctaaaggctttgtttaaggactcatacgaaagtttggtaggcaattgtgatacgtttatatacttgggaggcaacgaacagggaactcatgagtacatatcaaaaatgctcggtaaggaaaccattgacacacgaacaagaggaattacaaagggacagcatggctcaagcaatacaaattatcagaacacagggcgggagctgttaacgcttgacgaggtacgtcttttggataacagtaatgaacttatatttattcgaggtgaaaagcctattatggacaagaagtttgatgtaatgtcacatccgaatattaagctgacagaagacggcggcgcggagccgtataagcatagtaaaaataataagcgctttaagagcgatattagctttactgaccctaaaacaattaaaattatagaatttaagacggaggaaaatataaatgaaaaaaatagagaagatagaaaagataaaaaacgtaataagaataattaaatactcattggtgctgtcattgtgtatgctgctgacaatggcgtctccggcttttgccgacgaccctcttgcagcaatcaacggattatctgattttatattcagtgcaataaaagcaataggctttattttgcttggctttggtgtagttcaaattggtttgtctttaaaatcgcatgacgcttcacagcgtgccaatggatttctaacattcttcggcggtgtggttattgcgttcgccaaagatatacttgatatgatattataaaaacttattgacaacaccctattggatagggtataataataacaaagcaaggtgataatatgagaagaaaatttgttatgatgcctatttttgataagcagtggaaagctatgggattaactgatgatgatttaaggttgcttcaagaagagctgctgaaaaatcctaagtcaggagctgtaatgcaaggcacaggagggctcagaaaactaagatttgcatttccgggtcgtggtaaaagcggcagttgccgtgtactttatattgattttgttattgacgagtcaatatattttatttttgcatatcttaagagtgagatggataatttatcaagggaagaacgaaataatattaagaagttaattgagcaaatagagagagggctgtaaggaggtgctgataatgagtgtttacgagggaataatgaatggattgcaagaagcaattgattataacaagggaaagatagaagcccgcagtaatgtattgtcaattgatccggttcctaagtttgaagctgatgatataaaaagcatacgtacagggctcggcatgacacaatatatttttgcaggagctatgggagtatcacaaaagactgttgaggcttgggaagccggcagaaatgttccgaatggtccggcgagtagaatgttgtcaatgttaaaatctgatcctgatttacttgaaaaatatcatattgtcacaaaatagataaacaaatgttaatggtgaagagcaatcaatctttaagaggatagattgctctttttgtttgcagtatagtaaaattagtgttatcggaggtgaatcaaatttgagtgataactggatagtagcaaaccttgagaacgcattttcgatttggaatgataaaatgacggagatatgggatttaataaccatgtctcctcagcagtttaaaggcggagctatatagaatataattacgaacataaacggaggcttgcaagcaatcggatacggacttctaatactattttttgcaatgagcatctttaaaagcacggcaagtttcagggactttcagagacctgaatatgcattgaagcacttcatacgttttgtcgcggcaaaagtggcaattacatatgcacttgatttaatgacagttatatatacaatatgcggcggagtggttgagcatatagccggaagccttggaggtatcagcggagcagctgtaacacttccatcggcaattgaaacggctgttgagaacgcaggcttctgggcaagcataccgctgtggcttgttacaatactgggcagtctgtttataatggtcatgtcatttattatgatattgacggtatacggcagattctttaaattgtttatgtacacggctttagctccggtcccgctgtcgtcgttcggcggcgaaggaacaagtcagatgggtaaagcgtttttaaaatcctatattggggtatgtcttgagggcgctgtaattgtgcttgcctgcataatattttcagcatttgcaagtgcgagtacgcctaatatagacacaagtattacaacggtaacaatgatatggaaatatatcggagaggtcatatttaacatgcttgtattagtaggacttgtcaaaggcgctgaccgcatcgtaaaagaaatgcttggtgtgtagaataaaataagcaaaaaattaaaataaaaataggttgtatttatcctatatttatgatataataatacagaggtgattaaatatgactgtagacacaaaactattggtaccaatgacagatgcaaatcaaaatttttcaaaagttgtgaagatggtagacgagaaaggaatggcagttattttaaaaaataacaaaccccgttatcttgttgtggattttgctgaatacgatgaaatacaagctgcaagaaataagatgatagataaagcagcggatgaattaattgatgaaaatttagaagcttttcaggagttggcaaaatgattattttaacagcggaggaaatatagaaagctcattgataaaaccggaggtttagatggagtaagagatgccggacttcttgaatcatctgtaatgagctgtatgcagacgtttgatgatcaagagctgtatcctgatataattgataaagcggcttggataactttttctatttgtaagaatcatccgtttattgatggtaataagcgtactgctgtactttgtatgctgactatattgagaataaataaaatagaaatatcgtatacacaaaaggaactaatatctcttggattacgtgttgcagaaggaagtatgggatatgaacaaataatagaatggatacgtcgacataaaatttaatagcaacataaaaataccgcagtaatgcggtgttttttatacaaaattttagaaaaggagatagctatggaaatatatcggagaggttatatttaatatgcttgtattagtaggtcttgttaaaggcgctgaccgtattgtcaaagaaatgcttggtgtgtaataacttaataaatttcaatcttgctgttgtattttacgatgaattatgatataataattacagcaaatataaaggaggaatttattatgcctaatattagacctgtttcggatttaagaaactatagtgaagtattaagagatatttctgttgatgagcctgtatttttaactaagaatggcagaggacgatatgctattgtagatatggaagaatacgaaaaaaccaaggcgactataaagcttatgtcaaagctatcagaagcggaacagtcggtgaaaaacggtgaatggatttcaggagaggatgtaaagaaagaattaggtatatgatatggcaaaaataagacttactcctgctgctgtgacagatttacaggagataaaagagtatatttctaaggaattatataatcctatggcagcagataggattataaataaaataataaatgattatacgcttcttgaaacatcaccgtttatggggacttcattatcatccatattgcctgttaaaactgattatcgctattttgtgagtggcaagtatcttattttttataaggttgataatgaatttgtttctatttacaggattttatatgggcgcagggattatatgagaattcttttcagtgaaatagattccgaaaatgaagaagaataaaaaataaacaatatttttcaccgcagtaatgcggtgtttttttatacaaaattttagaaaaggagacagctacggaaatacgaattaacaaggaaataaaggactatcatgagagcctgtttttcggactatcattccgtcagtttgcctgctccgttgcagcagtcggcgctgctgtcggagtatattttgggcttcgcaatattgtaggtaaagaaatggtgtcatggctttgcataatttgtgcagctcccattgcggcagccggattctttaaatacaatggcatgaatttagagaagttcgttatagcatatataaaaagcgaatttctctgttccggcaatagaatatataaatcagaaaacgtgctttttaatctatataaggaggttttagcagatgataaaaataaacaaaacaaatctaaaagaagaaaaaagaaaaattcctaagaccgtgcagcagtctataccaattaaaaaaatatttaaggacggtataatacagtgcggaaatatattttcaaaaacatggagatttacggatataaattatgctgtagcctcggacagtgaccagctggaaatgtttcttgcgcattcggcgattttaaacggtctgcctactgatgcagtggctaagataagcatatataacaggcaattagataaaaatgtgtttaagcaaatggtatcttcaagcaatgatgataaatattctatatatacatctgaattaaatgaactgttagcagataaaatggccgaatcaaacaacattgttcatgaaaaatatattacagtatcaaccgaaaaaagaaatatagaagaagcaagaacattttttacaagagtaagcaatgaccttacagcggatttctctaaaatatcatcaaagattacggagcttggaatcaaagacaggctccgtattttttatgagttttttagaaacgaaagcagctttgaatttaatatgaaaaaggaaatggcgcgtgggaatgattttaaggattacatttgtcccgataatattgaatttaaaaacgaccatatcagaatagggaatagatatgcaagagtgctgtttttaaaggagtatccgtcatttttaaaggacagtatgctgtcagagcttacggatctatcaagaagtatgatgctgtcagtggatattcagcccatcccaactgatgaggcagttaaggagatacagaaaaagctgcttgcaatagaaactgatataacaaaatggcagcaaaaacaaaatatgaacaataatttttctgcgacagtgccgtatgagctggagcagatgagaaaggaaataaaagaatttcttgatgacttaactacacgtgaccaaagaatgatgtttgtaacagttacgcttgttcatgtttcggacagctttaaggagcttaataacgatacagaaacgctaaaatctatcggcagaaagcatatgtgtaatttctcaacgcttaaatatcagcaggaggacggattaaaaaccgtgctgccgtatggaatcatcaatatagacgcagtgagaacgcttacaacggagagcacagcagttttaatgccatataaaacacaggagattattgacgacggagggttatattacggtataaatacaatctcacataatcttttgatgtgtaacagaaaggaactgcttaacggaaacggctttattttaggagtatcaggctcaggaaaatcatttgcggcaaaaatggaaattgctatggccgcattgtttacagatgatgatataatttgtgtcgacccggaacgagagtattcaccgcttgtgacaaacttgggcggtgaggttgtaagactgtcgtcggcttcgaaaaactatataaacgcacttgatttggaaagagactgcaataaggatgaaaaccctgtgtcaatcaagtcagagcttctaatgtcaatgttcgatcaggtgcttcaggagagctcttcacgtttgggtggaggggtaggtcctaaggataaatctattattgatagatgtgcgtctaatttatacagcagctactttaataataaaaactctttgccgcctactttaatagattttagagaagagttattaaaacagcaggaaacagaagctcatgatttggctcttgctcttgaactgtttacaacaggtaatcttaatgcgtttgctcatcaaagcaatgtagatgtaaacaagcgtattataagctatgacattctggagcttggagaacatttaaagcccataggacttcttatcatgcttgacaatattatgaaccgtgtaattgcgaacagaaagcggggaaaatatacaagagtatatatcgatgaagcacatctgtttttctctaatccgtttagctcatcgtttttattgaaagcatggaaacgctttagaaaatacggcgggcttttaacaggaatcactcaaaatatagatgagtgtcttagtaacgatacggcaaggctgatgcttggaaacagtgagtttctgcttatgcttaatcaggcggctaaggaccgtgagggactgacgcagacactaaatatatcagaggttcagataagctatataacaaacgccggagccggacgtggactgataaaggtaggcggctctattgttccgtttgttaatgagtttccttctgatacacagttatataagctcatgagcacgaaaccgggggaggaatagaatttatgaaaggtaagaataacccggagctatgcccaaactgcaaaacaggttatgacagctatcttttagataatagaagcccattctgtccatacctcagataccatgacggcacagaatgcaaaatgtttgtagctatgaaggtatttgactatgatattgaaatcgaccgggaggaatcagaaaatgaaaaataataatctttataagctcgcatatgctgatttactgacaggtatgatgaataaaaacgcatatgaagaaagactgcaaagcttcagaaataaccctgacagtataaataaattttcggtagcaataattgatttggataacttagaatatataaataacatatacggacagcatacggtagatgaggcggttaaaattactgcaagatgtattttttgatacactgggggaaataggtatgtgctatcatataggcagcggtaggttttcatgtgtggctgtcggtgatatatcaggatatgtctcggagctgcgtgatttagtttcatttgaaactgcaaacgacctgtctgtttctgtcgggtatgttaactataataataaatttaacgatattgatgaagtgataaggtattgcgataaaatgatacaagacgaaaaaaatataggctagggcactgaaaaaattcagtgtttttttctttagggaatggaggtgataattattgaaggatgtaaaaacaaagcctaaaaatgtatcagcgcctaaggataaagtgaaaagtcaaaagacgtttagcaatgctgcacaagatattaagactaatttaaaaaatcagtatattcatacaaaagcagaggcagctaataaaaataacgaggagcagaaaaatcctgaaaactatgcggtcgataatgttgaatatgaagcaaaaacagtagtacaaagcgtatacagtgcttcaagcagatatataagcagtaagctgaaacaaagaaatgagcatacggatacatacagcaatacaaataataacggtaatactaaatattccgaaaatgcttacaaccctgttaaggaaaatatacagttgaatgagcctaagcagagaaatgatgtaaaagtctgaacatattccggagccgcaacaaaaggtaattgtcaacaattaggaatgggggataccgagaaaagagatagttttattgatgttgttgctgtgtggggcaataaagaaataataaaattagaaacacgtggaaatacaacatttgctttaacgtctgataatattttatatggatggggcgataattcaaaaggacagcttggaaacggcactactgaaaacgaattggagccaatacaaattagaaccggagttaaagatattaaagccggacttgagcatactgtggtacttgatactaatagacgtgtttatgcatggggcagtaatgaatataatcagataaacagttcaaataataaaataataatgactccgtatatgataactgattattcggagttaataggagcaggagattatcaaacatattatcatggtacagattttgaactatgcggtataggaaagaatgaaagaggaatgatttcaaataatcttcattctctattttatatacaaaaaatatcgtgtggtgataaacatgcagctgccattgacttgaatggtcagctctgggtttggggcgacaattcaaaaggacagctgggagtatatacaatgacctcaaagatgtcattcaaggaaaaagaaacagtaacggaaactatagaaggaacagatacaggaggaaaaacatcatatgatgttacagctcagtcaggaggagaatatattttaaaatatgttgctaaaactgatggtacttatacatttaacactgtttcaaataatggcacttcgttagtcgttgctgcatataaggacagtaattttacaaagccatataaacagacaagtaacaatggattgttacaagtaggagctgagaaaaattcaacgatttatttaaggtatataaaccctgataatatttccttttctgcaactaccacagttgaaaaaatatctgatacagttgaggataatcaaacggtatatgcgatattatatgattcgccatatttcgaagaaggatatgcagcagacggcaaatttttaggcagccgctatcttggttcaaatcttgatgaaagatatgaatacaatactaatggaacggaaggaagcaatgagttttttaagaattatcttagcttagtgaaagataaaaatgtggtttttgttatttttataagagatataacatttgatacagatgaaaacggtatttccatgactcttgatgaaatacataaaaactatgcaacaaaagcaaatgatattacacgttttactaatgatataataacaaatatgtataaagcatatatggagcttgaggagtgggaaaagcctggtcagataccgcagatatacatagaaactccggattttagcgcggttggtattgatgaacaagaatataatttaaagaagagttttttggatttgtatctagatatgtgtaaaaaaatatataaagatgttgaaaatcatgttatcgaacttgaaaatggaaatttaaaaaaggtgcttactaattgtattgcaggactatattatggaaaagaagacccatttgattattacaaagatacaaatgaaaacgatggaaaagaattaaaaaaagaactatctgatagcatttatgcgttaataatgaaaaatgtttctgattatattcatgacgagaataaaaagctgatatggtttccatatacagctggtcagaaagaacaattgaagtgtattggtgagatagcaaatacaggcaaagtttcaaatgacaaagatttatgtgatattgttattattcagccaaattatttttattatgaaatgaatatatctgcgggtgatactggatatatggaaacgatgaacgatatttaccagagcgcagctgacaactgtgtgaagtattgggatgaagaagaacagaaatatgttactgccggcggtgagaaaacaaccgatactttggtatcatttcagatcgagtatgatatgtcgcttgtatcaggaagagatactggtgaaaaacaaaatccagtagataaagcagataagcttgcttatactatatccgtatttcatgatttaatttacggtaaccacagtgatcctggaaatatagttgagcaaaaatctttcggaatatatgccggcggaccaaatgaacagggctatacctgggaagttttaaatcctgacggaggcatgaacgtcaacacccatagtaatagaaattttgttaatttattgggagatatgggtatggtgcatttttatgaaatgagatactatctaagtgtatcggattactattggaacaaaatatcaaatgagtataatggaaaattaatttatgatataacacatatgttgttttattgtgatgaagatggaagttatataccagatccattaattacattttttggtcaagatagaataaaacaaatgtttaaattagattaggaggagtaataaatgaagaatatgaaaaagctcattatgatatttataagtattgtaatgtttataggaacatatagtgtatatgcggaaacaagcgataataatttaattcaagacggaacctatatacaaataggtaaatataatgaagatccaatattatggagatgtataagcacaaatgaagatgatgaaaacggaaagctcataataagtgatagaatattatgttataaatgtttcgatagcagaagagcagggacagatcacaaggacactggattaggtttttgggaagaatcaaacttgagagcatggctgaattctaaagaagcaggagaaaatatattatggccggggaataaccctccaaatatagaaaatgctatacgtaatccatatgataaagaaaatggattcttatcatcatcaaatttttctgaaacagaactatcggctatgaaaacagtaagtcaatggcagatattagatatttatcaacaggatgaagtagaaaatggaatatatgacttttttgagatagatggcagtttaaaaacaagaccagattatctccgttgctatggtactatatcatctctcactcatatagagggaggaatgaaaagaatagcagatacaatgtttatattagatgatatacagatatataatttatatactaagtacggtgtattatcggagcctactgaaaaggctctgaaaacatggaattatggcggtaattctatttgggctcattcgcctaactcatattggcttcgaacatcaaatggacctgcaaacgctaattatgttcaggatgataatatacgaggttataggtctccaacaataggagatttatatggtataagaccagcattttatctgaacgaggataatgtcagaatagtgtcaggaagtggggagtggaacgagccatatataatagacggaaacggtcaggaaggaacaacagtattttgccagagcaaacaattaacggatgcgcagattatagaagaaaacggagaaatattagttccggtaagagatgtatttgaaacctttggtgcagatgtacaatattatgatgtagaggacggaataataacagcaacaaatgatgagcgtacagtggtattacaggcgaataatccggatataggaaatggaacagatgttttcacattaaaagtagcgccgaaaataattaacggcagagcgatgatttcattagagggagtaaaagacgcgtatgagtgtaagacagagtatgtggaagaattagaccgaattgtaatagataagccgggaccgcaagattttggagacggagtaggaaaagaacgctggcagcgagctcgccacttgtgggacggatatcaaggtgacatagattaaagcagtgtaatatattttcacttatttatatatagggaatttgtagtgaaagtccattcagccatgtaacaaactaaataacgaacgttacgacacgaattatcgtaacgttttttattatacactatctgtaaatttacagttaaaaccttactttaaatatgaatagaccgcaataatctaataatttggatattgcggtcttatttatttgtaatactgcacaataaatcgtgttatttgcgatttgttaatgtgaaataagacgattgtttaaatatttaaaagtttttttataaaagtttgccaaaacgaccatcggcaaccgtgatagtgaatgaaaggggaaataaaccgccttgcggaaacggaaggaggtgagactctagtggagttgacttcttcccaaaagcagaccgttgaacatcaatttgatagtttttgcaagagagttctaaaataaggagagcgagaaaatattatgttataaaacatacttgcaagctgtaggcaacgaccttatatcagtataatgatacttctatccagttataatccgagcgttaaaagcgtcgcaggtaataaggatagttcgggctgatgccggggaggtgagattcctatggagcattttagcaaaatgccgtccgtctgaattattaattaatggaggcagataatatgccaaaaaaacaagacaaaatagattttgaagttgtcagtcacttttcaggcagtaaaacaatcagggatttattgaagagccttgtaatgcgtgaagtaactgatgacacatcagaaaataaaacagaaattaataacacagtgaaataattgaagtttgtaacggtttatgatatactttaaatatggaaaacaaaaacaaatgctggtttcgctgtgagaaaggagaagctatggaaaaacagcgtgcagcgctctattccagactgtcgcgggatgatggaataggagaatgtgaaagtaatagtatatcaaaccagaagcaaatgcttaacagatacgcaaaagaaaataattttgagatagcaggtcattatgtagatgacggctggagtggtacaaactttgttgaggtaagataacgataccttttttgcagagggtgttatcttacctctttttgatgtatgttagatagcataactctttacgtcggctcctatctgtctgaaataggagatactttcagtaggcttgtcgcctgtatcaactctgccgacaaagctataaaagatttcgattttgcgggtgttcgtttccttatccagttcgtgaataagaatacggtcaataaattcatggacgttttcgtaggtcagttcttcaatcgctgtgtatctgcgtaccagtgcgacaaacctttttacgtccgcgctgcgctcggtggcgttgtcgatttcctgtgacagctccgcaatcctccgggtcagcgtctttttttcttcatcatagccggaagtcagaaaagcaaattgttcatctgaaagtttccctaaagcgttgtcctcgtagagcttgcggaataagatgttcagctcgttaatacggttctgcgccttgtcaagttctttccgctgctgtgtcagcgtcttttgtactgcctttgcgctgcactcgttggcggtttcgataaactcctgttcatgctctttcacataagacgttactcgctgcaagtctgcaaggacaagttctttcaatacgcttttgcggatataatgcgtagtgcagagcatatcatttcttgcccggttgcggtagttgccgcaagtgtaggcgtgtttccgttcaagcgtcccggctccgcgtactgcatacattttgtagccgcagtccccacaaaagagcagcccggaaaacaggtcaatttcatcaacctttgtcgggcgttgccgggtggcaatccgcttctgtgcaagttcaaaggtttcttcatcaatcaaaggttcgtgagtgttggggaagaaataccttttttcctccgggttctttttcgtctttttcgacttataagataccttgtaggttttcccggttatggtatgccctaaatactctttccttgtcagaatgtcgtacagtgtcttatccggccagttgtaccatgcgttgagctgtgggcgggggtggcgtttgctccctgtcctgcggtagcgcagttccccgacggtcaatatctcattgtcccgcagccagttctggatttcacacatacggtcgccccgtacatacattgcaaaaatctgttttacgacgtgtgccgtttccgggtcgggtatcagatgattgcggttatccgggtcgataaggtagccgtaaggagcttcgccgttgacgcgctcgcctttctgtgcctttgcctgtttgacagcccggattttctttgaggtgtcgcgggcgtaaaactcgttgaaccagttccgcagaggggtaaactcgttatcttccctcgctgtgtctacaccgtcgttaatggcaatgtagcgcacttcgtattcggggaaaacaatctctatcagttcgccggttttcagataattacgtcccagacgggaaaggtcttttgttatgacggtcgccacgttcccggcttcaacctcatgcagcatggcttgaagcccctcacgctcaaagctcacgccggaaaatccgtcgtctacaaaaaagcgtgtgttgaaaaagtggtgttcgtcagcatacttttgtaaaatcagtttttggttctgtatgctttcgctttccccggcttgcatatcttcctggctcaatctgcaatataaagcggtaatcttgtctgtctgtaacattttgtcctcctttccgacgacagacaagcatggtatttgtactgtctatattataccacataccgctgcctgtgtcatgtataaaatgtgaagaaacgccctatttccgggcgtttgcggggttcagctccatgtccttgcgaatgagcttctttatctttttatccagtgtgtccgttgcgcgttcacttgcggacgaacatacaaggtaagtaacttttccgattttatgctccgttgtggtaacgggcgtctggttttgcgtcaaagaaaatccccctttctttcgcaaacatataatacagtctatgaatagcagcaagtccactattcaagaaaacaaaggctttaatcggacggttattagcataacctcatgggaatttcaccccggcatggttctcatgcagccctacccattgcctgcgacgctcttaacgctcggactgtggctgtaaggaagtatcattgtatattttgcgtgtcgtcgcccgcaagccgctacacttgctttccggcgcggtgttggtcgctcggctgtccgggcggggataacctcacccggatagcgtcatggcgcacccaccgtatggctcggcgcaaaaggaacgtatccgatttgccctatgctgcgccgccgttatcttgcgccgctttctttgtcaaggttcagaatggctttgctgccgcgtcagcagcggaacggaaaagggggagagagaaagcgtcccgccgctgcggtttattcctctgccttaaaggtgaggacagccatcatcagttttgcttgcagccgttcccgaatgtcgtggtctacgccaaaatagacgttcccgcgctcgtcgtacagcttccgcatggagaggcgggctatgtagccgctgaaatgctgcaagacaatcttcatagcgtccgggtcgccctttgtcgctgccaaaatgacaggatagggaacaagggctttttccgggtagccgggttcgttaccattcgtcccattcatcagcattttcctccagatatttttttagcagctcaaaagagcttgtccgcctgtactgtatcgtgcttctcgacgtatcgaacagctccgcaatctcggtgtcgttcattccctcgaaatagtacaggagtacggctttgcgcttttcttccggcaaagtacggattgcttcaagaagcagcttcggcgtgattttcttcccggctctttcaaaggcgatttcccctttgaaatattcatcaaaggtatgaagctgccgcgcttcttctaaggtcaagtcggaaaaggtaatctcccttgccttatgcctgtgcagctctttgtgagcgtcacacgcttcattgtgcagtaccgtattacaaaacttctggaaagcgcactgttttataaactccctgcgattaggttccacattctcaccccctttctcgttggaaagttggtggtgcttcccccttttcgcggggcaatactgccttttgaaaaaaacgccgaagattttcggatttttttcaaaaaattttttgagcagcaaaatacgcctgtccgaaaagcccggacagacgtataggtattgtaagcggtattcagatgattagacagttcatattgatagacgtagttttccccggcggtggtcgggctttttttgatgtgtcaatgaccgtcggattttgtcgatatggtatgtgcttcatggcggctacctccttttagccgccgcttttaacagtgataccgcgtcatttcattagaagataaaaagaaacggcggctttggtttttcaaagctgctgcggaaatcaaagaacgacaagcaacagttctgattttgctccaatatggttattgggggcacaaattaaatcaaaaaagagccgataacagcagtatttcaaactgcatattatcggctctgcgtctgtgcgtctggctcttttaattaaattatttttgttgttttttggctttattatatgtattagctaactgtccacaagctgctttaatctctctaccatgagaaactctcatggtaacttacacaaaatcattgccggtgttatacggcgggtcaatatatatcatcttcaccttattgtaataagctgtttgcaacagctttaacacctcaaggttatcgccttctatataaacattattggtatcatcaaaatttacgctttcttcacggcaaggtcttagtgttcccgtagaacgcttctgtgcaagatgtaaacattccgctttgcccttccactcaaatttatatttttcaaaatcatcttctatgtattcaccgcacagtgacaacagcttgtctatatcaagctttccctctgaaaaacattccgggaacacagtctttaatttctccatatttgagttttctaaatccattgaaagtccgtctaatttattattcataatatttgtcctcttcccatttaattggattattttctatgtattcatatattttttgatattcatgttcattgcgtatgatatgttcataatatccacgctgccaaatctgtttatcaaacggcggcaaaatattttgtttaaccaattttatatattctattgttgaatgtcgtttaaaagattgtattacatccggcagcgacaccgtaggggcggattccatatccgcccgtgtttccatatccgcccgtgattctatatccgccgcattttccccatccctttgtattgcaattatacaatggaaatggtttggcattacaacataaatcggacaatgtatatattcatacatattaattgtttgtataaatgtgtttttgattatgcgagcggatattgaatccgcacataccgggcaaaatatattttgtgggttggttgttcgggcggatatggaatccgcccctacggaacccatgtacatcatatcagtttcaattcaatttgtctatccttcaaaatataatgtgcgtttgacaatgcggaatcgtctgcaaatccgtgttcggcacaaataatttttgccggagcatattcagctattgcttcaatatcttctgctgttatattatcaaatagtgcaatcattaaaaggaagtcgcctacaatatgaactactttataaactactttataaactactttttcgttaactcctatgtattgaacagggacatcaagcggaactcccattttcagcataacctcatagacaacatccatatcagttctgtcgtctttgatactgtctatcatagagttcatacgctctgtaaacatctctatctgattatcacctgtaataggcgtattatcccatattctaagatttgaggtatcaagtttgaataccttaaaacctatatcaagcggcttcttttcttcgtcgtctattccaatctgatcgcctttttcttcaataattttctttccggcacgtcgaatacgttctttgcctatttcacagatgtttttatatcctgctttatacgcttctgatttttcatcacaaagttccggcaattgcacacatataaatcttctgtttcctccgtcctctgcatttaactgcataacagcgtgagcagttgtagcgctaccactgaaaaaatccagaattatgtcatcgctatcattattgtttgtacataacttgatacaacgcaagattgttcctattggtttaggtttgggaaaagttcttttatcaaatcctaaatttataaattcttcactgccccgttcactattcacatctttaaatgtccaagaactagttggcttaactaatgatctaccttctaaataatcttttgtcattaccccccatactttacgggctggcataaatttaggaacaagtaaatctaactgtttctctgctgtatctaatccccatcgccaatttccttcttttccgtcttccctctgaggttttatttgaataaatccatcgttcttttcttctaatcttgacggataaaattctcctgttatctcattataataaaaataataaaaaaggttgggtctgtcttctctaagatcgttttcacccgtttttcttaaatcaatttctctatatttctttccatttttatctactttattatatctttttattatttcttctgacggctcaaatccataccactttaatgtatctacatgttttgcataaactataacatattcgtgcgctgtagctatatatttatcatcagatctaccttttggattatttgaatttgcaatgcatccaataaaattttcttcaccaaaaatctcattacaaattttctttaaattgtctacctcattatcatcaatactaataaaaataacaccgtcatctctaagcaaatttgctgctaaccttaatctaggatacatcatattaagccaatttgtatgaaatctgcccattgtttcaggattcgattttgttgtttgctctgttatctctttatatcttgccatagggtcagcaaaatcgacgatctcgcccgggctcggcgggcgaaacagggtctggcgcatcaaagtaagcaattatagaataattaaatggatttatataaaatggtatttataattatgaagtatcaccgcggctgcgcacctcacgaggaggactttgtcctccctgccgaggcttgctaaacccaccaaattagtgaatgttatagtaataaatatgttattgtaaaaataagagagtaataaacaatcaattactttataaccattctattgaaacgtttaacacctttggtaggagtaagaactcaatattaagtgagttttgcctggaatagttaaattaaattgaatatttataaaaaatttttattactttatctgctttagatataaattatctagtttgttctgacttatatcacaacatattatataatacggtaaggatgaaaaaagacatcttataaattattgtaatattaggtcataaaagggctataacgaatgatgaataataaatttttaaataacaaattctctaaaagagaaaaaagaatacgtaaaacttatgaaattgaggatgatttatataactttttagaagaagcttctttaacttacgatgcttctgtttctgatattttaaatttttgtatagcagaattaattagaacaaatgatttaaaaatttatacttcctctaatatgaaaaatccatcacataattttaatatagcagtcagtaatgtaaaaggtctcgcaaaactaagcgaaactaccccatttactataaagtcattagtaaacatgtctgttaaaaatattttatagataaatattaaatttcttagttgtgtagatattcagaaatatttctattattaattaatatactctcttatcgatgtaaattgtcaagatttaaaaattgcttaaccggaattgtttaaattaattttaacaagttttttgtacttatatttagataaactgataaattttcagaaagttatatagaagtcaaacagctgcgattttattatggaaaacgacggactcaatatcttaataaccgcgcaaaaagaataaatcccatcgctaaaatccgtttagttaatatgatagtgcgttgactttttatgaccggtgtgataaagttattgtgtgaatttaatcataatttgtaaaattgttatatcggtgattatatgaaaaataaattctgttttggcgtattaataatagtgtttatttcgctttgtatgtccttctccgcttatgcggtaaaaaccgactatgttatgatagtcgtaaacgatgacaggcttgccgctcctgcagaaatactcggcggcgttacttatattcctgtccgtgagttggcggagagcgtgggggcggaaatcttttgggacgaaacagtgttcggcgcaaccctcagtaagggggatataataataacaatccttccgggagcagcaacacctgtttacgtgaacggaacagcggtcaaagacgctgtaaactgctatataaacgatgaaaaattaatgctgccgctaagattctttgccgagagtttcggtttcaaggtggaatactttgacgcttataaaattgttcgtgttaccgacggcagtcaaacttcaagcgcggcaaaaatcttattgaattttggggagactgcgttggaagagagaacgcagtttaataacagaccggctgttaatccgctgaagtccggcggtgtttggattgacggacgataccgcatggcgtataatgatgtggaaagttttccgggactgcatgttgtaggcaacgttggttttgaggatataagtatttccgagaaaaatgcaaaagaatatgcggaaataataaatcacatagctgaaaaggttccgcttgctgacacgtattcgttgcttgtgccgtctatgagcgagttttatgcgccgaaagaaatttataggagccaaattgaggggctgtctatggtttatgacagcttgaaaagctgggtcacacctatagacgctgttacagctttatttgagcatggcggagaaaagctgtattttatgacggataaccattggacgcaaagaggggcgtactacgcctataagtcgtttttggaatgcaaaaatgaaatggctgacgatattaatagttttcagaatatgaagtttgattattttattggatattggcagaagtatttgacagagttagatgatgaaaagggaaagctggcgaaaatttcaggcaactttgaaacgctggagcgttttatgcctaaagtaaacgccgaggggacggtgtatcgtgacggacatatgcgtgattatttgatgaacgttgtgccggtagaccagaatataaactcttattctgcatttattggcggagacaatccggtcaccgtatttaaaacgaatgttgataacggcagaaaaatttgtattattaaggactcgtacggcaacgcgttttctgcctgggcgcttaataactacagcgttgtttatataatcgacccgcggcatgttaacggcttatatggtttcggcggaggagagtttaaaatagacgagttttaccgctatacagagtttgatgatttggtaatcataaattatccggcctctgtagaaagtcaggggttcagatatgcgctcagcgtgctttagcggcggtattttggagatgtgtacaaatggatttatataaaattttgagcgaatgcaggctgtgtccgagagagtgcggtgtggataggctcagcggcgaaacaggtttttgcggcgcgggagacaaagccagaatcgccagggctgatttgcatttttgggaggagccgtgtatatcgggtgaaaacggttccggtgcggtattcttttcaaactgcacgttaagatgtgtgtattgtcagaattatgatgtaagctcaaaaggaaaagggcttgaaaagacggatgaagaacttgccgattgttttttggagcttcaggataagggagccaacaatatcaatttggtcactccgacccattatattccccaactggtttccgctctggacaatgcgaaaaaacgcggtctgaatctgcctgttgtatataactgcggcggttatgagaaagctgaaacactgaaacttcttgatgggtatgtagacgtctatctgcctgatatgaaatattactcagacaaatacgccaaacgttattccggcgcaaaagattattttaaaacggcttccgaagctgtttcggagatgtacaggcaggtgggcaagtgggaatttgacaacagcggtcttataaaaaaaggtgtcatagtacgtcatatgttattgcccggtctgatttttgaggctaaaaaaatagttgactatttgtttgaaaaatatgaagacaaaatttggctaagcctgatgagccagtataccattatgcccggagtgagaggtatggatgagcttaacaggaacttgccgaaaggatattatgaaactttggtagattactgcgcgtccctgggaatggaaaatgtctatgttcaggaagaaggctcgtccgatttgtgttatatacctgaattttacggaagttatcagtctttatcagaagaaggggagtaaaatgataagaggaagcgaagatactgctgaaagatacaagcaggatatttttaagtatgctaaacaaaaatatgacgcggagcctgactatccgtgggttaaatcacctgaaagcgctgttttaaggcataaggacaatgcaaagtggttcgctttgttaatgacagtggcgaaaaccagtttagggctgaataactctgaaattgtgaatattataaacgtaaaatgcgaccctgttttaataggctctttaattaaagaaaaaggttattttccggcttatcatatgaataaagaacattggattacggttttgctggacggttctgtttcaatagatgagctgtataatttaatagatttaagttatgacttgagtaaataaaatatttgatatataatgttaatcatagagtgtaacactgaaaaaatttttagaggtgaaagatgtgaaaaagtatagtaatgaggaatacaaagcgttattgacagagattgaaaacattgattttgccgaggtcaagcttgagaatgagtgtgaggagagggtttgcagcgaccttaacctgtgggatggcagaaatactaaatttggttatgccgatgtttcgtggtcaagttcagacccggattctgtatccacatcgggcgaggtaatttgcctgcccgaggagaagaatgtgactataacggctcatttttcgtatcaggattatcctgaaataaacattgacaagagttttgtgcttaacgttctgaaaggcagcggaaaaaggcaggagaaaaactctaatataatcgacagaaggggaagacgggtcatttttgttattggcgactccactgcaagcatatatccacacagcggagaaaacaacaggtttccccaaactggctgggctcagtattttgataagtattttataagcgataaagccgtggttgcggatatagccatgagcggcaggagcgcaaagagttacacagaagaagataattttaaggtctttaaggataatatcagcgagggcgattttctgatattacagtttggtcataatgattctaaaatacaggatccgtcaagatatgctccggcgtttggtaaaattgatgaaaaaggctcatataaaaattatatgagcgtatatataaatattgcgagagatgccggagcaattccgatattggcaacctcagtgagcagacggaagctttcagacgagagccttgaagaatacgtcaatgccgctaaagaactgggaaaagagttgaatattccggtgctggatgtctataagaggacaaatgactggataaacgaggtcggtcttgaggaagcaaagagcttatataaaatcataaagcctcatgatgagaggtttatgtataaccctgagttcttaaattcacagttctacgaaaacggcgatgatgatgatactcacctgaatatcttcggagcggacaaaatagccttttgggttactgaggaaatcaaaaagaacgttccggaactggctgttttgataaaataataaaatcatatcaatgcgatataaaataattccttaaaggaatttgtgacaattttcttttgtattctatatacatatttgttaattttaagattgacaattcaaaaaaatgggaatatactatcttcaagtaaagagtttgaattcgaacagttttgtttgttttcaaacaagctgttgctttataaaatttgacttttttagtgatgacttttgaattgttaatatatgagagataatttgaaaagtaatttaagataaaaaagaaattaatatcagcatgcaaagaggcatctggtgtatttcttttttattttaccctttgagtttgagaaatttttaacaaggcggtgacagactgtgaatgatattgcagcggaactttatacaaagctgaatgaaacaaccattgcttttacaattccgattttcggagggattccggtgccggaatccgtggttataacctgggggataatggctgttcttgtcttgttttctatcatatttgtccgaaacctgaaacttgcgccaagcggagtgcaggtatatttggaaacgtttatcggctggataaataacttctttaccgggattttaggcgagggaggaaagaggtatatcccttatttgggaactgtcttgttatatatcggatgttctaatatagttggtctttttgggcttacgccgccgacaaaggatttaaatgttaccgcggggcttgccataatgagtattgttttggtggaggctgccgggataaaggcgaaaggcgccggaggctggataaagggttttgcccagccgatggcttttatgacgccgcttaatgttttggaaatcgtaataaaaccgctttcactttgtatgcggctttttggaaacgttttgggctcatttgttattatggagcttataaaaatggttgttcctgtttttgttccgcttgcattcagtttttattttgatatatttgacggattattgcaggcatatgtttttgttttcctgacatcgctttatattcaggaagtaaccgaaacggaatagtcttaaattagaaaattgattaaactacatataaatttatcagaaattttaaaggagatgtatatttatgggagcattaatagcaatcggtgcaggtatagcggcactcacaggtataggagcaggtattggtataggaatagcaacttcaaaggcgacagaagctattgcaagacagcctgaagccaaaggcgacatcaatacggctctgcttttgggatgtgctcttgcggaagcaaccgctatttttggattcgttatcgcaatcatgataatcctgttcttgaaataggagaggtatttttattatttggatgacggaggtcggtttgaatgcttaacttaaattggaatataatctggacctttgtaaatcttatcatattgtatattttacttagaaagtttctttttggtccgataaccgcaatgatggagaagcgcgagggcgagataaaatcgtctcttgacaacgcttctgcggcgaaacaggaagccgccgctttaaaagcggcttacaccgataagcttaaaactgctgaggcggctgccggagatataataaagtccgccaaagaggaagccaaagcaaaacgtgatgagataataagcaaagccaaggaagacgccggaaatattgttttaaacgctaacaaacagattgagctggaaaaagaacgctcaatatctgaagctaagtctgagatagcctcgctcgttatggacgcggcgctgaaggcggcgaagaacggtgatgtttctgagagcgctgttgacagctttatacttgaggtaggtgaagcaaaatgagcagagcaaagataataaccaaagaggctttaaattatgctgaggcgctttatcaaatcagtagtgacataaaaaatgttatggagttcaccgcactgcttgctgtggatgagctcagacaagcattggctaatccaacaataagcttaaaagagaaatatgcggttatagacagaatttttgacggcggctttggaaagtttatgaaaacagtatgtaaaaacggtgattacagcgttttatctttgatagaggagagttataagcaggtttggaacaggcacaattcagtgcttgaagcttctcttgaatatgcagagccggttagtgaaaaatcggtatccagtattaaggcaatgcttgttaaaaaatatggcgtaaagtctgttgagttaagcttggttgaaaatagagatttaataggcggtttcagactttatgtaaatgataaggtatatgataaaagtgttttgggagctttagacagaatgcgcagaacacttttgcggaggtgatagatttgagcagtattaacacaagtgatgttatttcagtgctgaaagaagaaatatctgattttgacgtaaaaatgacggctgttgacgagggcagtattatcagcatgggcgacggcattgtgacagtgtatggcttaagcaacgctatgtacggcgagttggttatatttgagaccggagtaaaaggcatggttcaggggctggaggaacagactgtcagctgtgtgcttttgggaagcgaccatggacttcatgagggctcaaaggttagatgttcaggaagacgcgccggagttcctgtgggaaataatttaatcggcagggttgttgacgctataggaaacccgatagacggacagggtgagataaagcaagacgatttctatccaattgaaagcccggcgcctggagttattgaaagacagcctgtaacggttccgctggaaaccggaatacttgcgatagacagcatgtttcctatcggcaggggacagcgtgagcttataatcggggacagacagactggaaaaacctcaatagcgactgatacaataattaatcaaaaaggcaaagacgttatatgtatctatgtggctgttggacagaaagcttctacggttgcaaaacttgtcagcgacttcaagaatatgggagccatggattatactatagttgtttcagcgtccgccagcgatatggcgccgcttcaatatatagccccatattcgggaaccgctatggccgaatattttatgcacaacggaaaagacgtattgattgtatatgatgatttgtctaagcatgcggttgcatacagggcgatgtctttgctgctggagagaccgccgggcagagaagcgtatccgggcgatgtgttctatctgcattctcgtctgcttgagcgttccagccgtcttgacgaggctcacggcggcggttctatcactgcattgcctattatagaaacccaggcaggagatgtttcggcgtatatacctacgaatgttatttctataacagacggtcagatttttctggaaaacgagctgttttttgcaggtataagaccggctgtaaacgtggggctttcagtgtctcgtgtaggcggagcagcgcaaaccaaagcaatgaaaaaagttgccggaaatctgcgtattgatttggcgcagtatcgtgaaatggaagtgttcagtcagtttagttcggatttggacccggcgaccaaagagctgcttgacaccggagacagaataatggagcttttaaaacagcctttgctgaatcctttgccgctttatgcacaggtgcttttgctcacagtgagcaaaaatagaatgctgcttgatataccgataaatgaaatagtaaactttaagtcagactttatagattttgttgagcggaaagctcctggaataataaaaacaataatcgaaactaaggcgctgagtgatgaagacgaagaaaaaatcatagagctgtgcaaggaattcaagaccggaagatatgtatcagcattggctgatgacccgggagaagaagcggaagttgtgttaaacgaaaacaatagtaaggaagactgagagcgggtgagataatggctaatatgcgtgaaatacgttcgagaataaaaagcgttaatgatataatgaagataaccaacgcaatgtatcttatatcttcatcaaagatgaagcacgctaagcaaagacttgacgataccgaaccatatttttatactttgcagaatactattgctcatattttgaagcataccccgcatacaagcaatttatattttcaccgccgcgatgagataccaaatgaaaaacgtaaaaaaggttatatcgtgataacaggagataaggggttggcaggagcctataatcataacgtgcttaaactgaccgagcaggagattgctaagggcggagaaattaagctctttataataggtcaggtcggcagaatgtattttgccagaaagggcataccgtatgaagcgtattttcaatacaccgctcagaatcccagtatgtacagggcgagagaaatttctgagttgatactgagtaagtttctgtcagaggagctggacgatgtttatgtagtgtatacagatatgatatcgtctatgaaagaggaagcaaaactgcttcaaatactgccgttcaggcgtgagagatttgaaaatctgcacagcggcaaacatcgtgagattcaccatactgccacatttgacccgtctcctgaaatagttatggaaaaccttgtcccgaattatgccaagggattaatatatggaacaatggtggaagcgtttgcgagcgagcagcatgccagaatgatggcaatggactccgcgacaaagagcgctaaggatatgattcaggaacttaaccttgcgtataacagggcgagacaggccgcaataactcaggagataacagagattgtcagcggtgcgaaaagtcagcataaaaaatgagcgcggtataactctatgacagtatgagatgggaaataggaggtaagagcagttatgaatataggaaaaattgtttcggtagccggaccggtagttgacgtggcttttgagagcaccgatcagcttcccaatatcagggacgcactgacagtccaaaataatgataaaacctgtgttatggaagtggctcaggacaggggcaataatgtggttagatgcattatgcttgccgccagtgaaggccttaaaaaaggtatggaggttgtgtctgagggcaaacctattacagttcctgttggagaacagacgctgggacgtatgtttaacgttttaggtgagaccatagacggcggagagccggttcagggggaagagcagtggagtattcaccgcgcggctccgagttttgaaaaccaaagcccggttgttgagatattggagactggaattaaagttattgacttgcttgctccatatgcaaaaggcggaaagattggactgttcggaggagcaggagttggaaaaacagttcttattcaggaattgatacataatatagcgacagagcagggcggatactcaatatttaccggggttggagagcgttcccgcgaaggaaacgacctatggcatgagatgaaggaatcaggggtaattgataaaaccgctttggtgttcggacagatgaacgaaccgcccggttcgcgtatgagagttgcccaaaccggtcttactatagccgaatatttcagggatgttaaaaagcagaatgttttgttgtttattgataatattttcagatttgttcaggcaggttcggaggtttcagcattgctgggacgtatgccgagcgccgttggttatcagcctacgcttgccaatgaactgggcgaacttcaggaaaggataacatcaacaaaggacggttcaataacttcagtccaggctgtttatgttcctgccgatgacttgacagatccggctccggctaatacatttgcgcatttggacgcaacaacagtgctttcaagaaaaattgttgagcagggtatttatccggctgtcgaccctcttgagtccacatccagaattttggaaccttctatagttggcgaagagcattatatggttgcgagaaagacccaggagattcttcaaaaatataaagaacttcaggatattatagctatactgggtatggaagaactggatgaaaatgataaagtcacggtatttagggcaaggaagatacaaaagttcttgtcacagccgttttcggtagcggaagtgttctcaggatttaaaggcaaatatgtgcctttgagcgagacaatcaaaggctttaaggcgattataaacggcgagatggacgactatcctgaaaacgcctttatgatggcagggacaattgatgatgtaaagaattttaaaggttaattaagattataactttttttaacttgtgaggaggattcacatgtctgatgaaaaaacttttaaacttgatattcttgccagcgaccgttcgttttacagcggtccatgcgagatgctgatatttcctgctcttgacggcctccaaggagtcctgccacatcatgaggcaaccgtaacctgcaccagcgaaggcgagcttaaatataaggttgacggaaagtggtattatgccgctgtaagcaaagggatagtagaaatcatgccgacgtatgtaaccttgctcgcggataccgtagaaagacccgaagaaattgacataaaacgtgccaaggaagcaaaagaacgcgctgaagagagaatgagacagaaacagagtattcgggaatattatcaaactcaggcggcgcttaaccgcgcgctgtcaaggttaaaggtttcaagacagcatatgaaatagatttaaaagcataccaattttggtatgcttgttttatttatacttttagtttgggtataatctttccgttttttaggggaatgataattataagtgaaagaaaaaagtttttgatttatgcagaaagtatttcgagttaaaatttagtatttatttttaggttaaacccgtgtttgatatttatagatgaattgaaattcacagacttattgctattctaacaaaaattattatttggaggttatgttatggcatggtattttattgtagatacatatattaacgaagaaaaaggacgtggggagtatgatgaatatattaatgctgtaaaaccgattgttgaaagctatggcggaaaatatttagttcggactgaaaatcttcaaactctttccggtgagagaaatccacagcgcgttatagtagtgcgttttgaagataagagtaatttggaagcttgttttgcttccgatgagtataacatgatagtatccaagcgcaaaaataatgtggacagccgcgctgtaatagcggaaggtatttaagaaaatgggtttgtaattataaaatattatttttattttagtttatataataattatggagcagcaaaaatgctgctccataaatttgtttttaatatgcttcacaaagcgggttcatattttcaagagaatcccaaagataaactttaactgtgtctccggcaactgttccaacttcaatttcgttgcttgatcctacagctgcgtattttacatcagttaatacatcatttgtatatcccgccgcaactacgacagcattctccgggaaatcttctcctctgctgatagaaacaactccggtatcttttgaatatcctgttatttctgttacaggctgaggctgaggagcgttgtcattcataattaccaaagaataaaggtccgggagccatccgttctcgttatagaatgtaatatctccggtgtagtcctgattgactgttagagaaatttctttcatgttatgggtcttggttccaatagttgcaaaagcgtatgaaggctttgaggcgtcaactgtaaccatacccggagccgcgtcaggcaggtcaacgattacaggcaaatcttcacctccgaagtaatagattgaatacttgccggccgggagtgaaatgtctgcaatagttggtttgacatcataatctccgcttttaccaatatagttgacgaaagtttgagtgaatttttctctcagcaacgtttcatcagttttatctgcaaatattgcttttactttagcgtcgattccgtcaacaaatttggctctttcagtgttagaattaactcttgcaggctttgaacctaaatcattttttgttatattgaaatattttgttccggttgggtggttagaggaggttcctgaaaatactcctacttgtgctgggtctgtctcttccggttcaggctctttttccataaacacgttaagctcgtttacagcccaatattttgaagagttagcttcagttattactatcttaatatactgagcctgctgttcggggaactcgattacgagttttgtgtcctgttccggatttccggtaacaatagggtctccaaagtttttgccgtcatttgatacatatagtgcgtatcctttaggatgatcagtagtcttggtgttattgtcaataactatcttgttaaacttttcagttttaccaaaattaatagtcatgtatttgccgatttcctgccagctgcagtgccattttgtttctaagtctccgtcccatgctgcaaatgtgctggaagaattgtttgaagccgagcctttccatgcacttctgtcaagtctgccgtccgcttgcaggaattttatactgttaaggtttacaaactttgcgtcctcgccgcttgctccggcagcatcaaaaactataataacatcatgttttcctttaactgtttcattcaatgtacatgaggcttctttccaggtctgttcgttacctgtgttaggtacctctattgttcctattatgtcgttgctgaccgcgtccagcttaacctggagagtgaatcctgaatcgacacttgcaactcttgctgaaatcatatttgaacccacatctccgaaatcaacattttcaaaaatgatatgtgagtcatagttgaattgatttctaacaaaccaatcctgtcccattggggtttccacatcaaccttaacttttccttcagcactggtagctgaaatagattcatacggattttttacttcgccagatggtttgtcatccggaccatggtcaggtttttcgggaagtgccggaacagtatatcctgcttcgccgcttgtctcgatagtaatgcctgtgctgtcgagagttccgttccattcaacaacaagttccttatcatatccggttccggttctggtgaagttaacaggctgaccgtttatctgaacgactggattggtttcgccgaagttgtcagaaaggtgaatgtttttgacagcaattggattatccgatttcacagtcatattctgattttgatttgcttcgccgctttcaacacagctgactgttccgtatccttcaggcattacaaacattccgtctgtcattacgttgttcatttccggaagaagtctgggctgaacccaaatatcctttgtgcgctggtctctgtaatatccgactacgtcattataatttctccatagtcccggcatgctgatatattgtttatcaccggatatagttgttgcagcatagttcggtgtgtttactgccggcagaatatcaagcggatgattgaataccttgtttctgtctgtatactgtctgttgtatgaatcacgctgcattgcttcaaaaatgttttctcttcttgtttgcagaagcagtccgccatagtgcataagagtgtacggcgtccattcgttgtaggtaccttttaaagttcccataccccaatagtatggatgatagaaactgtcgagttctgaaagtgcatagtctgtttgttcatctgtccagatttgacctaattttaagtgaagtgagagccattgtcctgttaagaatgattcgctgacacgtttgtcttccgggaagttgtttgaaagataacgttttgcaaaagaatcagtaacggtattatatgctgtagtatatttcgcagcttcttcagtttcacccatctcatcagccaaacgtgccattattttataagccaccgctgaaacacttgcattatacgggtttggatttccgcctgcgtcatacgagttttcagaattgtcaaatgtatacggatatgttttatttccgtagagttcaacctgttttaaaattctgtctccggctttttttagatagggccagaagtaatccagcatagtggttccttccggaattgggtcttttcctaagattatgccgtctgttgatggattgcctgcaacctgcattgtttcataaactgaaataataagaccgcagttaaggtctacccatttatcaacgtttctatagtcgggatgctcagtataatcccagtcaacaagctcggcgcggtcagctttgttttctaccgctgtgttgaaatcgtgatgtatctgtccatcgtttctttgggttcttgcccaatattccagttcacgccaagcaaagaatggtataaactgagcaataacctgccttgcctgccacatttgatccattgttccgaaacaggtccattgtccttcggaatatgcaactctgccatcttttttatacatcgagttgtttgatatgtttacaagagtgttttgaatttgatttctaaaccaatcaggtagattggagtctctcattttggtaacaagaatttcagcattgttttttaaagtgtcaaacttctctaaacctcttgctgctatatctcccggattattgtaaagattcagataataatgccagtcaggttctgaatcgtcataccatgcgagaacaaatctgattacggtgctctgtttagcgtcaagatttactttaacagcaaccttattggtctttccgctgatagaattgtcaagcacgccggtggtgttaaaatcagaattgtttccaactgatactattgctccgttttgttcagagtttccatatatagcccattttttgccgttaaaaccttttccgtcaacaagggctggtatgtcgtttgtagtgagctggaatgcgcatgaagcgtcaacgcttgtatcaccaaggttctcgagcgtcatttcatagaacgcatacggcatactcatattgtcatagtccacattgtccaaaggtgaaaacgcctttaaattaacttgaacatcatttgttgaacccatatttgcgaagtgcataggccatattgcgtcatcttctgaacggccgttgcttgaagctgatttcattgtatcaaccgtttttattgagccgtttctgtttgtgtaaagctgaaatttagcgtcttttaatgcggtgtaatcgtttgcgtcagccggtgcctttgtcagtgcggcaaaagaaccgagccttgcgttaaattttactccgccggttccgaatcctccgagcggagttcctgttgttccatcgacttgttgtgtatcggaaaccgcgtttacttctatcggcactgcaaaagtgctgcatacaagagaaactataacaaatacccccataagccgtttaaacaatcctttcataactgttcatctccttaatttatttaactatcagcttaattatatcagacagacagtaataatctatttatttatagactgaaactgcccaaaaattgaactgagttgttgaaactttattacaaatgtgatatactctataatatagaggtgaaaagtcatgaatcaattctatgaagttagaaaaagtgaattttctgtgaaaaataacctatatgaagtggcatacagccctcatatacatatggatatagaaatattgcacatgagaaaaggttctcagcatttgaggattgacggaaaatcttatttgcttaagcagggtgagacagccgttatattcccaaatattgtacatgagtattataaggaaaatatttcagtttccggtgttgatgagatgctgataatatgttccaaaaagttttacggcagattttttcctgatatgactgacagttttccattaaatccgattatagcaaaggaagaattatctccggacgctaaatatgcgtttgagagtatttctagcagtctgtcaaaaaatcttcagattgcctggacggtaataattctgagcagaattttagaatcggtaaatctttcgcaggaaatacatgcaccgattgaggatataagctttaaaattatgaagtatattgaggagcattttactgagcctataaccttggaatccatagcaaacgaattatgtgtggctgagacctatgtgtcgagagtgttttcaaagaagataaagatgaattttagaaaatatttaggaatagtccgcgctgaatatgcagcaaatcttctgcgtatgacagatgataaaatcattacggtggcagaaaactcaggatttcaaagtgtaagtacattcaacagggtatttcatgatatctatggcatgtcgccgagagattttaggagcaatataactaaatataccagagccaattaagtaatttgagtttttaatagatttattgtgaagttataacattgcaattgttttgcagaattaatataaatgtgttttataatgtattggaagtattaaaaagtcaacagaaaattagacagaaaaattaaggttgtttttcagtgaattttagcaggtatgaaatatcaatcagaaaacgttatatgacagctaatctaacgagaaatgctagtacattatattgttggtctttaaaaacaaccttaatttttctgtctagtttattgtaagctttacggtttagttttattaatttctaaaacaattagattatgtattgtgaaagaatactatattgtataaaggcgttataaaaaacattacgggtggatttataatccacccgtctgttgtattcctaaaaattaatttattccaattcaaaggctcctgtatacagctgataatatctgccctttttctctatcaaatcctgatgatttcctctttcgattatctcaccgttttcaagcaccattatcgcgtctgcattccttactgttgaaagcctgtgtgctattacgaataccgttctgcctttcatcagggcgtccatacctttctcaatatgagattctgttctggtatctatggagctggttgcctcgtcgagtatcagtaccggagggtctgcaacggctgctctggcaatcgccagaagctgtctctgtccctggctgagattatcaccgtcggcggtcagcatggtgttgtatccatcaggaagatgcgtaataaaccagtgtgcatttgctatttttgcggcttttataacatcttcatcgctcgcttcgaggttaccgtatcttatattgtccattacggtgcctgtaaacagatgtgtatcctgaagaacaattcccagcgcccggcgcaggtcatctttattaattttatttatattaatcttatcaaatctgatttttccgtcaggaacgtcataaaatcggttaataagatttgtgatagtagtctttcctgctccggtagagcctacgaacgcaattttttgtcccggtttggcataaagagaaatatcgtttagaacggtctttttaccgtcgtaactgaatgttacgttttcaaattcgactgctccgcgaacttctgtgtatgaaatctgaccgtttgagtgaacctgtttccaagcccatctgccggttctgtggttaacttcggttatatttccattgtcgtcaatttcggctctgacaactgttgtttttccgttgtcaacctcaacgttttcatcaagaagttcaaaaattctttccgctccagccatagcgttaagtatggagttgatttgctgggatacttgtgtgataggctgtgagaatgagcgggtatactgcagaaaggctgctagtgaaccaatactgagcgccaaaaatccggcgtcgctgtttccgcttattatagtcaaatatgcgcctatcatagctgtgagcgcgtagtgaatatatgagaggtttcccattataggcattagtatgttggcaaaggtgttagcgttggaggcggcgtgttcaagtgaaccgtttaagccggtaaatttttgttttgatttgtcctcatagcagaatacctttacaactttttgcccttcaatcatttcttcaacatatccgtttactgctccgagcgatatctgctgtcttttaaagaagtgggctgaacgcttgccgataaattttataactatcagcataataaccagcataccaacaaccagcagggtaagcataggacttagaataatcatcataataaagacggatatgactgttaaaagagacgatatcagctggggcacgctttgagacatcatcatcctgagagagtcggtatcgtttgtatagcggctcattacgtctccgtgcgagtgagtatcaaaatatttgataggaagcctttgcatatgttcaaacatttggtttcttaccttatacagcacaccgcacgacacgcttaccataatcctgttataaacccatgatgaaagagctccgataacataaataaccagcatgaatactatcacttgtatgaaacctgataagtctgggttctgacttccaataaacggaactatatagtcgttgattaccggtttcagaagatatgtgcccaaaacgttggctccgctggaaactataaccgccagcacaactataaatagcatgaacttgtattctttaaaatagctaaacagacgtttggctgtcttttttgtgtttttaggctttcttattacgccttgttttccttttcccatcggcggcatattattcagctcctttcttctgagattcatatacttcacggtagatttcattgttttcaagaagctcgctgtgagttccaacggcgtttatgcggccgttatccattaccactattttatcggcgtcttctatagaactgatacgctgggctataattatagtagtggtatccttgagcttggttctgaaagtttcacgtatctgagcgtctgtagcggtatctaccgcactggtgctgtcatccaaaataataattttcggttttttaagcagagctctcgctatacaaagtctctgtttttgtccgcccgaaacattaacgccgccttgacccaaattggtttcatagccgtcagggagagacattatgaagtcatctgcacaagcatctatacaggcctgctttattacttcatcagacgcatgttcgtcgccccagcgtaagttttcaataatggttccgctgaacagaacatttttttgcagaaccatagcaacctcttcacgcagatggtccagtttatattcgcggacgtcgtgccccccgactatcaccctgccttggattacgtcataaagacgggggataagctgtaccagtgatgttttggaagaaccggttccgcctataataccaaccgtctcaccggattttatatccaagtttatgtgacgaacggcgcagttcataatatcattgtggtaactgaacgcaacatcttcaaatttaattgacccgtcttctagcagaattttatcattagccttttcatcagtaatatcaattttttcgtctattatttcaacaattctgtcgccgctggcttttgagtttacaagcataataaaagccatagaaatcatcataagcgacataagtatttgggttacgtatgaaataaaactaataagctgaccggtctgcatatcgccgaccattatcatgtttccgccgaaccacagtatagctactatacagcagtatacaacaagctgcattatcggcatattcacaacaataagtttttcagcggctttttgggtgtctcttacttcacgcgttgtggtttcaaacttgccgtcttcatattctccgcggacaaaagcctttacaacacgtattccggataagttttcctgaacaactcggtttaattggtccatctttttgagcattattctgaacttcggcatagcgaatttagagacaataacaaccattattccgattataggaatagcgactaaaaagatagacgctagtcttgcgtttatggagatagacattataagcgccattataaacataacaggggctctgacgcacattcgaagtatcatcatagtagagttttgtatgtttgtaacatcagtagtcattcttgtaaccaatgatgaggtgctgaacttatctatgtttccgaaagaaaagtcctgaattttataaaataatgcttttcttatattcgccgcaaatcctgctgaagcgacagaagcggttctggcggctcctgctccgaacgcgagtgaaagcattgccataagcaccattaataatcccattttaacaacatagcctatatcggaattttgaattccgacatcaaccaaagttgccataagcataggaattgtggtttccatagttacttctccaataattaaaaatggagttattatagaaaattttctatcctttttggacatctgttttaccagggtctttatcatttatcattgtcctccttgtcataaaaatctatacagtcgttgaacttttcgcagtggtggtgtcttggtttaaggcgaaggagttcctcagggtcaatattgttttgactctcaccagttatatttattgtcattctgtcaataacattacaaaaagtattcaggtcatcatctgaaattcccgaatacactttttcatcaaatgagtcaaatatttttctgcattttgcaactgtttcttttcctaattcagtcacataaaggttctttttcctgaggttgttttcatcttcctttttttctaaatatccggctttttgcatacgtttggtagaaacagcgatgctggcaggagaaacgcacaaaaattcagcgagttcgttctgactgcatccgtcgtttttgattatgtattcaagcaccgggagctgacggatatgcagtttgttgtcctcaaacagactaaaaagggtgcttctttttaaaatctgaaatttgtcgatacgcccattaacttcacggtaatcaatcataaatttcacctcctgactttagcttgatttggctttcagccacatactttagtataataagcttgtttaaaccgcttaatagttaagcgtttaactattatagaatataacaattataaagtcaatagtttttttatataataaggaagaggaataagagaaaaagtttgttagtaatatttagcaccttttaatgtgagatacttgtaataatttaaaggatattactgcttgacttttaaagtttttaagtatataagaataaaatctgtaatttcgaacgaggactaagattgtgaccaagcctatacgttaacttttttaaaaattgttatattatttaataagaccatttatgtactttgtatatgaccccatataatatatattattattacataatgaggtgtttgaatcatttattattacactaaaaaagcggttttttcagtgaacttcggtagggcggcatagccgcctcgttaggtgaactgccatctgaacacgcagtgttcaatatataaaaaaactatctatatactatgtatatgaccccatataaaaaaatttattattacataataaggtgtttgaaccatttctttttctggcaagaaaaagaaacgcttcacctgtgaccacacctgcaaggtgtgtgtaatacaaggttacttgttttgaataacctacaatgtcaataatatgaatactcaaataaaagaaaaagtgcttgttcgcttaggtcgcctgcggctccaaggggcgctcgcccccgctaatttcttttgcgctccacgcacaaaagaaaaagccttgttactttcccgttgactttgtgtgctgccgtgaataaagatatttcgagttctttattcatttacttatcaaaaaaggtggggttcaatttaatttaacacaaaaaaaacagggtttcagtgaacatcggtagggcggcatagccgcctcgttaggtgagctaccatctgaacacgcagtgttcaatatacaatttacttattaaaattaactatgtatatgaccacatatacaaaaattttattattacataaaaatagtttacgcgctcgggtccggcgagcgcaactgggactggctcagcaaactatctcttagaattatagttaccggaatatctaataaatcaagtatttatactatcttttttcccatttaaattgatactttcataaattattgtcctttttatttttaatcgagtttttctatatcaagtacaaacttagtatgtttagtgtaccgaatatgataattcccgtatttttcgtaagcattccagtcacagccgtttagatgtttcagttctttattgtccgtatcgacatatgaaacatgtggaccaaggacaatgcgtgtcggcaattcatttacatataaatcctgaccgccgcttaatgcgctgggtatatctgtactcatataaatcaagaaaaacagtataacgcaaaaaataattataaacactacaaaagtctctttttccatataatcatgttttcttttatttttcaacatatgtaaaaggcagaataagacagctaatgagctaacaaataaaataataaaactaatccaataaagcatatataaacctccaaatttaaaattatgggtgacagttgccgcaaggggtataccctgcttgtattgcattgtcacgggtatcaaaatacattctgttatgttctgccgggagagttttacatgacggcagatgaaattttttagttttactgttgccgatgtaaccgacagcatttgccgaagcttttggctttggcgttgtaacatctctttgcgctgatagtgtatcagcgtccgcatttttggttggtgttatagttacggtatgaccgtcgcttacagcaattatatctccttgaatatccgtcctgtaaacttttgctccggcgtccccaagccggctcaacacgtcctccgtagggtgtccgtaggtattgtctttgacgacagaaataatcgcatattccggcattatctcacgcagaaacggataggtagtagagttacgactgccgtgatgtcctactttaagcaccgtcgcggataaatcatagcctttgtctaaaatctgctgttcttcctcgcgctccgcgtctccggtaaataaaaatgatgtttcaccgtatataattttcataacaatagagctgttatttttatcatcttccgattctgtgaccgggccgaaaaaattaacggtgcttctgccaaactgaaagctctcgccgcagacagggtgttttatgattaagccctgctcctctgttttttgcttgaaactttgatatgattttgtatcagcttcaatattgggtgcatacacgttattgactgtgattgtggaaagcggagcagaaagtccgcctatgtggtcctcgtcagggtgggtgcagataatatagtccaaacagttaattccttgatttttgagataggtatatattacatcactggattttggtttaccgccgtcaatcagcattgattttccgtcgcataatactaatgctgcgtcaccttgtcctacatctatgaaatgaactgcaaaggtagaattttccggaatcattactgattcatttatttccggcataactgttgcgtacgtggtatctgtagcaggattagttattacgtcagtttgcgttatcgtaccacaagcggagaaactaaatactattataaatattaagaatagagataggatttttttcatttattaaaccttgtcaatatataatttttatcgctgtataagtaataataaatcttattataccacatgtacggttaaaaataaagagaaaactcatcaaaaacacctacttttaattaaaagtaggtgtttgcgtcgttccatttgtattattatttatatataatatacataaatgttaaagtatgaggtatttattatgaataaagttgaaatactagacaatgaagatgaaaataatttaaaaaatgtaggtagtagaatacagaaatgtagaaaagcggcggggctaactcaacgtcagctttcagacataacaggaatatcggaaaaccatatatcaagagtagaaagaggtatacatatacctaattttgatataatggtaaaaatcgcaaaagcattagacgtttctatagatgtttttgttgaagatttatctgctaataatataaacatttttttggaaaatataaaaggtgatgtagaaggtatgagtcaaaaccaactatctttagtaaaagatactattgtttcaatcaaaaaatataaattttgaattattttcaccataaaagtaatattataattagttatatcccaagtatgggctaataaaatattgtagattcgccgtatgcgtcgttaaactgttgattttcgttatcttcgccgttcttcttgagtgagttattttatataatattattcaaagatattataaataatttagaggtagcaaatatggaagatgaaaaaaataatatgttaaagggtataggacagcgaatacaaaaataccggctagagaaaaaattaactcaagaacaacttgctgaaatgactggtatatctcagaaacatatatcgagacttgaaagaggcatacatgcaccacattttgatatgataataaaaattgcaaaagcattggatgtttctacagatatttttattgaggatttgtctgctgataatataaatatttttttgcaaaatataaaaggtgatgtagagggtatgagtcaatatcaactatcgttagtaaaagatatgattctttcaattaaaaaatataaattttagttactcccaaaaaccgtgatacagttaatagaaatggtaaacagtattatggtttttatttttcgttattggcaagttttgaaaatcagaaacactttttgtattttcgttatgtaatttaggtaactataaggatataatatgaaatgtgaattagactttatagaaataggaaacagaatacagtattaccgtactcaaaataatatgacacaggcacaattagctgaattgattggaactaatcaaaagcatatttcaaagatagaagcaggacagcttagagtaaaacttgatacaatgtatgcaattacaacagctttgcatatttccattgatacattgatagctgactatgataacagtaatgatgaggctaatctgaagcttattttagatgagattaggggtatgaatcacaaacagcttaaaatgcttcgtgaaaatattgccacaattaaaaagtttaatcagtaaatgagataagttaaaaaaccggcatacagctgtcgagaatggcaagcatatgacggtttttgttttatgggggcgtagggcggctatgcgccgtgttaggggagctatcatctgaacatatagtgttcaatatatataattatattattttgtttattaaaaaagctatctatgtactttgtatataaatggtcttattaaatattataacagttttttcaaaaaagtcaatgtataggctgggttacaatcctagtcgttgttcgaattggatataaattggtttataataaatttgtataaatagtgttaaggagtgaccaaatgaaaaatataaaatattatatcggtcgtagaattatagcactccggaaagcaaaaaaattaacacaattgcaacttgcagaagctataaatattcatgaaaataaccttggttcaatagagcgtggcgaaaatggtatttcaatggacacattaatggctctaagtacagttcttgatgtagatgctgattatattttgttcggcgagcgtaaaaaaacaaataatactccaatccaaaatctaattgcggaacttgattctgaaagtcaggctgacttagaggaaattattaaattatatataaaggcaataaaacgatgaataacaaagatgatagtaaaaaagaggaaaataatattgtatttgtaaaaatagggcaacgaatacaaaaatatagaatacaaaggaatctaacacaagatcaggttgctgaaacaactggtatatctcaaaaacatttatcaagaattgaacaaggatatcacaatccacgttttgacatggtaatccagatagcgaaagcattaaatgttccgacagacgcatttgcaaaggatttgtctgatgataacgttgatgtttttttagaaagtattagaccaaatattgagaaattaaatgtcaagcaattagaatatttaaagaaaaatattgaattgcttttagaattatgaaaaggttaaaacattacttcatctcaattttttgctgacaatgatatggttgaactcatatcagaattgaatgagctatatagtgagggaaagtttttaacaccaaagcagaaagaattaatgctgcaatttgtaaaagaaatgaaaaataaattaaactgtatatagtttaatttacttagtatacagaaagtctatttagttataaaatattagctcaaaagaggtgataccaatggtcaataagaataatcaaacaaaagatagtatagcttttgaaaaggaatacgccgagtttgttattcgagtgggcttgaaaattggatattatcgccggtcaagaaatatgacacaagaagaactcgcagaggcctctaatttaagtcaggtatatattagtcaattggaaggtacgaattttcactatgctccttctttaaaaactcttttacgaataggcaaggcattaggtgttagtgtatataaatttttagatgttgagaatgattagaagttataaaatattagttcaaaagaggtgatatttttttgaatgtacaggatagacttaatgaactgctaaaaaaacaaaatttatcacggtataggcttgctaaaaacagcggaataccagaggaaacattgacaaatatttttaagcgtggaagtattccaacaattccaacacttgaaatgatttgtaaggggttaaatatttctctttcagaattttttgcagaagatgatatgattgagtgttctccagagcttatggaactacatgatgaatggaaattcttaacacaaaaacaaaaaaatttagttttagaattaataaaagaaatgagaaataaaaaataaaaaccgtcatacagctaccgagaatggcaagcatatgacggtttttattttatgagggcgtagggcggttataccgccctaccgaagttcactgaaaaaccgactttttttatgaattaaataaataggaacgcggaatatctttattcacggtagttcacaaagtcaacgggaaaaaacaaggctttttcatcttgaagcgcagattcaagatgaaattagcgggggcgagcgcccattggagccgcaggcgacctaagcgagcagtactttttctttggtgaagcgtttctttttcttacgagaaaaagaaatggttcaaacaccctattatgtaataataaattttttacatggggtcatatacaaagtatataggatagtttttttataaacaaaataatataattatatatattggttattcaacttacaaacagtaagtcaaaaaaatagtttacgcgctcgggtccggcgagcgcaaccgggctaggccgtcataccgaactgcagcagtttagtaactatataaataaaataatttaagggcacagttttcgtaactcgaaaaacagtgcccttttcaattttaataaaatttaaatataataatacatatcagcagtgcggaatatttgtaaattctgaaatctccctgctggtggtgcagagatctgacacattcatatcgtgaagattttcatgacctgttatgcgcgcaaacgttcttaactcttctaaagaacagttgaggaaattagcaacccttaatactgccggttcctctttaaaccggcttctcaattcctcgtcctgggttgccattcccataggacacataccgcttccgcatatccgatactgctgacaggcggcggcaatcaagcctgcgctcgctacagcaaccgcgtcagcgcccattgctatcgctttcgcaaaatcggacgatactctcagtccgcctgttattaccaatgaaatatctgatttgacagaatcaagatattttcttgccctatataaagcaaatacggtcggaacactggtcgaatccctgactattgcgggactggctccggttgcgccgcccctgccatcaatcgttataaagtcgggttcggcaaaaacgcagtattccaaatctttttctattttacctgccgctatttttatccctatcggacgaccgtcactgcgttcccgaagttctgaaaccaaattttttaaatcttctctagtattgatatttggaaatttggacgggcttataacatcctgacccagcggtttgtttctgatttcggcaatttcaggtgttactttttctcccggaagatgtccgcccattccgggttttgttccctgtccgatttttatttctattgcgtctgcattttttaggttttcatccgtaacgctgtaaaggttaggaacgtattcaaatatgtatttataggcggattgcatttcctcaggcagaattccgccctcgccgctgcacattgccgtttttgccagcgcgctcccttttgccagcgcaactttagtctcttttgacattgctccaaaagacatatgcgatatgtataccgggttttctatgaccattgggcgcttagcgtttttacctattactgttgtggtatagacatgggcgtgttcgtcaagcggcggaggattgaactgtgccccgagtataagtatatcatcccaattcggcattggacggcttgtacccatagctgatataatggattttccggtcaccgccatttggtgaatctcgtccatatatcttattgttttatcgtgtcgctcatattctctggggtatgaaaggtcaattttgttttcctgttcagttttaaacgattcaattttgtcaggttcgtttgcttcagttggctcatctgatgattcttcaatgagttcaaaatctgaggccggatgtttacagaccggacaaaattcgatttcatcaattgtttttccctcagcctcttcatcaaaaataaatccgcatatgggacatttgtattttgccataaaattcactccttttattatatttatgatacaatttcaatttatagacaagactgcttattattttttaatttaattatgactagttttatatgacctgtttttctttaattaattatatttacaacacaaatatctgtgtatatattgcagatagacaaaagttaatgttttagcctcttcatctgcggagtggtctcaaggagagtaaacagcgttttcgagccgtttttcatccttcggctcagcttagataacagttcactcatctgaggagcttattatgtttatgcagtttttttctcaaaaccacttttttacgcattgtagctcctattatatatagaagttaactttgtttttatgttataataaatagatttatttaaattataaaattaatttaaaagttaaacgccttttgttttttatctttttcgacacactgtaaatctattataatactatttttattaattttcaacaatttttattacttttaatatattaattttatactattcggggtgcgtgttgactatccgctgttatttgtgtataatattaagttgttggttccgggataataagctgtaacggaacttttcaaaattgaatttaaatctgggagatatgagatggaagagaaatcattatcaactcttgaatatacaaaaattttaaagtcgctttcagagtgtgctaaaaatgacgacgcaaaaacaatggcagaagaattgaagccgtcgtcagatttccgcgaggtggaaagggcgcttgcagagacagatgctgcggttactatgtcgcttaaatttggctcgcccgaaatattaagagtagagccggttgacggagcgataaagcgtcttgatgtgggcggcgcactttcggcggccgaacttcttaatgtggccaggcttttaaaatgtatcagaaatttaaagagatatactaaggaacagacaggggcgcttgaggaatatttttctgagcttgtctccgctaaacctatagaggacgagataaacagagcgattgtttctgaggatgaaattgcggacgcggccagtcccgctttagctaatgtcagaagaaagatgaaaaatacaggtgccaaaataaaggacagccttgacagcatggttcgttccggtcactatcaaaagtttttgatggataatatagtaactatgcgtaataaccgttatgttgttccggttaaagccgagcaccgcagtgaggtgcccggtatagttcatgatatgtccgcctcaggcagcacggtttttatagagccgtcgagcgttgtaaacgccaataacgaactgcacgaactggagataaaagaaaaggcggagatagaaaaggtattatatgagctgtcaaacaaggttgctgaaatatcagagcaggtcaagtataactatgagactttgattttaatagactttatttttgccaaggcaaagctggctcttgacatgaaagctgtctgtccgaaattgaatactgacggcaaaataaaaattgttaagggaagacatccgcttatagacaagtcaaaaatagttccgatagatgttcggctgggcgatgattttgacgttttggtggttacaggacccaataccggcggtaagactgttgtgcttaaaactataggcttattttgtattatgactcaggcggggcttcacataccggccaacgaggaaagcgagatgcctgtgtttgatgatgttttcgctgatatcggcgacgagcagagcatagagcagagcctttcaacattttcgtcacatatgaagaatatagttcatatagtagagaatgcaggctcgaattcgcttgtgctttttgacgagctgggagcgggaaccgacccggttgagggagccgctcttgccacagcgattattgaaagtatcaggcttattggcgcaaagattgtggctactactcattacagtgaactgaagctatacgcgctttcgacagacggtatagaaaacgcctcctgcgagtttgacgttgaaacccttagccctacttacaaattgttgattggcgtgcccggcaagagcaacgcgtttgccatatctaaaaaattgggtttgccggatagtataattgagcgttcaaaagagaaattgtcagatgagaatataaagtttgaagatgttctcggcagtattgaagaaaacagggtttccgctcaaaaagctagagaagagcaggagcggatgcgccgtgaaatagagcagctcaaagatgaactgcaaagagagcgcgaaaagatagataagaaaaaggataaaatatatgataacgcgagagcgaaagcagaaaaaataataaagcaggctcaggaagatacggagagaatgcttgaagagataaaacagcttcaaaaggaaaagcggaataaggaagctgtcagggcaatggaagaggttcgcaaagagctgaaactcaaggaaaaatctaatgtacgccccaaaaatcgcaggagcggcggcgtaaagtcgaacgttaatttaaacactttgaaacttggctccaatgttctgattatagacctaaatgacaagggaactgttctttcgataaataaagataatcagacggcagtaattcaagttggcataatgaaaatcactgctaagatttcaaatctagtggtgcttgaagatgaaaagggttcaaagcctgaaagctatgtggctccaaagaggtcgacaggaatcaatactgcaatgagcggaaagaccgaagttgatttaagaggtatgacaataggcgaagcggagcttgaagttgataagtttttggatgagtctgtattgagcggcctcagtgaagtcagccttattcacggaaagggcacaggcgcgctgagggcagggattcatgaatatctgcggcatcatccgcatgtcagaaaataccgcttaggcaggttcggcgagggcgatatcggcgttacgatagtggaactcaaatagccgattatctgtaaaacagtgatataaaagtattatattgaccaaattcctaaaatttttgttttttgtaaaaaaattgttgtattttttcgaaagtaatgataaaatattgaaatgactgtttaaattagtaaactaattttatttaggagataaatttgtatgttaaagaagaaatggatacttaaagaatttgataaggcaagggtggttgaaatttctaagaatttcaatatttcacctttaaccgcgattatcctttataaccgtggtatccgtgaagatgggcagataaaagattttcttgcccgtgacctgagcggtatgcacgacccattcctgatgaaggatatggataaggctgttgaaagaattcttttagctaaaaagaataatgagaaaatcactatttatggtgattatgatgttgatggaatcacatctatagcgattctttataagtatcttaaaaacatgggtttggaagtgggattttatgttccggacagaatggttgaaggatacggcgtaaacagggacgctcttgacaagataaaggctgacggcaccgctgttattataaccgtggataccggtataaccgccattgaggaagccgattatgctaagtctattggtattgactttataataaccgaccatcatgagtgtaaggaaagtattcctgacgtatatgcggctatcgaccctaagaggaaagactgtgagtatccgtttaaaagtcttgccggcgttggcgttgtgtttaagctgatacaggcgcttgacagttctgaaccaatcgaaaatctgatggatgaatatgcggacttaatgtgtctcggcacggttgctgatatttcaccgcttatagacgagaaccgtgtgattgtaaccgaaggattaaagagatttaagaccactaaaaatataggcttaaaagcactgattgacgtgtctacaaatggcaaggcaatcacaacctcaactatcggatatactatagctcctagaatcaatgcgagcggacgtttgggctgtgcttccacaagtgtggaattgttccttacagaagatgaagaggaggcggctaagctggctgattctctctgtcacgaaaatacgctgagacagcagaccgagcagaagatgtttaaagaggcgctggaatatattgaacagcatcctgaaattaaggatgatgatattttggttattcctcatgagaactggcaccatggtattgtcggtatagtttcatctaagattaccgaaaaatattataaaccgtctattttgtttgcggttgatggagattcagcaaagggcagcggcagaagtattgcgggatttaatctgtttggcgctttggaaaactgcagcggtcttttagaaaagttcggcggtcatgagctggcggcaggacttactattaaggctgagaatattgaggctttcagaaaaaagattaacgaatatgcaaagggaaaaattgaggatatgactcttgttcctactatatctctggacgctcaaatcaaggttccttatataacgatagatactgttcatgatataaataagcttcagccttttggagtaaacaacccaacgccatcgttttctgttcgcaatataaagattcacagaatcagtgtgatgagcgagggcaagcatctgcgcatgaccctttataaggacggaaagtatttggataccgttggttttggaatgggagattattatagtatgtttagggaaggcgactatattgacgttgcttttgctcttgatattaacgactataaaggcttccaaaatgttcagcttattttgaaagatatgagaaaaacggagtttaaagacgcaagataaaagaaatactaattatataaataaatatggaatgaaccggctgtatcttagatgtatcgcgtttagcatacctttttgatgagaccggttcaaactgctatatggcgagtgatgaattatgaaaggtaacgagctttctactcttatagagttaataagaaaatataataaaacaggcgatttgtccatggtggaaaaggcgtataattttgctgtcgaaaagcatgacgggcagacaagaaaatccggcgagccttttgttaaccacccgattcaagtcgcttcaataattgctgaaatggagtttgatgtggagtctatagttgccgcgctgcttcatgacgttgtggaggataccgactccaccagagaggatatagtccgagaatttggggagactgtggctctgttggttgacggtgttacaaagcttgataaaataccatactcttctaaagaggaacagcagattgagaccttgagaaaaatgtttttcgctatggcggaagacgtcagggtgatagttataaagctggccgacaggcttcataatatgagaacgatgaaatatatgcctgaggagcgtcaaagggcaatatccagggagactttggaagtttatgcccctttggctcataggcttggtatgtcaaagataaaaatggagctagaggacttgtcgctcaggtatatagaccctataggatattatgagatagttgacaatatagctcagaagcgtgaagaaagagaaaagtatatcggcgagattatcgaaatacttcaaaagaagctggatgaacttcatataaaagctcatgttgtaggcagagccaagcatttttatagtatataccgcaagatgtttatgcagaataaaactattgacgagctttacgacttatttgcggttcgcgttatagttgatacagtttcagactgttacgcggtgctgggtatggttcatgaactgttcaagccgatgcccggaaggtttaaagattatatagctatgcctaagccgaatatgtatcagtcgcttcattcaacgcttattggacctaatggcaccccgtttgaaattcaaatcagaacatgggaaatgcaccaaatagctgaaaacggtatcgccgctcactggaagtataaagaggggaaaagcggttccagcgatatggacgacaagctggaatggattaaaaatctgctggaaattcaaaaggacagcaccagtcctgaagactttatgcacaccttaaaaattgatatgttcagcgacgaggtgtttgtcttcacaccaaagggcgacgttgtcagtcttcctgcaggctcaaccccaattgactttgcctataggatacacagcgcagtcggcaatagaatgaccggtgcaaaagtcaacggaaagattgtgccgctttcgcacgagcttaaaaatggtgattttattgatgtcataaccagttcggttccgcatggaccgaaaattgactggcttaaaatctgcaagacgtctcaggctagaaacaagataaaccaatggtttaaaaaggtaaaccgtgaggaaaatatagaaaagggaaaagagactatagaaaaggaactgtctaaaaacagtattcctgtcaaatatattaatgatgaatcctttattagcccgttactaaagaaatacggatttaacggtataatggatttgtatgcggctgtgggatacggaagcacaaacgctaatcgatttgtaaccaggtttctgaccgaatgcaaaaataaacagcttcaggaaatggagcttactccggcagagctcaatgttccgctgaaggtgaagaccacagccaaacccaatacaagcggcgttgtggttgagggtatagataactgcatggttaggttttcacactgctgcaacccggttccgggagataaaatagtcggttatgttactcgcggcagaggcgttgccgttcatagagcggactgtctgaatatgatacatgccgctgcgtctgagcaggagcggaacagattgatttctgttcattgggcaggcgatactccgccgtcttcgttccagtcgatgattacgataaccgcttcagacagggttaatctgctggttgatatactgactgttataaacgatgcaaaagcgcctgtaactaatgttaacgctagaaccggcagaaacgatttggctataatagaaataacgaccgaaatttcaaatacgagccagcttgacactataaagagaaagcttaaagcgctcagcggagttatatcggtcagcagaagcagacagtaaataattataaaggatatggtgctatgataataaaaagattgattttaggacctgttgcaacaaactgttatattttcttggatgaagacagcggtgaagcggcggttatagatccgtcagccgaccataagtcgattttgaatttaataaaagaaaatggctgcaagcttaaaaaaatattcctgacccatggtcactatgaccatataggaggactgtccgggttattagaagcggagcctgaggctaaggtttacgcccatgaaaaaagcgctgaggttctaggcgagccgcgcgttaacctatccggtgagcttggcagaaaagaagaaacttttaaggcggatattgcgttaaaagacggggatgttattccgttcggaaatgatgagtttaaagttatttacacaccgggtcatacaatagacggaatctgtttggttatagacgggaaagttttctgcggcgataccatatttagattcagcgttggcagaaccgatttccctacaggtgatatgagccaggaggttcagtcgattaagacaaagttaatgccgtttgacgacagtgttcgtctgtatccgggtcatggggaacctactacagttggagacgagcgccgcggaaacccatacttgagataggattaggagtatatttatgtcagaaattacagatgaaacaaaatccccttggggaatattgacgggtatacgtccggctaaaattgccactaaactccttgacgagggcatgagcgatgatgaggtaataagttattttataaatgagtgcggtaccacatatgaaaaagcgtctcttgccttagaggcggcgagagcattgcggccgatacgtgatgatatgtatcaagacggggtgagcatttatataggtataccgttttgcccgagcaggtgtctttactgctcttttgttaccaacggcacaaagcaggcggcggctcttatgcctgagtatatagaggcgctgaaaaaggagataaagtatacggctgatataataagccataacggaaccccggttgaaaccgtatatatcggcggcggaactcctacaactcttacgcccaggttgcttgaagagatgatagactgtctctatgacaattgtgacctttcaaaaatgaaggaattcactgttgaggcaggtcgtcctgataccataacggaagaaaaactaaaggttttaaagaagtataatgtggacaggataagcataaacccacagtctatgaatgacagcacacttaaaataatcggcagggcacacagcgccgatgatatacgtgaagctatgaaaatggcaaggcactgcggatttgataatataaacatggacgtcattgcaggtctgccgggtgaggatatggaaatgtttaagtataccttaagcgaggttgagaagctggaacccgaggataccacggtacatacaatgagtataaagcggtcgtcaaggctgaatgagtatttggacgagtacgatttggcaaaaggcgagttggttgcggaaatggtgtcatatgccagaaagtatctggcggagagaggaaagtttccgtattatatgtaccgacagaaaaatcagcttggaaacctggaaaatgtcgggtattcaaaacccgggttcgagtctctctataatctttatattatggaggagatacagactataatctctttgggctgcggcggtgtgaccaaaactgttgaccttgagacaaaacgtatagagcggatatttaacgttaaagaagcgaaggactatattgagcgcctggatgaaatgcttcatagaaaagatgttttaagacgaatataaattaattgataggacttgaaataatggaaaataaaaataacgaatctattgaaaacacagaaaatagcactgagaatattgagagcactgaatatactgagtctgttgaaactactgaaaacactgagaatacagaaaatacagagccggcaaaaggcggacatgatttgggaaccggcagtataggaaagcttatgctcaaaatggcgataccgactattatagcgcagataattaatatgctgtataatgtggttgacagaatgtacataggtcatattcccgacgtgggcggaatagcgctgaccggagttggcgtaacatttcctataatagttatcataacggcattttcagctttggtcggaatgggcggagcacctcgcgccgctataagcatgggtcagggagacaataaaacagctgaaaaaatcatgggtaactgtttgacaacgctggtaataatagcggtgatattaacagttctgaccttgatttttgcggagccttttattttgatgttcggcggaaaccgggacacaactttaagctacggaatgagttatatcaggatttatgcgcttggaactatatttgtccaatgtgttatgggaatgaatgtgtttatcacaacacagggcttttctacaaaggcaatgctgacaatagtaatcggagcggttattaatataatactggatccgatttttattttcgggtttaatatgggcgtcagcggagcagctattgctacagttatttcccaggccgtttcagcggtgtgggtaataaagttcttgtcaggtaaaaagagtgttttgaaaataaggaaatcctgcctgggctttgataaaaaaattatgctcccagtgctggcgctgggactgtcgccgtttataatgcagtttaccgagagtattctgacggtcagttttaatttctcgctggctcagtacggcggagatatagcggttggggctatgactattctagcaaccgcaatgcagttcgctatgatgccgcttcagggacttacgcagggcgcgcagcctataattagctataactatggagccggcaacaaaaagagggttgaaaaagcattcggcttattgcttttgttctcgtttattttttcattgttattctggtcggtgtgtatgtttgcccctcaatttctggtaggaatgttcagcaacgacccaagtcttgttacgtttgctgaatgggcgctcaggatttatatagcttctgtatgtatttttggtatacaaatagcgtgtcagcagacgtttatagcattaaaccaggccggagtttcaatatttttggcactgcttagaaaaatcgttctgcttataccattaatttttatactgccgaatattataactcccggatttgccggtatatttacgccggataatattccgcctcttttggaaagcggagggaatatagtgaaagtgttcgcggtatttttagcggaaccgatttcagactttttggccgtggtgtttaccgcgctgatgtttgctctaaagtttaaaaagatattatcaggcaatgaaagatgtgggaaagtataatgtcagaagagatgcaaagcaccgagaatcaaggaactgagaatcaagggaacgaaaatcaaggaattgagaatcaaagtatcaagaatcaaagtatcaagaatcaaagtatcgagaatcaaggaaacgagattcaaggaaccaggattcaaagagaagagatgcaaagaaccgaaatgctgcttggatatgacggagttgagaatcttaaaaattcaaaagtggctgtattcggagttggcggagttggaggctacacagccgaggcgctggcccgttcaggcgttggaagcatagatttatatgacagcgacagggtgtcgctgagcaatataaaccgtcaaatagcggcgcttcacagcactgtgggaaaatacaaggctgatgttataaaagagcgtatactcgatataaacggttgtgctgaggtcaatgcctataaggtgttttatctgcccgagaatgccgatgactatccgcttgataaatatgactatgttgttgacgctatagacaccgtatcagccaaaattgaactgatatgcaggtgcaacaagatgggtgttcctataataagcgccatgggagccggaaataaacttgacccgacagcttttaaggttgcggatatatattcgactaagatgtgtccgctggcaaaagtgatgcgccgggaactgaaaagccgggatattaaatcgctgaaagtggtatattcagaggaaaaggcaaagaagccggaaatacagttgtatgacagtgaaaataataaaccggttccgggaagcgtcagctttgtgccgtcggttgcaggtctgataattgcaggagaggtaataaaagatttggcgctcagagcgaaagaggaagaatatgagaacagttaaaatatccaaagccgacagcggtataaggcttgataaatttttatttaagataatgcccgatgcaccttcgggcattatttataagtctctgaggaaaaagcggataaaggtaaacggcaaaaggacaactgacggtaccgttcagcttgacggcggagacgtattggaactttatattaacgacgaattttttgaaaaaggcgcagataatgacgataagtggttaggctgtgacggaaatatttctgttgtatatactgatgaaaatatagttgtaatgaacaaaccgtcaggtatgaagtctcaggacagcggcgatgatgcggattcgcttgaaagcgagtttcgggcgtatttatataagcgcggcgaactggatttaaacgggacttatcttccgtcgctctgccataggatagacagaaacacttcgggattagttataggcgcaaaaaatttaaaggcgcataggataataaccgaaaagattaagaccagggaaattaagaagttttacatctgccgggtggagggaagagttacgcctgagagcggaaaacttgagggatatatactaaagtgcggaaacgatagggtaaaattcagtgagaatcggattgacggagcgaaaccatcggcgcttaaatatagagttataaaatatgagggaaacgcgtctgttttagaagtggagctgctaagcggcagaacccatcaaatcagggcaacgctggctcattacgggcatccgttggttggtgataaaaaatatggggcaaaatctgacggcggaggaaaatatcagagcctttccgcatataagctggtgtttggattcaagtcacagtcaggcggtcttgaatacttaaccggaaaagaaataagcattgaagccaatatgtaatgattggtttttcattaaaagaaatatagccgcccttgttacaaaaggacggctatattttattatctaaatcttttggcaataattaaacggttattttttatttatattttttatgttcttttattctttttgtcaagaatgtttttaataaatgtgaatatatgtaaaggatttttaatttgactttattcgataaattgtatataattatatcaagtgggtaaaagggaattgtaggacggttgtcatctccgtatgctgttacttacagcagaaaggaggtgtcgcttatgtggaaatacttacttaaagtaattatatctattataataatttttataatagtgtccataaaagcaatataactgtcctctggtcaggacagttatatttataaacaaatatttctcttgacaaccgtttaacggttaccttttatctgcttttattatattctctttttctatttttgtcaagaatattttttatttataaattgttaattatatattgaacactgcgtgttcagatgttggctcacctaacgaggcgcataaatgcgccctaccgtagttcactcaaaacctagtttttttgtattaatttatactggaaacttgtttttttaattagtaaatcactagtaaatcaacaggaactcggaaaatctttattcacggtagttcaaaaagtcaacgggaaagtaacaaggctttttcatcttgaagcgcagattcaagatgaaattaggtgtatgtgatattatggtgatataactataacacaatttatgagttttccgtattctttttttctctttgtaacacatctattgtaatcctacattttactttaatttattctattttataatttgactttatctgccaatccgtatataatgttgagtaactctcagttaactatatatccgagattaaaccgattaacactcggtataatcaggactgaatcaataaaaacaaaaacagaaaggagatacccaccatgcacacacttaaaaaatttataaaatactatggtccatataaaaccgtgtttttcttagacctcatctgcgcaactgttatcagcgccgttgacctggcctttccgcaaatcctgcgcacattgactagaacattgttcacacgtgacaccgccactattgttaacgccctaattcctatagcgctggctctgctcacaatgtacataattcaaagcctttgcaaatactatgtcagctaccaaggccatatgatgggcgcaaatatggagcgtgatatgcgtcaacagctttttgaccattatgaaaaactttcattttcatattatgaccaaaacaactccggtcaaatgatgagcaaactcgtctctgacctttttgatattgccgagtttgcgcaccacggcccggaaaacctgtttatatcattaataaaaatagtaggttcttttacctttttgtttattataaactggaaacttgccattcctatggttgtgttggtttttctgatgtttcttttctctatgagccaaaataagcgaatgcaggcaacatttatggagaaccgccgtaaaataggcgacgtcaacgccagcctccaggataccttgtccggaatccgggttgttcaggcttttgccaacgaggaagttgaacgcaataaatttcaaaagagcaatcacgctttcttgatttccaaaaggaataactatagctgtatgggaaactttatgggctggaacctattttttcagggcatgatgtatcttgtcacacttgtattcggcggctatctaattgctcacggacaaatgcaggcaggagaccttgcaatgtatgcgttatatatcggaatatttatcagccctatacagatattggttgaactcaccgagatgatacagaaaggtctgtcgggattccgccgctttttgtcagttgttgaaaccgaacctgatataaaagacagccccggcgcgaaagtcctggaaaatgtgaatggtgatgtttcctttgaaaatgtgtcgtttcattacagcgatgatgacgcgcttgtattgtccaatctttcattcaaaatccccgccggacgttctatcgctcttgtcgggccgtcaggcagcggaaagaccactatctgctctctgcttccgagattctatgacgtaacggacggacgtattactattgacggtcacgatgtacgcggtctaactctaaaaagtctcagaagccaaataggcattgtgcagcaggatgtttatctgttttgcggaaccatccgggaaaacatctcctacggaaaacctgacgcaactgcagacgaaataatagaagccgcgaaaaaagctaatatacatgattttatagaagaacttccggacggctatgacacatttatcggtgaacgcggaaccagactttccggcggtcagaaacagcgtatatcaatagcgagagtatttttgaaaaatcctcccattctgatattagatgaagccaccagcgcccttgacaatgaaagcgaacgatatatccaagaaagtctcgaagaactcgccaaagaccgtacaactatcacaattgcccacaggctgtctacaatacggaacgctgatgaaatatatgttattgctgaaaaccggattgcagaacgaggcacatttaaggaactaatggatcaaaacggaatttatgctcactactatgaaatgcagtttcagtaatacaaccggagggttccgctattcaatacatacttacaaagcatatataaaattacacgttgcaacgagtatttctaatattggaaacaaaaaaattgtcataaataattgggggataaaactaaaggatagttttatattaatattgactgaaggatttggaaaagaactgtttgacaaattagtttctgtaaaaaaaccttatgtttcggagccggaagaaaatgtagtatttttctatgataaaaaattatttatacggttattaaatgataacatcaataacaaaactattgaccataatagtaaaataatgtttgtgattcatgattccacaggaaggtcttataccatcagaagtaaatataatgcaggtaaatacatacataataattataatttaactgtgaaattataatacctttaaacctctacaggtaaaattcaatacttttatttgaaaaaagctgtcccagtaattagatataataacttaaaatcctaataaaccaataaataaagttctatttataacttatagcattttttacctttcggattaactactaaaaagtgatatcatttagaatttaaaaaaacttataaaatataactacttgaaaattttatattaattttataactttaaatttttcctgatagaaaatcactgagtttcttaatcaaaccaataaaaacaagtaataatcttaaaaactattatggtaaagtaagccatagtagttttttattttgagaaaaaatatataatagtaagaatttttccaaagttaagtgtatatcaaattaaatcattttataaagatattacagttattttaatctctaaaacaaccgcataaaccgaaactgcatatattgttccagtataattgtatactaattaaacaagagcaaaaaaatttattttgtttcaaacataataataaacacaaaaaacttaaaatacagaaaattttatcgtcaagtttagacatcataataatatgtatttctgttgttaacgtaataattctttaacttaattcacagttcaataaaacgcagtcaaaataaatcggtaaaatttctaagacatttcattgaataaatcttcctgacaaatacaaaataaactttattaataagtttatttgcgtaaatttatgtaaccgataggtctaatgaatacatatggttacttctacaaacaaattcggcaaaataaaaactgacaccgttttttaaacgatatcagtagtatgtctgcttaaaacgtaatatttactgccgtatatatttttataataataatacaattaataaagttcatatttattaaggttcaattatctcggcactaatttttgtatcattctattttatgtagcaaccaaaagttctaaatcacggcctacagctatatctgcctttgatattccaaattttacagtttcatacgctagcttaggataattattttcttcacttaaatggcccaaaattattttttcggctcccattcttacaagaaactcagttgccttagccgcgtcatcattcgatagatgacccagcttacctaaaattctttgcttcagaggatatggataaggtcccacctcaagcatccctatatcatggttggattctaacaaaaccgttttacagccgccaatctcacgaaacacctcttcagtcagaaaccccatatcggtagccaccgccgcccggcaccttccgtcatcaaaacaataaccaaccgggtatgctgcgtcatgaggaatcggaaacggctttataccgatatctccaatagaaaatggctcaactccctcaaaaatctttattttatcatcattaagctttcctaaatcattagtcatgattgcggaccaagtcattgagttcgcatataccgggacgttataccgtctcatcataacgcctattcccttaatatggtcagcatgctcatgtgtgacaactatcccgtcaagatccccgggctcaaagccaatatcagccatagcggtttttacagcttttccgcttataccgcagtcaactaatattttggttttgtctgtatatacaagactggcattgcctttactcccgctttttaaagaatgtattttcataaaatcaccatatttagtcttctaaataaaaaggattggcgcggcgcaccgcaatcaatccccaatatctatcacaatttatacgtttacagcactcaaaactccgggcataggattaacatttcggcgtgttatctgcgccccaagcgctctcagcttttcttccaggttttcataacccctgtcaatatactgaaggttataaatctcagtaactccgtctgctatcaatgcggctattaccatagctgcgccggctctcaggtccgttgcgcacacaggcgcgcctgtcaaacggcttccgccctcaacaacggcaacatccttgccttcaacattcacattagcgcccattctattaagttcatcaatatatttaaagcgattatcccaaacgttttctttcattatgcttgttccttttgccacagtcagcaaggtaagcatctgaggctgcaagtcggtaggaaacccgggatatggctgtgtttttacattagcgcgctttagttccggcttgtctacataaatccttatcgcctcgtcatactcctctacgcccacgcccatttcttccagcttagcactgagagattccatatgcttaggaataatattggtaaccataacatccccgcgggttgcggcagcggcaatcataaaagttccggcctcaatctggtcaggtataacgctgaatgttccgccgtgaagttctttaacgcctctgattttaataacatcagttcctgcgcctttaatattcgcccccatagagttcaaaaagttagctacatcaaccacatgaggctctttagcggcactgtctataacagtaattccgtcagcaagtgcggctgccagcattatattgattgtggcgcctacagatacgacgtcaagatagactgtatcgccaacaagctcgtctgctgtaatattaaccatcccatactctatatcaacttttgctccaagcgcttcaaaccccttaatatgctggtcaatcgggcgaactccaaaatcacagcctcctggcaaagctacgctagcctttttaagcctgcccagcagagcacccataaggtacgacgacgcacgtatctttcttacgctgtcatatgacgcaacataatccgtcaaatcagaacagtcaacctcaaccgtatcctctccgacaaattcagccacaccgcccaatccgtttattatgtcaatcaaatcaagaatatcacttacatggggaacgttttctataacacactttccctttactaatatagacgcgacaagaatggcaacagcagagtttttagcaccgcttatcttaacttcgccatgcagtttaacaccgcctaaaattaccattttctcttcattattcattataaaatgcccccaaataaatagcattaattatgtaaaccgaagctgcaaatattcacgtttctatttataaaaaatttataaaccaacaaatattataacacaaataaattttttggcaagagcatatctatgtttttaaaagaatttgacaaaaagccctgtcaaacactataagatttatatcttttgcatagataaatccctcaatcgcattgatagcgctatatcttgtatctgtaaacagacactgatacaagacgcacaaaaaacgccggctctataccatcgtcacatatattgtaacacaaaaatattacgtattgattacgcttgctttaaaaatcaaataaacactaaaaatttgcagatgacacggtttgatatattttttcatgtttcaccaaattcatacatattaatataatgaagtgagagatattgttccggcacaatttctgatttatatttaggaggaattcatatggcaacaaaaatatttgtagacgccggacatggaggaacaaatcccggcgccgttggcaacggagtgattgaagcaaatgtcaatcttgctgttgcaaccgctttagctaacaatcttagaaacatgggatatgatgttagagaatacagaaccacaaatgatgaaaatgttataacacccatagctgctgatttaagaaaacgtgcacaaacagctaatgattggggcgctgattattttatcagcattcacaccaatagctcgctggatccggcagtaaacggctttgaaacctatgtatacaggcttggcactcgttccgcccagcttgcgcaatcgatacaagactcagttgttcagcggttaggagtaaaagataatggcgtaaggcaagccaacttctcagttctgcgaaacacaagaatgccggctgtgctggtagaactcggatacctttcaaatccgactgaagcactgaatcttaacagccctctctggcaaaataaaatggcttccgccattgccgacggaataaataattatataaaacgatagacataaaatctaaagctaaaagccgttccaaataatttggaacggctttaataatcagcactttattttctaaagtattttattcagctttttgctgtcctataaaattcgctaatctttggaataccaatgacgcctcggctctgttagctgccgtttgcggattgaagttattgttatcgtctccgctcattataccgattatcttattatatgttactgcttcgaatgcgtaatcggaaatactgcttacatcattgtaatctaagttaatcatccatgatcctacaggacccataccctttgaaacaacataacggtaaatcattgccgccatttgttcacgagttataatttggtcgggagcaaactctgtgtctgtataaccatttactactccgttcgcagacgcccagccaatagcttctctatagtaagatccttccggaacatctgtaaatccaaagtttgtcatatcagtcttaggctgattttccattctgtggagcactgttacaaacattcctctagttatgttttcatacggaccgaatgtatctgtttcgataccattcatcaaaccgttttcatttacatacttaactccgtcatagaaccaatcagatgtgttaacatcattaaatgggttagtccatgaagacgggttctttgtcggctccggtgaagctgaaacattaggatttgcagtctcagccggcttaggtgttgaagttcctccggtactgtgtccgctgtttccactatttccgctgtttttataaccggttttatcgaatgtatatgaaacagtcatagtttttccgtccggactaatctcattaacttctgcttcattaccgttaactaatgcttttgcattgtcagcaaaactatatccgtcttttgccgccaatgttactgttgctgtatatactgtaccataatcaaactttccgccttgttctacattaggactccaagtaataatacctgaataatagtatgaaccttcttctacagcagctgcaaacgttgccgcagcatttgatttcggcgccgtaattttaatctcagcactgttcataacgaatgttacattttgatcagcatatttgttgccataaatcactcttacataggtatcgccgacataagcgtccgcacttggaagagaaacatctaatcctggcttaaatgtaaacccgctctttgtagattcatcataagctacatcttgtgatgttccgtctttataatgaaccgtaataactaaacctgccggattgaatgttgaaccttctgtatatgaaaccgtatcaggagcatttttaatttcaatataatcaatgctgctttcctcagtagccacaactacagcttctgttttatcatcattaacctttaatgaattatcactttgagctacgtcaacttctttaccgcttacggctttagccacgatttcataattaccctttggagctgaacccacaaatgtaatttcacctgcttctgaaacttccatatccaatacaattgtttcaccggtagccttatttaccaataaaacttcagaaatctcttctgacgcacttatctgaacctgatactcaggcataggtgttgcagttggtgcgtttggttttactgtcgctgttggatacggggtcggtactacaacaggtgctgatgttggttttgctgtcgctgttgcctcaggtgtcgctgacggctctgttgttgccgttgcctcaggtgttgctgatggctctgttgttgctgttgcctcaggtgtcgctgatggctctgttgttgctgttgcctcaggtgtcgctgatggctctgttgttgctgttgcttccggtgtcgctgatacttccggtgttgctgatacttccggtgtcgctgatacttccggtgtcgctgatacttccggtgttgctgacacttccggtgttgctgacacttccggtgtcgctgacggttctgttgttgctgttgcctcaggtgttgctgacggctctgttgttgctgttgcctcaggtgttgctgacggctctgttgttgccgttgcctcaggtgttgccgacggttctgttgttgctgttgcctcaggtgttgctgacggctctgttgttgccgttgcttcaggtgttgctgacggctctgttgttgctgttgcctcaggtgttgctgacggctctgttgttgctgttgcctcaggtgttgctgaaggctctgttgttgccgttgcctcaggtgttgctgacggctctgttgttgccgttgcctcaggtgtcgctgatggctctgttgttgccgttgcttcgggtgttgctgacggctctgttgttgctgttgcttcaggagactgagtcggcaaaacatcatttgtaattgatactgttggtagtttttcagcgtcagttacgaaatcagttccattccatacaacaatctgctgcactccgtctccgtcttctgccacctttttattactctcgtcgccataatataagtttttaaagttcagcacatatcctgtaacatcctgttcaggattaccatttttatacacggtctgtaaagttgcatatccttcccatccttctgttgggtcagttgccttataccactcattttctatgttaaaaattgcatttactttatcaaccaaaccgttgctaagccttaaagcgctagctgatatttcgtatatattatcctttatagtaatcgtagcattctcttcaacattatatatactgattccattatgagttatctttccaaaatgattcccggatatttctgttccatccgctactttaacaccatttttatttacttcactgcctacatcaaactctacagcattatagtaaacaccatcattttcagttccaaatgtgttgttctttactatagtctttccataatttttaagattcaatggtgtttttactccagcggcagttgcttcaaatttacaatcagtaattgtaaatgctccgtttccgctcactgtaagcgctccaccgtctccgaaattaaaccctgatactgttatatcattagcaaggactgcgttctctgcagttgttattacaactgagcctgaagcaggagttattgtctcgtttacctttgcatcttctatagctgctttaagggatgtataatatacatcttttccatttctgtttatcttagcaacattgtctaccgcagtttctccaacatgataagttgttccgttaacaacaatttccttagcttcagttcctaaaactgctgccaaagcctttgttgtttccacaaccaaagcgtcgtcatattttacgccgccgatagtttgtgctaaaggaagatactcaattccgttgtaagtaatataattgccgtctccaaaatattgagcttcattattcgggtcaaacttttcaaaagtatcattaaccgaagaagtattatcaaaaacaacagctgtagcagttgaagaaatagtaacaccaactatagcgttataataataaagcgctttaaatgtattattatttgacgcacagtctgtaaatgtaagacctccattagaaccattttttagtcctaaaaaggctgcgacctttgtgcatccggaaataacagagttctgaacaattacattattaaatttgctgtctcctctggcttcgccgatcacaacggcagcgccgctgctgtaatcctgaacaacagtatttcctttatcttctacattacaattatcaaacactatattgcttatttcaacatcaccattcatgtgtccaataaaccctgtgtaataattataatttgccgcatttgatgccggggcaactgtgtcaataatattaagaccggttattgttgaagattctgaaccctttatcacaaaagttccgctccaagcagtacaatttgagccgccggtatgaggacctgctcctgaacacgcggaaatgggaacccaataatgagctgacatatcatatgtagagcctgttaagtttatagttttcccgccaaagcttacattttgattatttatcaaataagcaagacctgcaagatcggcagaatcagttaaatcatatgatccgctattttcgtttcctgtataccagcttatatcataattatctacgtcagtccaatatccatttgatgtaacatttgaagactgaacgttgttataatcatatgacttctcctcgtctgcaaaaacaggcaaagatacaaacatagaagccatcatagcgactgttataatccaagccaaagtagaacgaactgctctcttttttactttcattaatttacacatccctctaaaaaatttatattattttattttttgcaattattatttaaaactatagaataaaaatatttctatagtttccgcttctttttacgaaacgcttttcttgttcgcgctgcgcaaaactgtgtattaatccatattttgcacactgaattcgaattattcaaaacattagaatttttaaaccaaaaagcgtgtataatagggtaagaaaaaagcggccaaataccgcccagatactcgcgtaggaggcagctgactgacatattgaaacttccataaaagcatattgcttataatggtcaacttagtctctaaagctttgcgacctattttttcaaatagtttgccaatatttaattcttttgttaatatccaaagtaacagtatctcttggatttgtgtatacattatacaacgaaacgtcgaaaaagtcaatattctatctctagaataatatataaaaaaaatactagtgatttagtaaatttacacaatacacctgttcataaattggcacaaagttccaatcgttttgtggttttttatgcaaattttattccattaattattatttgattacatttgttacaaaacatttaatgatatacggctaatacacccatgtcttaaaaactcaataaaataatcatcttgattattaatattaaataatatataattaaaatatatttactttggctttctgtgaggtgttaaggatgatgaaaaagaataaaaacagagttttaagcgtagttttcaggagcgcagtaattatcttatgcgctctctccataatgtatgcttttattcttacttcgtgcacacagccagcccgctcctcaaacagcgacagtaaagctttgactgttaaagataattctataataaggattgcttttaccgccggatatgaaccatttgaatatatagacgattcagggaattatttaggatttgatatggcactaggatacaaactttcagaatcaatgaacagaataccggtttttcagaatatgaaatcaaattctctgcttgattctcttaactgcggaatatctgatatggtaatttcagctgttgaagtaactgatgaaagacaccaaaaagtcgatttttctgattcttatattactctcagttcatcaattataacgtataaagacaatactgatgtgaccaacataaacagtcttaaaaatgcacaaaatgtggctgttgcttccggcagcgattcaggttattatttaactaataatcttggtctggcaaatattaaagaatataggaacgaggccgaggcagaactggcagttttaaacggcgccgccgatgtattatttactgacagcaaaattgccgagacttttgtaaatcaaaatagaaagtttactataaaagagacaaatattaatcagcgtaaattttgtatagcggtttcaaaaggaaattctgatttgctgagactgataaatgagaaacttaacgaatttaaaaaagatgacactctatacaacctgagatcagcctatattagcggaaacgcagaacttagaacaacatttgacgatgaacttataaatattcagcaagacaggacagttcctaataccaaaacttcaactgattatgcagagtaaaattccaaaaatttaaaataaaacaaagagacaggggtaaaacagaattaattaaaaatagatggaaaaaaccttctatgacagaatgcaatgaaactgtcataggaggtttttgtatgcagaaaattacaaacatattgaatattgccaaaatttattattttctaatatcaagtaaaagtcgggcgcaagataaataacaacttttactaagttaaattttatgatcttttatttaaatgatataaaattacttttatttcacaaaaacgcctaattgcgttttatatcttatttatatcagcttatctgcgccgcctaaattatacacattttcaaatcccatagctcttgccttttctacagccaattctgctttaaacccatttaggcaataaaatataattatcgtatttcttccatacgtcaacaaactctctatactgtctaatggaatattaaccgctccttggatatgggattccttatattcatactcttcacgaacgtccgccaaaactgctccgtttgaccgcagcaccattgcctcgtccggttcaactctatcagatcccagcgataccatttttattgtcttactttctgtatcgccggttatattcattactccgccgtctatttttatatctttaatatcaaaaccgcaaacttttttcaactgataacatttttgacacaacggcaatattaacattattccattgtcgcagccggcatataagcggcctttatactcatcaatactatttattttcagcgggttttgaatttcttcaacatcacttttcgcaaaataatccagctttacttccgaccaaacggaacctgagccgcttgaagacaatttggtttttcccgtgacgctttctttttccaattttgcaaaaccgtttccccactttgcactctgaattgtctcaaaagttttactttcatcaattccgtttatatattctacaaaaacagcataaatatttttatttccgccgttgccatatacgtatacaggctgagttatatccgatatttttgccgttacatcagatttacattcaggatatgattttccgccagccaatattgttcctccttggacaatataaatttccctgtctcttcccccattgccgtcaaacagaaccgtaatatagcattcagcttttggtctgtataacaagcagctttcggtttcgcttccgtcgcctatctgccaggcagttgaaaagacgtattctttgtcgccatatacatatttaaacttctttttttctcttcttaaaactgtgccatatcctgtaatgcaatcaatctcaggaagtttatccattcgtgtattgcagaacaataccgtatacgccctgttatcaccgctgtatacctttactttcctttctgccggttttctgtaagtatggttaaatatatcagacgcttctgtatccatattgtatacgcaaaaactcacagaatccccgtatttacaatttgtggagatatcatacctgccccctgctgtcacctcaatagatttaatttcctttgagacttcctcaccggtatacacttttaaaacgcccgaagtgaaaccgctgcccaaacactttatatcaaccgacatcaaaccgttctcccggtcatgaacatcagcaatactatatggaagacctccgtcatattcctcataatccagcttaaaaaagtctatattggcagaattagcttggagaaatatcgatgaaagtccgttcccatctacagaggcattatacaacactgaactgttaactttaaatacagcttccttccaaatctcacttccgcctgtttcttttaaaatattctctgctaaaatacagttgggagccgcacttctattaacgctgaattttatattgacgcttccggatttaagcgcatacctcacagtaattttccttagattttgaagccttattcccttatactccagccagttcacgcttgtattgccggtactgttggccctttgagctgagccgctggctccgcttctgttgtcgccgaaattattttcttcactgtcactgtcctcagcctcaatctgagtattaatatatataagcgtttctccgccgactaaacttgatatatctataacccgcactctcacaagacctccggtcattaccgtgagttctcctgtatttctgttgatttctgcagaatcacgctttgaactgtccagtttttctatctgccaaattaaatttttgctatcaattctattatcgccgtcataagcctcaagttcaataccatgataaggattttcagtatttactgtacccgaaactccgtctttgcttgttatatatgggggtattccgcccatgcggtaatctattactccatcaaccaaataattgggatttttagaagctatcgtataccgattttcaatattattcatttccaccgaacgcagtttcttaatcgattcagccaatatcttggtcatatccgtatacttgaccgctgattctatctctttgacagcggaatcatatatcgcttctaacttattccaattattatccgaaaacgctcctttaggataaaaattcttttcgtatgtcaattcttgtaccgctttatttttatcactagttccggccttatattcaagtatatttactattgggaacccaaccgatttggtctcattattcacagtaacttcggccgttatcattgtgactcctgaaaccggaccggatttaacaacgcctctatcatccactgcagcgaccgtctcattaccacttttataagaaactttcacctttgatatatccaaaattttctcgtctgtcataacaacagacagattagctgttacagagcttatttgctcaagttctccgccttgtccgtttattaatccgcgcaccgctataccgctgggcagaacagatacggttttcaacttgctttcaagctctccggaaacactgaactcgtctgctaaagattcatcagcagaatttctgccaatatacaccttatattttccctctaagacataggctttttgttccttctcactgaaaaacgacatttcagaaatatcaagctcaaacgaaacactcttaatctctccgggcagcagttctattctttcaaatccctttaattgttttttaggcttattctctccgtcagcccccggaacagaaacgtaaagctgaactatttcagccccgtatactgtaccaacattctctatatcggccgaaatttttattttttcattagcacttatatatctttcagataattttatgtttgaatatctaaaatccgtgtaactcaaaccgaacccaaacggataaaccggcgtaccgctgtaatattgatatgtacgccccggaaatcccgaacggctttgtatgttataatcattaaaatatcttgttataccgtcttctccctttaccccttctgtttcaatcggcataagttccaaatcttcagatttataccaagtggcagtaagcttacctgacggattaacctgccctgataatatttttcctagagcggttccctgagtttgaccgttgtatgaagtccagattattgcacgggcgtccttttcaaacggttcaacatttacttgcccgactgtttgcattgcgactatagttttttccggatacgctgatgttaaagcctgaacatgcgactggctcaaaggcaagtctatgctttttcggtcatacgattctgccgaatctgaaagattagtccctgcataagcgattataacatccgccgagtccagcttctccttatatttggttaccgagaattcctcctggtttgcctcaaaagataaatataaatcttccgttccgcaataccctccggacgttccggtatattcgcctatacagtctttaaacgaatttaagctgttagttttaacgctgacaacttcggccacctgcggtcctccatcgccataacataattttacctttcctcccgctaagtccccggttgatacctccgccttaacttttaaaacatcactgaaatctatatttttaaatacggcggtaccctttctagtaatatcttcaatcaaacttccattaagcgtaataccgcctgaaaccagggcagcagataaatctatctttcgttcttcgccgcttttaagtataaacgacaaccctcttatattcattaatttggtttcgtctgtagctccgccaagataatctacattaacatcaggcattaccctccttaattctgttacaataccattataaggagtgactgtttgttccggagaccctgaataatcacctaaaacaacttcgtcagccaaattccccaccagcgcagcatttttaattccattactcaaaggcaaaatattattatcattcttcaaaagcacccaggactgctccgccgcttcttccgcaacagccacatgttccgccgtttctaaaacgtccggtttgatttcgaaatattttactccggaatcaaactctcctgtccgcattctctgaaggaacaatctgtaaatatttatatccaactcgtcttcagtaatatatccattttttacagcgtccaaaacatttttttgaacgccggcattgccgcagtctgtatccgcgccgttcaaaaaccccttagttattgttgcatactgaggaacgttatttatatcttcatcagtaaacagagcttttttatacgccgccgtattgttcaagtctccaaaggctccgcagtcccctgtgacataaccgttaaacccccaatttttccttaataaatcaagtaatatgtacggatttgcagtagacggaatataatcaaaaatcttttctccgttcctgtatactgtagttgcattatatgaactcatgactgaagccggagcggctttttcaacaatatcctgaaaggctctgccgtaatattccctaagtgttttttcatccataaccgacgagcccactcgacgctccttttcacagttatttgcaataaagtgttttatagtggctatcgttttaagatatcttgtatcgtctccctgcattccattaacaaattctataccatactgagccgtcaaatatgggtcttcgccatacgtctcttcatttcttccccaacgcgggtctcttgccatattaatggttgggctccagtaagacaaatttgtctttggatttttgcctcttgcctccgttgccgttatatctgcagctttataaattaacttgcggttccaggtattagacatcgccaaacttgttggaaaactagtggcctttccctgtctcgcaactccgtgcagcccctcgcgccaatagttatattcgctgactccaagacgcggtataggttctgacatatttgatacttgcgcagctttttcttccaaagtcatcctagctactaaatccgctgcacgctcctcaaaagacaaacgtgaatcctgatacggaagtttatttttactccctgaaatatcaatttcattttcattcaaacttgaattagtttctgcactgtcatttaactttttttccattcttaacatatatctcttcctccgattttactcaaatatatctttatccgccgatagtatccgcaattccgtaaaagtaaccataaaatgtcacataacaaaactataacctatttataacttttgtcaagaataatttaacaataatacattctgttaaaattattaattaaactctacaaatattaaactgctgtatcactcaatatttaatgtaaatttcatgaaacttcagctgcttaaattattagttatttgataagcttgtttaaatttttatcaactcaaatttattaacatatctttttgcatgagacaatttatcgaccaagattttaactgtaaaaattatttaaaactctctgttaaatatagataaatattcggattgattctattttacttttttatcctgctaaaggacatgaaagattttctataaacaaattttgtattttacttgtattctaacataatataagatataataaaagccagtaaagataaaaaagtggtcaaaaaatgctgcttattatttggatatggaggaactgatatggtaccgttttatgaaatacagccttctgacttaacagtaattcataattaccgtgaaatccgttttcatgctcatctgcatgagtacattgaaattgcatatgtttttaaagaaggtcaacatatagatattgacggtatagaatatgaaatcaaatccggacaggccgctgttgtatttcccgatattgtgcattactattatcggaatgaagtcagacctgctgacgaggtgttggttatatgcagtcccaagctgtttaacggcatgttcccggatatgagttccgtacgccctaaaaatccgattattactgatgttgatgaaacaacaaaactggcgtttcagcagattgccgactgcacctccttccccgaaaagttgggttggtcgctgattataatgtcaggtattatgaaaaaaataagtttggaacacggcaagcatatacccgttgagagtcttacccaaaaaataatacaatatatgactataaattttaaacaggatatttctatcgagacattggcagatgagttttccgtcagtaaatattacatctcacatatcttttcagaccgtataaaaattagttttagaaactatctggcgctgctcagaacagaatatgcagcaagtctcatgaggacaaccgacgacagcattacaaacatttgcggctgtgccggtttcgccagccagcgaacctttaacagagcctttaaacaaatttatggtgtgacgccacgcgaatataaaaataatatcagcgaactttacaaagaataaaaaatacggattttccatcggaaatccgtatttttgataatctttaaatcttatcaaattactgatacataatattcggcatcaccgtattgattttgtgtgccgccggcaattttatatctcccagtaaacttccgtaagtaacggagttctctccatacatatctttgatatattcaatagaacgctctaagctttcccgctttaattccttatttatatcttcaaacatatttaattgaacatcaactttttcagacacaaggtttatagcccgaactgttacagccctaacgctttgtttccattcataatgctgtttaaaaagctcaaaagccttttcagcaagtccaaacgcactatatgacggctttggcatcttcatttgaaattcctgataatgcaggtctttgtctttaatggcgaccgcaatcccttccggcatcagcccttgttttctcagacgtcttgatacctttctgctcaattcaaatattactttccatacctctgtttcatcattcaaatcctcaacgcaggttataccgtttccaaccgactttaccggcggtatatactcatacggagctatttgagtcccccctctgccattggcaaaattccatagtttaacaccgtttatccccagccaatttcttaaatggtcaggatttgcgttggctatatcacctatagtacttactccgtgatgaagtaatttatccgcagttgccctacccactcccaacatttctgatgcaggcagaggccatactttatccttatacccctctctcgttatgcaagtgacggcgtcaggctttttcatatcagagccaagttttgcaaaaatcttactgaatgaaactcctatagatactgtcagacccaaagtctcctttatctcttctttaattttacaagctatttcataaccgtttccaaacaacagcgtgctgccggttacatcaagccagcactcatcaagaccaaacggttcaataaggtccgtatacttataatatatttcatgcgctaatttagaatatttcatgtaaagttcaaaatgcggttcaacaaccactaaattcggacacttttgtttggctttccaaatttgttcccccgtgctgacgcccatagattttgccttttcattttttgccaacactatgccatgtctatcgctctgcctgccgcacacagctacatatttatttcgcagattcggatttagcatacactcaaccgaagcataaaaattattcatatcactatgcaatatgattttctcattagttctgtctattttcatacctgcacttttcattaccgcatatcctcccatctgtaaaaaaccaaatacgcaactaattttcacatatacattatatgcaattataatgcacttgtcaataacaatattgcaattatatttcataatatttaacatatttcttaattataaaataactactacaatcaaattaactcaaacgtttgataattttaaacataaaaaacccgtcaagacaatgttgtcttgacgggttttaattgggaagaaatctataaataattttaattatttatcagttataaaggtcttaataatttgtcagataatcaaatcatagataaaaataatatatctgtctgcaaaacagaataaataattattatgttttaaattaatttacaggtgctgaattgaagctgtatgccaaagttagagcggcttaggcaaaaacagcttcattcagaagggtataatttaatcaacacctgaccaaatatataagtaaaacagtcataactcttatcaatccagacaagatatactgtttatatcaacattaataaacctttcttattattacataacatattttatcaaatactctgattaaatgatagtcaaaacaagtaaacttttagtcaaaaagtgttaatttcaattctttggctgttaattcttacatattcaaaatataaaaatcatcgatattatactttactctaaataaataaaagatgtccatacttgaagtgaaccccaaagtatagacacttttatcgtatcagaatctttgttctcaaataaccaaaaactatcctgtaagattaaacattgctttttaccttaaattaatcaactatgaactgcacttttacataactaaccgattttaatcagtatataaaaaaataatattatctatttctaagaaaagatttataaaaaacgacaataaaaattacgtacaaatatcagtacaaatattatattcgaagttaaacaggatattatagataaataaaaatataaataaagcagttacaaaaagttgtttttaaattgtatatcactcttaaatttatatcctctgtgattcatactttcaattttaattccaaccaaattactgtccgtatcaagagcgttggcagtttgattaacatcataattgtatatattaacaagttccaaaatctcatcatccgaaattagtaaatcagcagcaaacatattagcctcatattcaggtcttgccgtcatatcatacagcataaactcctgaagcgttctgttttccgccaggtctctatgaagcatgtcatgccctaattcatgagccaaaacaatcctcttcttttctcttgacaaattattatttaaaattataacacgcttacgtaaaattattgtataaataccgcacaattttgaaaaatctgaacttgttcttaccataattcctaaatacttggcaatctcaaatgggtcagaactaccggaagaccgaatcagctttttagttttcaaatagatatcctcagctgtcaagctattcaacctcctgtcctactatatttataaaaattattttatgtattttttaggtgtatattttttattttcatctttaacggaaaaatatgcgtccgaaatagccttcatagcagcgtccatatcctccctcggcaaacttccgccggcaaacaatccgcatacgccttttattagcccctcaacatctctcatagaacctgtgccgccttttttataagcgtcaaaaataatctcctcgtcctctgtcaacagataattcacatccacattcaaaacctcggctaacctataatacaaatcacgctgtttgggatgcatacccgatttctcataattctgaacagtacgcagagatacgccaatagcagccgccaattcaccctgactcattttattttttttacgcaggttcctcaccttttcgccaaatttcatattaatacctcctgcttaatgcaaatataattctcatatcatacataaaacgaataatatcttcatacaaataatactattttacaacaattttgtcaagcattatcaatagaaataatataatcttctatttttattttaaaccactatatattattttttataatttgtcatattaaactgatatactattattagtactaaacaaaataattaatttatattttgttatatactttatttcactatcaaatttgtaatataaaaaatactatatataaactttaaattaagtttgattataatattattaattctatagaattaaaactttgattaattgatatattagactacttattttagccaaaatgctaaacaacaaatacaaacttttaatataaattaaatttttacttacacacttaattcaaaatctcccatataaaattgatatgtaaagcaatagtgctgtttctaataatatctattgttggtttccataatattttttctttaaaataacttatttttcagcttacagcataactaaacaaatccttcaaaagacataattaaacaacttctgtcttaagttctgtcaataatattttaatgttctgtgataaaacaatctaataaaatattattgtatttttacttttcataacatcactaataatatttataaataaattttatataatatatttcctcaataaaacaaaccgactaaaattgagtaattttttaaattatataattaactaattacagccgaaaatagtacaggctaagctcaacctaatttaagactttatttcgcttgattacttatattgagctaagaagaaaaaagccgttcctatatagatgaattcaaataaaagtaggttcaactataacataacgtaaggcgaaaacgatatatcttacgttaagataatatccccacctcaccactgaataaatggcttaggcagcagcagtaacatgctccttctgtaaaaaagataaccattccgccgaggagcaggaattattagaactgcgtaaaggtaaccgattattggagactaaataaaaatggtaataaaaaaacatctgaactttataagttcagatgtctaaatggtgatcccgaggggaattgaacccctgttaccgccgtgaaagggcggtgtcttaacctcttgaccacgggaccaaatggctcctccagttggactcgaaccaacgaccctgcggttaacagccgcatgctctaccagctgagctatagaggaatatttaaaatccgcaaaagggcagaaaaaatctgctcttttgcaaaattgttttggcagcgtcttatgttcccgggcagtcacccgccaagtattttcagcgctgagaagcttaacttctgtgttcggtatgggtacaggtgtgaccttctcgctattgccaccaaatgcgactacactttttttaaaagtgtatgtaataaaactaaccagttttatcaaaccttaaatgtcaataaatcacttagttgtgatgtatttgcgactactgtgactacactttttctaaaagtgtatctgatgaaactaacttgtttaatcatgccttcaatgtcattaaatcactcagttgttatatactgtggctacacttttatttaaaagtgtatgttatacaaactatctagtgtcatataatccacaaatgccaataattaacttagttgtgatgtatattattaaactaatatattatgtttttcaattgaaaagagaaagtaagaagctttcttactcacaacatagttcataaaactctcgccttatacttcctatgtcttttaggtcaagccctcgacctattagtatcggtcagcttaatgtgttaccacacttacacctccgacctatcaaccacatagtctacgtggggtcttacttcttttaaagaatgggaaatcttatcttaggggggacttcacgcttagatgccttcagcgtttattccttccgtacttagctacccagccgtgcctttggcaagacaactggtacaccagtggtacgtccatcccggtcctctcgtactaaggacagctcccttcaaatttcctgcgcccgcgacagatagggaccgaactgtctcgcgacgttctgaacccagctcgcgtaccgctttaatgggcgaacagcccaacccttggaaccgactccagctccaggatgcgatgagccgacatcgaggtgccaaacctccccgtcgatatggactcttgggggagatcagcctgttatccccagggtagcttttatccgttgagcgacggcaattccactctcttaccgccggatcactaactccaactttcgttactgctcgacctgttcgtctcgcagttaggcttgcttttgcgtttgcactcttcgtacgatttctgaccgtactgagctaacctttgaacgcctccgttactctttaggaggcgaccgccccagtcaaactgtccaccagacattgtcccccgaccggtttcacggccgcaggttagaattccagtatcacaagagtggtatcccaacattgactccacacaaactggcgtctgtgcttctcagtctcccacctatcctgtacatgcaataccaaaatccaatatcaagttacagtaaagctccatggggtctttccgtctagtcgcgggtaaccggcatcttcaccggtactacaatttcaccgggtgtgttgttgagacagtgcccaaatcgttacgccattcgtgcgggtcagaacttacctgacaaggaatttcgctaccttaggaccgttatagttacggccgccgtttaccggggcttcaattcagaccttcgcttgcgctaagtcctcctcttaaccttccggcaccgggcaggcgtcagcccctatacttcatctttcgatttagcagagacctgtgtttttgctaaacagtcgcttgggcctattctctgcggcctgcgctagcaggcaccccttttcccgaagttacggggtcaatttgccgagttccttaacaacacttctcccgctggtcttaggattctctcctcacccacctgtgtcggtttacggtacgggcacctcatcaatccacacagcttttctcgtcagtgtacaatcatccacttcgctacttaattttcgctccctttcgccgcactcgaccatcggtgcggttggattatgttcctgcgtccctgtgcttaacaatttcggtggctacggaatttctaccgtatgtgcatcgactacgcctttcggcctcgccttagctcccggcttaccttgagcggacgaaccttcctcaagaaaccttaggttttcgaccattatgattctcacataattctcgctactcattccggcattctctcttctatctcgtccacatgtccttccggtcatgcttctccctataatagaatgctcccctaccaacttgcataactattagatcacacattccttttttccttacttcaatttcccgtctgcttcacagccggttttctttctctttctcatatgtgttctaatagttatgcaaattcccaagcttcggtataggttttagccccgttaaattttcggcgcctattcactcgactagtgagctattacgcactctttaaatgtatggctgcttctaagccaacgtcctagttgtctctgcaactagacatccttttccacttaaacctattttgggaccttagctgtgggtctgggctgtttccctttcgaccacgaaacttatctcccgtagtctgactcccggacatcatttttgcggcattctgagtttgatagggttcagtaagctatacgccccctagcccattcagtgctttacctccgctaaactaatccgaggctagccctaaagctatttcggggagaaccagctatatccgagttcgattggaatttctccgctacccacagctcatccccgcatttttcaacatacgtgggttcggtcctccaccagattttactctagcttcaacctgtccatgggtaggtcactcggtttcgggtcgtatacatgcaactctttcgccctattcagactcggtctccctgcggcttcgaaccttaagctcttaaccttgctacatacatacactcgccggaccgttctacaaaaagtacgccgtcacactttaacgtgctccgactgcttgtaagcacacggtttcaggttctctttcactcccctcccggggttcttttcacctttccctcacggtactgcttctctatcggtcattaggtagtatttaggcttggatagtggtctaccctgcttcccaccgggtttctcgtgtccggcagtactctggatcctgctcgctcttcgtcaatttcgtttacggggctcttaccctctttggcttgacttcccagtcaattctactatcaactctgaatgcgtttcgcagtcctcaaccccgatagtattactaccatcggtttggcctctttccctttcgctcgccgctactcagaaaatctcttttgatttctcttcctccgcctacttagatgtttcagttcagcgggtctccccacatatacctatttattcagtatatgctgacaaagtattgctttgccgggtttccccattcggaaatctgcggatctatagtcatttgcaccttcccgcagcttatcgcagcttgtcacgtccttcttcggctcctaatgccaaggcattctccatgtgctcttcttcgcttgacctcgtcgtcgttcccttcgcttatcgactttatgaattctcataaagtctcatcgcttcgggactcctcctctcaaattaaaagtaaacttttaatttgctttttaaagcccttctgctctttttgctctgttcacaactcttgtagtgaaatatttctatttcacggtcgctatttagttctccttagcgattaatctttcgattaattttaatcatgtgagtaagttttgttaatactttcttagaatagtttttttacagctcctatctctagtcgccgtattcccagttacccttgtatgaatctcttcatacgcgcgttctttctgaaaaaacctgatcttgtatctattttcataaatactcatcatttttccgtaatatatgacctgtatcatatactacgtcaaagtatctttcataattatttctaatcattactccttactcttctctttattcaattttcaaacatcttctcaacctatctgtgatattatggtgatataactataacacaatttatgagttttccgtattctttttttctatttgtaacacatctattgtaatcctacacttattaaagatttattccccattttgctattgctttttattgccaattatgatatactatttaggattattcttatgtaacaattattatattttttatcaaggaaaggagttgtgccgaaggcaaaaacctccgcgcacaaaaaaattatggacagttcttttggacttgttattattcttgtactacttattggctgctcggcttttttctctgccactgaaacagcctattcttctctgaaccgtatccgaatcaaaaatcttgcaaaagagggcaataaaaaagctcttttagtcgaacgtttatccctggattatgacaaacttttatctacaattctaataggaaataatattgttaatatactcgcgtcttctttggcgacagttcttttcgtccaatatttcggaaacgccggagttactatatccactattgttatgacaatactagtccttatatttggcgaaatatcaccaaaaagccttgcaaaagaacagcctgaaggctacgcgattgctgtttccaaaatagttgtgattctgcagtttattctaactccaataaattatttgtttggattgtggaaaaaacttcttggcaagctttttaaatcaaaaaacgacagcggtattaccgaggaagaacttttgactatagttgacgaagcccaaagcggcggtgaaattgacgctgatgaaagcgaccttataaaaagcgctattgaatttaacgatttggaagccggggatattttaaccccgcgtattgatgtgtgcgcgcttgaactaaatacgtcaactgaagagattattgaaacgtttttggaatccggattttcaagacttcctgtttaccgggatacaatagataatattataggtgttgttcatcaaaaagacctgtttcatctaatacaaaaaaacagcggcggaaatattgaagaaataatttcaccggttatatatgtttccccttctataagcatttccgaattaatcagggttctgcagaattcaaaaagtcattttgctgtagtaattgacgagtatggcggaacagacggaattcttaccttggaagatatacttgaagagcttgtaggagaaatatgggatgaacatgacaaggttgtagaaaacatttctgaactgtctgacgggatttatgaaatactcggaggtactgatttggatgacttccttaaactgatggacgaaaaacctggtgacgacgacccaaatactgtttcgggctgggttatggagaaactcgggaaaatgccggaactcggggacacttttgaatataacggacatcatatttatgtcatagaaatggaaaaccggcgtgtagctaagataaaagtgaaaatattgcaaaataaataatttttatgttgacggcgccgtgtttttatattaaaatagtctatggaaattgaattttatattataaatgtggaggtattataaatgtttaacaacatcccggaagttaagctgggtatcgttgcggtgagccgtgactgtttccctattgagcttagcaagaaaagacgtataaatgtggtaaaagcttgtgcggacaagaatattgacatatatgaagcacagactattgttgaaaatgaaacagacatgcttgaagctattgacgaagtaaataaggcaggagttaacgctcttgttgtatatctcggcaactttggtcctgagggtcctgaaacttatctttgcaagaattttgacggtccctgcatgtatgttgcagccgctgaagaaacacaggaagatttaatagacggcagaggcgacgcatactgtggagttcttaacgcttcctacaacttaggcctaaagaacttaaaagcatacatacctgaatatcctgttggtctgcctgatgaagttgcagatatgattgcggagtttgaaaatattgctcgtgccattattggtgtaaagagcttaaaaataattggatttggtccgcgtccttatgacttccttgcatgtaacgctccaattaaaccattgtttgaccttggtgttaatgttcaggaaaattctgaacttgatttactggcttcatttaatgaacatgaaggcgatcctaggatagaagctgttgctaaagaaatggcagacgaacttgggtcaggaaacaactatccttcactgcttactagacttgctcaatatgaaattaccttgctcgattgggctgaagctaacaaaggagcttctaaatatgttgcgtttgctaacaagtgctggcctgcattccaaactcagtttggattctgtccttgttacgttaattcccgtcttacatcaaaaggtattcctgttgcttgtgaaacagatatatatggagcattaactgaatttattattgcctgcacaaccggcatagctcctactttgcttgatattaacaactctgttccaaaagatatgtttgaagctaattcagataaattcagcaattatacattaaaggacacattcatgggcttccactgcggaaatactgcttgtgatttattgaccgattatgctttaaaatatcagttgatacaaaagagaaatctagagcctgaacttcctgagcctaatgtttcaagaggaacattagagggtaatattcgtcccggagacgtaactttattcagacttcaaagcacagccggcggtcagctcagaagctacattgccaatgctgagataatagacgttgacccgaaatcattcggaagcattgcagtatttgctgtaaatgagatgggtagattctaccgcaacgttttaatcaataaacagtatcctcatcacgcaggtatagcattcaagcacgccgctaaagacttgtttgaagtagtaaaatatttgggcgttactgatatagaatggaaccgtcctgcaggatgttattacgagggcgaaaacccatttgcttaaattattactgctttgtaattaaataattgctattgctatataattaaagactggattcgtgatagtaacgagtccagtcttatttttatttagtcaagatagtatcttaatatacattatataaaaaagccaaaagtcaccaataggtgacttttgacttataaacaatttaaaatataactaaactcttattctgctgtaagattaaacacagaacaataaggatttaaattttcgtcccatacaaacacttttgctccatcctgtaataatccgtcaaaagtaattgtttgttctgctccgccatctaacactgcggttttcgtcttagcatttttaataattttaccattcggttcatactgagcgacaaacacctgaacagacttcggttcatcagtattattctttaaagtaaccgacccggttccggcagcaattttctgatacccatttacaattacgtctcctgccggttttgtctctactgtcatatttgcaaaataaggctgagcacttctggcaatcagacgaatctgctttaaaccggaatcaattccgtctatagcgggcattgaagtatttactacttcctctcccgccgcatttttgattataactgtaataaaattatcagatgtgctttctttagtataatccaaagtgatgtcaatattgaaccaccctgcctgttcatttgaaaagtcatagacagcatttgcggctcccatagcaggacctacgcacaaagaaccatttgaggaatttaaaacctctgcaaacactccgcctaaactatttgaactatcctgataattctttgctttatcattttcaagatatattctgaatccatttttatcagacggactgagatacatatcagtattaaaagttactacatcagaatttttcacttcgctgagagctgtgtagatatttctgctgttaatttttacagccgttttaccttcatactcaatttgtacagcgtctccgtcagttccagctgcactaacctgaccaacattccaatcaggataatcggtgagacctgcgtcaggagtaggaaccggctcatctgtagcgcccgggtcaaaattcgactggttttcaagctttaaattactgaatttcgccattgagtaatatgcctgcggcgatgcgtcagactgtccctgctgtgaatcaatagcaaccccgacataaagtttgtttgccaaaccgcttattttcattgtatacggctgtctggcattatctttccagtcagttccgctgtccgaaactgagaacaaaagattatctccgcttctttgtattctcagatagtttggcaaatgatattttccgttttcagctgtatcataagggtgttcacccaaaatgttaccggaaactatctcgccttccttgcctctcataaatattcccattttattatcagtagaattggaattttcactatcgatggctatattggcgtttttagtagtgcgggcaacaatacggtcatttctgccatattttatccagccgtctaccaaagcagccattcttgaaccggcgtcaagagattcacggagcatcagtcccaaaactgctccattctcatttgccattatatcttccatttttaaagatatgtcaaagtcgcctgtaacctctttatacataaaatcaagcttatcggactttccgcctatcttaccgctgccgcccatagtataaatatctgtatcagcatcatatgaaactattccttttcccgaatatgcaggcggcccgatttgtttctgagtccagccctcaggcttgtttgtgcctgttacataaacaatcgaaatagtgcttctggtcttctcacctttatcattatgcgcaacgcatgacagataatgtgtgcctataccgagaggaagtgaatcatctattgaagaaactccgtcgtatgttttaatcaatgactcgtcatcgtaaagttccatttttgttatatttgttccgtcagcagcttttgcagacgctttataacttaatgtatccgtgtcttttataacagtccagtttcccttttgaacagtctgaccatcaacggtgctgtttatagaagcgataaccgggcttgtaacaactatttcaggatttgtcggagcctgagcgctttgctgctcagtccaatcatttacataagcttcaacccatgtatatcctgcccatacaccgcttgtcactatatcagcttcagcggcgccggctcccataccatttgcagctttccaatctgcagggatttcaaaggttctctgtgaactttcgatatcggagagtcctccgacctcctcttcattgttaataattcttccggtctgatttaaaacatcggcaataacacgagcgtcagttgcgtctctttttggaagagtagctccaacgtcaggcaaaagatttgacattacgtcttttccaggcaatatatttccttctgcaatattcaaatccggatacaaatcatcgcctaaagaaaatggcgtgtcaaccttttccacctggtcagccgcactgttggtgccgtcgttagaccagttattattagtaaccgttgagcttccaaccacatagttatcagtcatatagaatttgctcttataagtcactccgtcaataactttagccatctttgcaaaatcatatatacggtatctcttgcctgaaactgtactcggaccgtacttataataattatttgaataattaacctttgacggatttataaccttattatgcggtgaagtaggctcgccgccataggctgagttggttacgccccagttatagacaacgttatttctaaagtctgtattttgcagaactctgtcaagtctcggcgaacggctgtcgtgatgagcaaacaagttgcggtaatatgtggcgttggttcctccaataattgcgccataaccgtgtgcgcctttaaaatgccccgacattctcatactttcagatgtgatagtattttgaactgtcaaacgctttccctgctcatatgtatcagattcagccgaacctgcataaagggtcagcccctcatcaacacaccagcttgttgagcaatggtcaataataatatccgagttccattgaccgcctaagccgtcaacttcctgaccatttttattcgtcggtctaacgcgcatatatctaataataacatttttcacgccattgcctatacgcaaatcgccgcctgtaagtgtgattccatcaccaggggctgtctgacccaggatagttatgttatcgttattgatataaacggtactaggaacgtctataactccgcccacatcaaacacaacaattcttcctgactggcttattgcgtcagtaaacgaacctggaccctcgctgtttaaatttgtaacatgataaacctctaatttaccttcaccgctatccaatacgccgcgtgcgccttttgtaaacttaccgccgccctctgctccgggaaaggctggcaaagcgttaccctgcagttccgcattatccgcaaaaacggacacactgacgaaacaaacagacagaaccatacagattgctactgcaaatgataatatccttttcataaaaattctccttgctccaaaaatttaagaacttaatattataccgtcaactgttattcccctctataaaaacagcacctccaatataatttgtatgccggtacaattaaaatcatatagatatattaccataaacaaatgtttttttcaacaagaattattgctattttacatagataaatgactatttttaagctaaaaggttaattattggcaatataacagtatgttgcgcaattaatctgtataatatttccgtatattaaaataaaataatgtcatccattgacataatattttgatatgaaaacataagggatttataaatattgcctgggtcaggcttgattggaattataaataaatagaattttgaaatatataatgtatgcttttgtgctctaatatacatcatctattgaccgagatttacatatatatctcttatttaagacactaattatgattcataaaattattgattttgcgccattctctattacaagtttatatcaaactcaaatttttataacaaatatactctatttatcgacaattgttaattaaaatattatttattatactatgtatataaccccatataatatttatattttacttattgaaaaaactgagttttccttttaaattaatatataaaaatgtggttttcagtgaacttcggtaggcttgtgttaacaagcgcgttaggtgagctatcatctgaacacgcagtgttcattatataaagaaaacattcattaaaatcaactttgtatatgaccccatataatatttattattttacttataataggtatttgaaacatttctttttctcgtaagaaaaagaaacgcttcaccaaagaaaaagtactgctcgcttaggtcgcctacggctccaatgggcgctcgcccacgctcatttcaccatgaagcatggcttcatgatgaaaaaagccctactactttcccgttgactttgtgtgctaccgtgaaaaaagatttttcgagttcatattaatttaatgcataaaaagcagagtttttagcgaacatcggtagggcaaacatagtttgccgcgttaggtgagctatcatctgaacacgcagtgttcaatatattaattacctgtttttataacagtataaaatatagtttttattcagcatcatatttttgctctttatttacaaattcattttgtatttttagaagttctttgataatacacaataaatgttgttgagtctctgttgttaacttgctgaatattttaacaaactcttgttcatatggagaagaaataaacatctctccttctcctgtgcgcaaccacgtttcattgacattatatgccagacaaataactttgatatgtctgtttgataaaggatttattccattttcaatcattgaatacgccgtttgagttatccctatttgtttcgcaaagtttgtttgattcattttaagagatttacgtaattctttaagacgttctgacattttatcacctcgttttatttttatatattatcatattttaaataaactatcaataaataatattatttttttaataaaacacactaaatttttatcaaattataatattaccacaaattgatattcagattataaagtaaatttatattgaagaaacaactaatattttcagacaattatcaattgaaaatcaaaaacatattttatatttttaaaaatattaaaaaataatgaaaaaaattagaaaatgaatcaaatatacatcaaattattatgaataaattttataatatatataatatataggaaagggaatataaatgtttgaagattttgtaagaaaaagaataacagaattgcgaatgagaaaaaacatatcagaaagatgtatgagtttagatatgggacgttcggaaggatatataaatcatatatcatcaggaaaagcaatgccgtccatgagcgaatttttcgaaatatgcagatattttggaataacgccatatgaattttttaatgaaaatatgaagtatcctgaaaaaatacataaaataataaaaggaataaataaactaaatgaaaaagatacagaactgataattaatcttatagaaagctataaagaaaataataaaagatattaacaattccgctactgcgcacctcacgcgcttgctatcgcaagcctaccgatgttcactgaaaaaccttcttttttagtaaattaaataaatagaaactcagaatatctattttcacggtagtacacaaagtcaacgggaaagtagtagggcttttttcatcatgaagccatgcttcatgatgaaatgagcggggtgcgagcgccccttggagccgcaggcgacctaagcgagcagcactttttctttggtgaagcgtttctttttctcgcaagaaaaagaaatggttcaaacaccctattatgtaataataaattttttatatggggtcatatacatagtatataattttattattttaaaaattaataaatataaaaacattataatatacacgcaaaacaaaataaaatttttattataaaaaactcaattatacagtatatataactttccactttaattaaattattataatatagccatattaataaaaacaataatccaacaaaaatgcccttctgaattcagaagggcatttttataataattaaaatctcccgcgctctttgtacgtcgtgtgcagcagctcatgcgcaagatgtgaacccggtttttcaaaaaagtcctcatacagcaatgtcatatcaggattttcatggctctttctaatcttgctgtctctgtcttccgaatataacgcttttgcgcgctccgttctgacatcaatatccattttcagtctcgacggaactataggctgtcctccgccatttacacagccgcccggacaggccattatctcaataaagtgataatccgccttgccttcacgaatattgtttaaaagctttctagcgtttcctaagccatgagcaacagcaaccttaacatcaataccgcccatatttactgtggcctcttttattccttcaacgcctcttacgtcattatattcaatctcttcaacagattttccgcctaacgtatctgccgccgttctcagcgccgcttccataactccgccggttgcgccgaatataactccggctccgctggcacgttcaaacggaacatcaaattcctcatcaggcagtctgtcaaacattataccagcctgctttatcattctcgcaagctctcgagttgaaataaccgcatcaacatctctaagtccgtcagactccatctcaggacgtcctgcttcaaactttttagccacacaaggcattactgatacaacgaaaatctttttagggtctatattgtttttctttgcgtaataagattttataactgcgccgaacatctcatgcggtgatttgcatgatgataaattatccaaaaagtccgggaagttatgctcacaaaactttatccagccgggactgcacgatgttatcatcggcagctttcctccgttttgtatgcgctctaaaagctcgtttgcctcttccattattgtcaagtccgcacctgtatcggtatcaaacgtcttgtcaaatcccaaacgccttagtgcggctgccatttttcctgtcaccggagttcctatcgggaatccgaactcttcgccgagaccggctctcacagccggagctgtctgaacaacaacatatttgtcatcgtccgcaattgcgtcccatatttcttgtgtattatctttctctctcaaagccccggttggacatgacactatacactgaccgcagtttacacaggccgtatctgacagcgccttttcaaaagctgtgccaaccctggtattaaatccacgctgcatggtgtcaataactgcaacagtctgtacgtctttgcacatattaacacagcggcggcatagaatacatttattattatccctcacaattgacggtgacacgtcgtctatttcaaaactgttcatatcgccttcaaactctattgaatctactcccagctcctctgacaacgactgcagttcacagcttttgttccttatacagctgagacattttttctcgtgagttgacaacaaaagttcaagtgtgacgcgcctttggtctctgacctttttagtgtttgtcataacctcaagcccttccgacaccggataaacacatgccgcctgaagagccctcgcacctttaatctcaacaatacacattctgcaagaaccggttttgctgatgtctttcaaatagcacagggtaggtatatcaatgccattttcacgtgccgcttcaagaaccgtatagtcggcaggaacagatagttctattccgttaatttttatatttacattatctgccatttctatctcctcctatttggttattgccttaaagggacacttctcaagacaagcgccgcacttaatgcatttttcactgtcgattttaaaaggatttttaacctgtcccgaaattgctcccaccgggcactgtctagcgcaaagcccgcagcccttacacttttcagggtcaatttcatatttagcaagccccttacagacatgcgcggggcaagtcttatcaataatatgcgcctcatactcgtctctgaaatacttcaaagttgaaagcaccggatttggcgctgtctgtccgagaccgcacagcgagccggctttaatagcttcagccaggctttcaagacgatctaaatcttccattgttccgttgccgtctgtaatcttagtcaaaatttcaagcagtctcttggttccgacacggcacggagtacatttaccgcaggattcgtcaactgtaaactcaaggaaaaacttagctatatcaaccatacagttgtcctcatccataacgataagtccgcccgatcccatcattgaaccaatagctatcagagaatcatagtcgattggagtatcaatcaattctgccggaatacatccgccggatggtccgccggtctgtgccgccttgaatttcttaccgtttggaattccaccgccaatatcttcaacaatttcacgcagtgttgtgcccataggcacctcaaccaatcctgtattattgatttttccgcctagagcaaacacttttgtgcccttactcttttcggtaccaatttttgagaaccagtctgcgccttttaatataattctcggtatattagcgtacgtctcaacattgttaagtatagtaggctttccgaacaaacctttaacggccgggaacggaggacggggacgcggctcgcctcgatgaccctcgattgaagtcatcagagcagtttcctcaccgcagacaaaagctccggcgcccaatctaatttctatatcaaaatcaaatccgctgtcaaatatattctttccaagcagcccatattcacgggcttgttttatagctatattaagtctctgaaccgcaatcgggtattcggctctgatatatatgtatccctggtttgagcctatcgcatagccggctatagccatagcctccaaaaccgcatggggatctccctccaaaacgcttctgtccataaatgcacccgggtcgccttcgtcggcattacaacagacatatttctgctcatttaccgagttagccgcaaactgccacttcagcccggttggaaatccgccgccgcctctgccgcgcagtccggaatcttttatagtatctataacttcctgaggcttcatctcggtaagcgctttacccaaagcttcgtatccgtctcttgctatatattcatcaatattttcaggattgataacaccacagtttctcaaagttatacggtgctgttttttataaaaatcaacttcattcagcgactttatttcgtcagtgccctcatgtacagactcatcatacaaaagtctttgcactattctaccttttaagagatgctcttcaacaatctcttttacatcttccttttttaccatgctgtaaaatgcgccttcaggatagacaataactatcggtcccagcgcacacagaccaaaacatcctgtcttaacaacttttacctcatcatataagccgttttctttcagctgtttttcaaactcgtctattagcagtgcactgcctgaagaagtacagccggtacctccgcagacaagcacttgcgatctatatatgttcattggttatttacctccagtctgtgccgcaccaatagtatattccatgaccggcctgccgtttactatatgttctgtcactaccttagccaccttatccggcgtcattttaacatatgtgaccttctcctcgccgggtttaaatatttcaacaatcggctcaagtctgcacataccgatacatcccgtttgggtaacggtaacgccgcttaatccgcgcttgtttatttcctgcaaaaattcattcagcaccggtctagctcctgctgcgattccgcaggttgccataccaataacaatcctggtatcattatcattgtcattacgcatatccatctggttttgaaccctgtcacggattgctttcaattcttccaaactcttcattttttgacctcctactgtcaataaatctatatatggaatttattatttactaatttgtttgtcttctcttatctttccgagaccctctgtaatataatccattatccaagacagaacctctgttgaatccagtggaacatcgcctaaaatttcttttatttcctgggtgtcaaacacaaactccgaatcatttaccctatgtatataaataaaattaatctccggattaacagacactaaagtaaccattgttcctgccatatcgccgacaggcgctctgtcgatatgattatactgaaatctggcagtgacacaggtgccaacgccctcgtcggaagtaatctcaaggcttccccccgcctgctgtgcggcgagttcaaaaagaggtattcccataccaaccctgcgtgttgttcttgtcgttgtaaacgggtctctgacacggcttaaaaattcaggactcattccgcatccgttatcagacacaacaatcgtcagtttatcatcatcaatattttcatcaataattatttcaatcaatgtcgcttccgcttttactgaattctgaacaatatccaaaatattaagagatagttctttcaatcagctcaccaccaatcaattatttatcaaatagttctatttattaaacagttcatcaacactgttaagttcaagaaaatttttctgtcccggcatactctcaagatagtgagcgtccgagtttctaagtattttatactttttcaagtcaggacgcatgcgcagataagcttccaaatcctcaacgttctttgaaacttctatccacttcacaggtatgtcttccgggataaatcccaggttagacagcacgctgtatgaatccctgtcgacatgggccggcgaaaacaatccgcccgcttcactaactatataaaaaagttcgcttatagatatggaagccgacgatatgagcagttttttctcatagtcaataatattgtcgttttcatccatataagcctgaattccaaaaatctccggcttattttctatatccggaagccggctgtatacaaaattcgaaacttcactagcacgctccatattcggatacagagtaagcacatgaacaccctcggaagtttccacctccatacccggaacaacagatacgcctatattttttcctgccttcataacagcttcagcatttccaatagtgttatggtcagttagagctatggcgtcaatctctaaaagcttagccatattaactatattacccggagtcatatccatactgccgcagggcgacaatgccgaatgaatatgaaaatcatagctaaacatttttactgcttaatttataataatcaacagccgcttcataactcgtttttgctgtcttcaaaataacaacgttttgggaattggccttatctataattccgctttcaacatccacatcctcggcaagaacaatacatgaagcgtctgacaatgtggcaacagcaacaatgtttatattgctcataacggtaatccacatatctccgctgttagctctgcccattacccagctcagcaaatcaccaatataacagccagtaatttctttatcctcatagtcaggattggttaaaacttcatactcgccaaatttaactaaatctgatattttcatagagttactcctcctcttcacggttatctttatctgacgccaaaagctcagtagcaagttcctgaaccttagctttcatatttactatacaaaaactctcatcggcaaaacctctcactatatcctcggccaaagctttacaggacggagcgccacatgatccgcagtccagctgaggcagagaatcatatatttcctcaagctcatccatcatttccatagccttgtcaaaatcatcatccagttccataaccggctcatactccagcttttttgaacatgacagagaacccaaatctatatcttttgtttcgcatggtctgttgtgtaaagtttttgatatattctttatatgatttttagctacatagctattgacaacattcaaaacgccgcccacacatccgccgagacaagccgacagttcaataaagtcaataccggaaaccttatcgtcttcgatttcctcaagtattttaataacattttcaattccgtcaacagctatataattctctatagccgcgccgtccgcttcccctccgcttctggaccaatatactccgctcagggaagatttcataagagcttttggctcctttatatctcctataatcggaaaaagctttgcaaacacatcattgactgatattgccccgcttatttcagatttatccaaagtcaacggagattttatactggtcattttggctggacatggggttataaaaaacaccccaatttcttcatttttaagtccggtcttttggacggcttctttccttgctaaacggccggcagtttccattggtgaaataaggtcaataatgctgtcaatcagattagggaatctgaccctgataagccttataacagccggacacgcactgcttatgaatggctttgaaccgcttcgttttttatatatctcttttgtcgccgcgcttatatactcggctcccctggcaacctcaaaaacatcgtcaaatcctatttttaaaaggccggtgagtataacgtttatatcgcttacatcgctgaactgtccgtataaagaaggcgcaggcaaggcgatattatatttataatttttcagttcctcaaaatcatctgttaccgcccgttttgcatggtatgggcaaaccctaatacattcgccgcagtcgatacagcggccttttattatcttggcttttccgcctctgactctgatagcttcagtagggcagcgctttatacaatttgtacagcccctgcacttatctttatcaagtgtgacggaatgaaagtatgacataccctcacctcatatatttataataagttctaccgttgtacctaccccaacttttgaatctatattcatgccgtccgtatatttttttatattaggaagccccattccggcgccgaaacccatttcacgaatttggtcgctggcggttgaatacccttcctgcatggctaaatctatatctttaattccggggccatggtctctgaaagtaatcgtaattctgtcctttgacacctcggcgtcgcatattccgccgccgccgtgtattattgtatttatttcagcttcatacattgctatggcaactcggcgtataacctcaggcgctatacccagcttcttaagataacttttaaaattgctggaagcttcccctgctatcgaaaaatcatggccgtctacatcataatgtttctgcatctttcctgccctccaaaccctttctgtaaagtctgccgcatgcggtatacataggcagctttgtgcttagaaggactattccctgctctttcgcaagctcaataagactttcgggcggagtttttcctctaacaaaacatatagctatgatatccatcatctctgcagttctaacgacctgtggattaacaagcccggtaagcaagagactttggtctttaacaaaagccaacacgtcgctcatcaagtcactgccgcaagcgttatgtatatcaaccgctccaaggctttcatcattttctccggtcaagacctgagcatttatttccgctttaacatcagataatagcataagccacccctttatacttggttataaacagagttcaaaaatttgaacaaatatattaacttaatgcacaactcacaactcataattcatatataaaaatgaattataaattataaattatgcattaacttttattctactgatactgttttaatatatcctcaacctggtcggcggtcaatctgccgtgaacatcgtcaccaatagtaataacaggagctaaaccgcacgctcctatacacctggtagcgtccaatgagaacttgccgtcagctgtgcattctccaacatctatgcctaatatttccttcattttatcaagtatttctccgctgcccttgacataacaggctgttccaagacagactcctataggataaacccctttaggattaagagaaaattgggtataaaaagtaacgattccatatatttctgcaagaggcacgtcaagaccctcagaaatcatttcctgaacctcaataggaagatagccatatatctcctgggcttcgtgaagcaccggaatagtggcacctttctctcccttatgagattcaatcaccgctttcagctgttcctcttgttcctttgttcccttaaatggtatagccattttatgagacctcccgtatgtaatatttactgtatttcctatatttagaatggtctgaaaaccacattcacaacatagcccagactttataagtgtatcacaaaaaattaccttttgcaacactgatttttaattatatgttatatatttaacacattactttttataaattaaaataatatatatacctttaatacaaataatataactaaaatataattaaggttgacaagcttttgccttgatgttaaaataatctcacatgatgtattatgaaatggagaaagcaaaatggaaacaagatataaatcacatttatacgtatatttaataatctgcggagcattgtacgtagtcttttctactctcagaagcggcggagatttacaaggatggtttaaaggcgtttatttctttttatcattaatggtaatggtgtttgcatattttgacatcgcaaaaaaaggggataaatacataaagacttatcatcacgacctatatgacagatattataacgttcttgtcaccggaaagaaagaagttaaacgtcctattttcattggtcttcaaactttatttaatacggattatgaaaacgacccaaacttaaaggcaatacgaaaagaagctaaattatatatctgtgctttgataataatatttatactaacgttaatgaatgttgcactgtaacaaaaaatattattgaatctgttattatattaaaaaatataataaattaaaaagaaccaaacagaatataaaaagactataatcagattgtcatacagcacaataaaatatataaataataaaaaaccattgtatttagacaataaaagtctttttacaatggtttttattgtttttcttaaaaatgactttttacagtccttttagagtttccaaaacttatttcttattcgtactctaccacgttaacccatctgtctaaaaattccttttcttcaggcttgccctttacagactgcgatgccgcaacaacaggcatccatttctgaacatactgttttgccgtgtcgctctttttgcagaacaaatcaagatatttgtcagcaagctcctccttgccgtctaaacaaaacagcaaatatgttcttgcaacatcagcgctggcgtttccttgtgtagcgtgtgaccagtcaagaatatatggggttccgttatcggtgacaataatattgctcgggttaaaatcaccatggcaaagctttgtatgctttggcatactctcaaggcgggtgtgcagctcatatctcgtagtagcgtcgtacccggactcgcttatttttctgttcatcttatcttttaacttgttcaaaagaggaacagtctccttattcatttccagctgcaaatcaacaaataagttaagatattcatcaagtttctcaggattctcatccattaactgagcaagcgtttttccttcaataaattttgtggaaataacccactgtccgtcaatcattgtaacctggttcagtgcaggtatatttaatccagtttcctcaactctagcctgattcaacgcttcgttcaatatatctgctttagaataattggaattaaaaacttttaaagcattttcgccgtctttataaataaccttatcgggtctctcggcaagaattttttcgtacttcataattgtttgctcctttcagaatcaacgtgacctattgttaacaatatcaaataatgggttttgccctttatccaatgtatcagcggcggtttgcggcgctgaaaatttaagcggatcccgccaacagcagggtactcttaaattaattcaataaggggtattgccccgttattcaatgtttcagcgtcgaaaattcgccactgaaaatttaaacggatcccgccaacggcgggattctcttaaattaattataacaaaccaacaacggttaatcaatatttatttgccgtagtaagcccttaaatacatctctttaatttctttcataagcggatatctcggatttgctccagtgcactggtcatcgaatgcctgctctaccatttcgtcaagcgtatccaaaaatactttttcgtccactccataatcttttattgtcttcttgattcctattttctctttcagttcatttatgcctttgataagattctcaagtttttcttcatcagtctttccgccaaatcccagataatcagcaacttctgcatatcttgccaaagtatgagggtggtcatactgcgagaacgttcccatctttgtaggaacttcactagcattaaatctcataatctcttcaagcatcaacgcatttgcaacaccgtgcggtagatgatggaaggctccaagcttatgcgccatagagtggcaaatacctaagaaagcattagcgaacgccatacctgccatagtagcggcatttcccattttttcacgcgctaccgggtcatttggaccattatcataggctctcggcaaatattcaaatatcattttaagactgcgcagagccaaaccgtcagtataatcagtcgccataaccgaagcataagcttcaagtgcatgtgaaacagcgtcaatacctgacgcgctcgttaaacctttgggcgcattcatcatcatatcagcgtcaacaatagccatattcggcataagctcgtaatcagcaagcggatacttaacaccgctgtcgccgtcggttattactgcaaaaggagtaacttcacttccggtaccggcagatgtcggaactgctacaaacatagccttttctcccattttcgggaatgtgtacacacgcttgcgaatatctataaatctcattgccatatccataaagtcagcctcaggatgttcatacagaacccacataattttaccggcgtccattgcgcttccgcctccgattgctataatacaatcaggctcaaacgccgtcatagctttggcgccgtcgatagcgcaggcaagggtcgggtcaggcgctacatctgaaaatacgctgtatttaatccccatttcatccaacttgtttgtaaccgggtcggtataaccattgctgtacagaaaactgtcagtaacaataaacgcctttttcttacccataacgcctaactcttcaagagctaccggcagacagcctttcttaaagtaaaccttctcaggagccctgaaccaaagcatattctctctcctctcagcaacagtttttatattaataagatgcttaactcctacattttcggacacagagttgcctccccatgaaccgcatcccaacgttagtgacgggtttaaatcaaagttatacaggtctcctatacctccgtgagatgacggggtattaaccaatatacggcaggttttcatagcggcctggaacttgttgagtttatctttttcagtaaccgcattcagataaacgcttgaggtgtgtccatatccgccgtcagcaattaaatgctccgccttttctatcgcttcatcaaaatctttcgctttatacattgcaagaacaggagacaatttttcgtgtgcaaactcttcgctgagttcaacactgctgacctcaccaattaatatcttagcagtttcaggaacgtcaactcctgaaagtttcgctattgtataagcagactgaccaacaatctttgagttaagcgctccatttatcaaaatggtctttctaaccttgtcaatctcattctttttaaggaaataacatcctctgtcggcaaactcttttttaacctttgaatatacggaatcaagcacgataaccgactgctcagaagcacaaatcataccattgtcaaaagtttttgaatgaattattgaacttactgccaaaagaatgtcagcagtatcatctataattgcaggcgtgtttccggctccgacaccaagcgccggctttcctgatgaatatgcagccttaaccattccgggaccaccggttgccaaaatagtatcagcttctcccataagcatatttgtgagctcaagcgacggaacatctatccatgaaataatatttttaggtgcacccgcttttacagcggcttcatatacaattctcgccgcgtcaatagtacattgctttgctctgggatgagggcttatgataataccgtttcttgtctttaaagaaatcaaagtcttaaaaatagctgttgaagtcgggttagtagtcggtattactgcagctattacgcctatcggttcagctattctctttgtaccataagcggaatcttcttctataacaccgcatgtttttgtgttcttgtatttattgtaaatatactcggctgcatagttgttttttattactttatcctcaactactcccattccggtttctgcaaccgcctgctttgcaagcggcagtctttgtttattggcggctatagcagcagccttaaatatttcatcaacctgtttctgtgagaacttcgcaaactcctgctgagctttccttaccttttttatttcctgctcaagttcctgaactgtacttaccataagttcttactcctctcagatatataaattaattaattttcttagtgaagcctaaattaggcctaataacaattatatccataatatgctaatcataaatcacttttctgtaaatattataaaaacttaacttttactataaataattaatgagattcacagactaaagtgttttgcttttattctttattacggaataaattgttaaatatttatcaatctctttacaatacacattatacacacttgttaaatatttgtcaatccaatttaaaaaacatttttcacaaaaaataattatgacaaatcagccgctttgttaaacttttatctaacttattgtttagataaactatcttataaattctgaaatttaacaatagatgacatatgtttttatgatatagaagttaactataattaaaataattcccgttaccactcatctttcacgacacttatcaatttcttttaaatacgcagtgcgaaagcagtttgctgcgtaaagtactcaatatcggaaaaatttattagtaaaaatatttataacaaatagttttaaatattttcacgctaagcgtgatatgatagctcacctaacgaggtgtgcttacgcacaccctgccgatgttcactaaaaacaccttctgatactaatctttcgttttaaatttaatataattaaaaaagtattgtatttatacaagcattgtcagatcaaaattgtttgtcgcagttgaaatgtaaacaattttttctaaataaaactttataaaacatttactgccgctccttgctataatcggaatgataaaatcttcagataaattatataaaaattttaaaaatctttctctattgatattagtaaatattttgtaatattaaaactaaaaatatggattgaaaaaaatatcaaaaagcgatataatatataatgtattaatgtggcaatttaaacatatataggagataaattatgctttcgaaaaaaataatctggaaattaaatataatagatatcttgctgcttgcaatcattattctcagcgtcgctgctcttatatacaaatcagcttggggcaggggaaacaataaatatgaaacctacactattacctatgtatgtgaaagctcgccaatcgacctgttaaacaaagttgaatacggcgacatttgcattgacggaagctatggtaatgaaataggtgtgcttgataatataaatcttactccaataactgaaaattattccgttgccgcaatatcaaacgggaacgctgaaaataatgaaaacgatgatgaagaccagccgtctcccacaccttttccaacgcctgagcctgttcgggctaaagcagaatttgttacaacggttgaaggtatgaagacagaccacggtataaaaattgataaaaacatttatttgatgggtcaatctgctcaaatcattattggtgacgtaatttttgatgtctatatcagcgatattcgttaatgagatttttggaggatataaatgtgagacaagagataatagacatatataaaaacagttttttatatgagataattatgtggatcacaaatattctgattccgcgtctgaaatacgattttattcatagtaagactttagcaattataacttggtttgaaaaaaaaattatgaataataagtatcttgaaatattttttaatactaaagttgtcggcgaagcctggtatgcaagtgcgttttacagatataccacaataggcatacgccggtttgctttttatattccccgttcaaggcttaagtttcatcctatatatataggtgtgtttctgctgtttgtgcttttattcccatcatctctatgggataatttttatatggttccggctttcatgctcgtatcgctaatttatatttctcataactccactcagcgcacaggcgttatatttattctgataaacataattatattcatgtttatagctatgatgagcatgtcaataccgattgcggcttgcaaatccctttcatactttttattggctgttgatttattttttctgatatcattcacagtcagaactcaggatgatttagaattaattttaatgtctcttttcctggcaatggtcgttttgtgtataaccgggatagttcaggcttatcatgccgacaatccgagcatagctatacaaggcgtttacggggattcgacaatttttgctgagatattggtactgctttttcctttcgcatttgtttatcccataactttagaatctaaaatcagacggtttatatattcaatactggttatgggagtatctttttgggttatctcggccacacagtctaaagccgcgttcattgcttattttattgagcttgttatcgtaatcattttgactgacagacgttatataccaatgattctgtttttggcgccgttcttttcagggcgcgtactcaacaacattatattaatgtggcaaaacggcagcaataacggaaatattattgaaaacattgtctatactttgagaaatttctggacaaatggatttggagtgagcacagacaactttgtcaacatctataattccacagctcagcattacggggaaggcggcactttgataaacatacccaaccttcacatcagcgctgtgtactttaacattctcatagatgtcggcgctgtatttatgattggatttatgtattatattttaagaattgcacactcttccataacatgtatgttcagagccacaccgcgccaaaaaattatatttgccgccggacttgccgcgctgcttggaatttctatttcttcactgctggattctaacttgtttgaacctcgtattcttataatgtattgggctatgctggggcttcttcgctccggaagaattataaaacttggggtattagactaaaaaccgacaaaatttctaattatgtattgacgaaacaagttatttttattataataaaacatacgtaggcaaggagggttaacgaatgaaaacagaaaagcttttcataacagctttgcagaaagttagttttaaagcatttgcgattgctgcctatattttattgtttatctcacagcgcttgccgatgtttggaataaattcgattgaactgaatgatgtaactgaagggttcagcatttcatcaatcgcttttggtatggtttcaaagttttttgacttttttggtgtgactactccgcctgaaatacagcttttgatgataggctgtatagtgctcctcgtttttggtcttgctgctcttataatgtctttatttggatttagacttattcaggttataaacttttgtgtatcggccgttggaacacttttgagcataggattttctgtattggttacacttggtatttcaagcataaattcatctgaaattggtgaaattttagagtttcaaccatatgcgtcaatttggctgccaccgatatttttcttaatcggaacgctgtttacatatgcttttgccaaaatgcctgactacgctttggctgaaggaagatttttcagaactatcggcgccgctctgaatcctaaatactttttgagaacttttaaaaaggatgataacacagaagcattattccgtgccagaactcctttaaaaaagaaaaagtatgttactgtctcggagccaaaaatcttgaaaaaagctaaaaaagctgaaaaagccgtaaagaaaaaaaagagaaagaaaaaaactgagcctgttacgataacaccgccggcaaaaaagctaacagctttagagcttgctttagccaaacgagaacatgctgaagcgcttgcaaatatgcaggcggatgaggagaacaaggcgttattttcaaaaagaaatgctgctccagattataacaaaacatattcaagtaaaaatcaaattcaaaacagaaagcaagttaaaaataaaagagcgctggaactggcaaagttaaaagcctcccacgctgaagagattgcaagcagaaacgaagatttattttaatcaaaagcaccgaactatatatgttccggtgcttttaatttatatattcaattcaaaattattatatctatattttaatttctaaaaagatacgtaaaaagtttaagtcagacaataataacaccttcatcttaagtgtattatatacactaattttcttatattactactaaaatatctgtaacccaaacacaaaaaatattatatatattttaatggacactttgtactttagattggaaatgcagtacagtagatttttttaggtttttattacccttttcatttttatattaacgctgttcatgttataacatatcataaaaaaatatctaactcgttttaaaaatattatttcgtcttcaaaatattaaccttaaagatataatacaataaactaaattgtaaaatacacattccagtattgtccgcaaacatttgaaaatctataataaattaaacggctttttatctaatttaattcaaatttcggaggcttaaaaaacctctttacagcccttgacacatcctttaaattagtatacaatattaaggttaattatcgaaaaaattaatgagtatataattttgttaagaattaatttattatagaattggagggatttaaatgtatcgcaaagtatcaaccgacctttcctttgttgacagagagaaggaaatcgttgacttttggaagaaaaacgatatatttaaaaagagtataaagaatcgcgagggagccgaaatctttactttttttgacggaccgcctaccgctaacggaaagcctcacataggtcatgttcttactcgtgcaattaaggatttgattccaaggtaccgcacgatgaagggatacttgattgagagaaaagccggctgggatacccatggtctgcctgttgaactcgaggttgagaaaagccttggcatcagcggcaaacctcaaatagaaaattacggcgttgaagactttatcaaaaagtgtaaagacagcgtctttgtttaccaaagcgattgggaagaaatgagtgaccgcgttggcttttgggccgatatggacaacccatatgtaacataccacaatgattatattgagtcggtttggtgggctctcagacaaatttgggataagggacttctctataaaggtcataaaatcatgccttattgtcctcgctgcggaaccgctctgtccagccatgaagttgcacagggatataaagacgttaaagaaaattctattatagtaaaatttcagattaaagatgctccgaaaggcgagtatattctcgcatggactaccacgccatggacccttccctcaaatgttgccctatgcgtgaatccgtcagagaaatatgttaaaatcgaatgcggagatgaaaagtatattttggcaaaagccttgcttgaaaaggttctgcctaaggactgcgaatataaaattttagaagaatatattggtacagacctgtgcggtatgcattatgaaccattgtttgattttgcaaagcctgagggagacggatatagggttgttgcggataattatgttacaatggaagacggtaccggtatagtacatacggcgccggcttttggtgaagatgataaccgagttggagttgaaaacaaccttccttttataaatcttgttgacagtcagggtaagtttgttgacggcacaggagaccttagcgggctttttgttaaggatgcggataagcttataattcgtaatctgaaagacagaaacttggctttctcagtaattccttttgaacacagctatccgttctgctggagatgtgatacccctcttctgtattacgcttgcgacacatggtttataaaaatgactgccgtacgcgatagacttctcgctaataacgagaccgtaaactggatgcctgacaatattaaacacggacgttttggtaacttcctggaaaatattattgactggggtctgtcacgttcaagatattggggaaccccactgcctatttgggaatgcggatgcggacataaacatgttatcggctcaatagaagagcttaaagaaatgggaataaactgccctgatgatattgaacttcataagccatatgttgatgaagttaaattaaaatgcccggaatgcggcggcgaaatgacccgagttcctgaggttattgactgctggttcgattcaggctctatgccgtttgcacagctgcactatccatttgaaaataaagaactgtttgaaaagcatttcccggctgattttatcagtgaagctatagaccaaaccagaggatggttctacacattaatggcaataagcacattgctgtttgatgaatctccttataaaaacgttgttgtaatgggacatgttcaggacgaacacggaaagaagatgagcaagcacctcggcaatgttgtcgctccgatggatgttctaaatcagcagggcgccgacgctatacgctggtacttctattccaactctgctccttggctgccgaaccgtttctcagaaaagaacgtgtctgagtcacaaagaaaattcctgggtactctatggaacacttatgctttttatgttctctatgcaaatatagatgaatttgacccgacaaaatacacactggatattgataaactttcagtgatggataaatggattctttctaaattaagcggtgtaataaaagaggttgacaataaccttgccaattataaaattgttgagtcagccagggctataacacaatttacagacgagctgtccaattggtatgtccgccgcagccgtgaaagattctggacggttgaaatgactcaggacaaaattaacgcatatatgacgctttatactgtcttggtagaattttctaaagtgtgcgctccttttgtaccgtttatgactgagcaaatatatcagaacctagtattgtcggttgataaaaacgctccagaaagcgttcacctttgtgattatccgtctatggatgaaaagctgtctttccctgaaattgagaaagatatggacgctgtcagaaaggtgataatgcttggccgcgcatgccgtaatgaagctaacataaaaaaccgtcagccgcttaaaaaactgtatattcaatcaaatactgaaattaatccggactatatttatataattctcgatgaactcaatattaaagaagttgagtttgttgaagacgccagcggatttatatcatacaaatttaagcctcagatgagaacaatgggtccgaagtatggtaagctaatgcgtcctatatttgacgaggtggctaagatggatggagcagaggttatgtctgttctaaattcaggaagcccgctgaagctcaatgtacaaggcactgacgttgaaataacaaaagatgacgttttgattgaaacccagcaaatgaatgggcttgtttcagacagtgacggtggatttaccgtaattcttgacacaaatcttgacgacgctttgattgaggaaggcttccttcgtgagataataagcaaacttcagacaatgcgtaaagattccggatttgaagtaaaagaccgtataaatatctactttagcggaagcaataaaataaatgatatattcgttaaatttgctgatgaaataaaaacacagactttagctgatgaaattcaaaatcaagaaaatgacggaaaagaatgggatattaacggtgaaaaagttataatctcagttgaaaaagtataatataatagtataataaataatctaagggtcaccgatagaattttttctattatgtgaccctgattttatactttaggaggagttttatgaaagcgttggttacaggtgcaagttccggtataggacgtgatatagccgagaaattaagtgatttaggttatgatattatacttgtcggaagaaataatgaaagacttcaaaaaacagcggattcgcttaaaacgaaatcatatataatatcctctgatttgtcggacaaaaacgcttgccttgaattatatcaaaatgttcagggaatcgctaatgaagacgatttggaaatagtcattaataatgctggatttggtttattcggagagtttaacaatacaaatataaatactgaacttaatatgatagataccaatattaccgcacttcatatactaacaaaattatttctaaacgattttataaaaaaagacaggggatatattttaaatgtggcctcttctgctgcttttatgccgggaccgctgatggcaacttattattcaaccaaagcatatgtgctcagacttacccaagctatagctatggaactcaggcagagcggttcaaatgtttacattggcgcgttatgccccggtccggtaaacacaagtttcaacaacaccgccggagtaaaatttgctattaaaggacttaagagcgctgacgtggcttcgtacgcagttaagaaaatgtttaagaaaaagactgtcataatacccggaaccacaatgaaactaggaaaattcggccttaggtttttatctgacaggctcgccgcaaaagtcgcatacaatattcaaagaagcaaaggttaaatttttatatagcatttatactaataattaatttgcaataatagcttgcttatcagcaatctcagactgaaaacaaacgccattgcggaatattccacaatggcgtattagactgttattaaagtataaaagtttttgtaatatgcgcaaaagccaattctttagacctctagtcatagtagtaaaagaacgttcccttaacatcaatgacagagttttttaacatataaaaatattaagataaacatcttatatccattactcattagtaattcttaggataactgtttatccttccattattttcacatataccgttcttgaagtcttaaccctttcaaactcacatagataaatcccctgccaagttccaagaagcagccgtccgttttctataataatattctgtgaaaagccaaaaagccctgacttaatatgagctgctgaatttccttcataatgatgaaagttggggtcatcatatggcacaagcctatctaaagtcatcaaaatatccctttgcacatcagggtcggcattttcgtttatagtcaatccacaggtggtatgaggaacatagacggtgcaaagacctgaattaacgcctgaatccttaaccgattcctgaacctttccggtaatatctatcatttggtctcctcttcctgtgtgtatatttatcttatatagcataaaatccacccctaaaacaaaatatatttattgtaattgtatcacaatgacaaaaagcggtcaagtataacaaagatgttaaactcgaccgcttaaatatttaaaaactaatcttcaatctttctcagatttattttaccattcggctgaatctcaataacttcaactttaatcatatcgccctcgtgaacgacgtcagtcactttttcaactctgccttttgccagctttgaaatatggacaagaccgtcagttccgggaagtatttcaacaaatgcgccaaagtccataatcttaacaaccttaccgtcatatatttctccgacttcgggttccctaattatatcctctatcatctttttagccagctcgccggcttttgtgtcaacggctgctatataaatacgaccgtcttcttcaatatcaatttttgctccggtatcggcaacaataccctgtataactttaccgccgctgcctattacctcacggattttgtcaaccggtatagccatattaatgattttaggagcatactctgaaatattttctctaggctcagctatagctttaagcataacttcatcaagaatatagaatctggcatttcttgtctgttctaatgctgttttgataatagcaggtgtaagaccgtcaaccttaagatccatctgaattgcggttatacctttcttagtgccggcaactttaaagtccatatcgccgaaaaagtcctctaatccctgaatatctaccattgtaataaaattatcatcatcttcaggatcggttatcagacctacagaaataccggctacaggtgcctttatcggaacgcctgcatccattaatgataatgtagaaccacaaatactgccctgtgaagttgaaccgtttgaactcaaaacctcagatactacacgaatagcatacgggaactcatccacgctaggcagtacaggcaaaagcgcgcgttctgccaaagcgccgtgtccgatttcacgtcttcccggaccgcgtgacggtctggtttcaccaacgctgtatgacgggaagttatactggtgcatataacgttttgattcttcaagaccaacaccgtcaattgtctgagcgtctccgataggagccaatgtggttacagacaaacactgggtttgtcctctgctgaacaaaccgcttccgtgcactctaggcaaaagaccaacttctgatgaaagaggtctaagttccaggattcccctgccgtctacacgtttcttttcatacattatccagtttctaactattgtcttctggagcttataaagagcttcatcaatttggtctttatattcttcctgcggatatttatcctcaaaatgaacataaacatcttcatatacaacaagaagtcttgcgtctctgacagtcttatcatccgtgtcaagcgcctgtttaacctgctcctctgcatagtctcttatatcatcaaacaaagcctgatcaactgtaacatgctcatattcaaatttcggctttccgatttcgtcaactatcttttgcaaaaaggcacaaatcttcttgatttcttcatgagcaaacataatagcgttatacatatcagtctcagaaacctcattggctccggcctctatcataacaactttcttagcgcttcctgaaacaacaaggttaagatcgcttgcttccctctgctcaacagtcgggttgataataaactcaccgtctatcattccgacatatacagcggcaacaggaccgttaaacggaatatctgaaacgctgacagctatagatgaacctatcatagcacagaattccggcgaattatcttggtcaaccgaaacaactgttgaaacaatagaaacatcgtttctcaaatcctttggaaacaaaggacgcataggtctgtctataacacgcgacgtcaatatagcgtggtctgacggctttccttcacgtctgttaaatcctcccggaatttttccgacagcatacattttttcttcataatcaatgctgagagggaagaaatcaataccatccctcggcttgtctgacgcagtagcacatgaaataacaactgtgtctccgtatcttactattaccgaaccgttagccagtccagcaaccttgccaaactccaaagaaaggggtcttccggcaacttctgtttcataaatctttgacataaataaacctcctaaatattttaaaagagaggcccgtttagcacttaaaaacaggcattatcagcgccaatgcatatttttaactgctaaagtgagctcaactctttgtttacaaaataaaccaaaggcaacccacgctgaaaaatgcgcaggctgccgtcaattgtttttaatgtctcaagccaagcttttcaacgatagcacggtatcttgtaatatctttcttttcaagatacttcaagaagctacgtctaacaccgaccattttaagcagaccacgtcttgaatgatggtccttcttatgaatcttcaaatgctcatttaagtgattaattctttgtgtaagaagagcaatctgaacttcaggcgaaccagtgtcgcccgggtgtgtagcgtatttttcaataatctcctgctttatgtccttatccatgttgtgtcacctccatattatattagccccttaaagcttagtagagggcggtgaatccatatcccaaaacttaagccataggttaccgcaggttataataacacaattagaaattgttgtcaagcattttttccaaatcttcttcagatataacatttattcccagcttatttgccttgtctagcttactgccggcttcgtctcctgccaaaaggtagtctgtcttttttgatacgcttgacgatactttacctccgttgtcctcaataagtttctttgcctcgctgcgtttcattcccggcaaggtgccggttattacaaacgtttttcctgaaaatataccgcctttttccactgcttcataagtcatatccaccccgcatttgcgcagatgttcaattaactcaatacttgcagattcagaaaaataatgctctacactcccggccattttttcacctatatcagggatttctgcaatttgctcggcgtttgcttcagctacactttctatggtgccaaaacgttctgctatcagctttgcagctctggaaccaataagccttattcccaacgcaaacaaaagtctgtcaaggcccctggatttggagttttcgatagactctataagatttgaagcggatttctcagcgaatccctccaaacttactatatcgtctttttttagttcatacaaatcagcacaggtcttaaccaaaccctcatcaataagcttctcaactattgccggacctaagccgtcaatttccatagctcccttagaggcaaagtgaattatgcttctaagctgctgtgccggacagtttgaattcgtacatctagtagccgcttcatcatctattctctcaagaggttcgccgcaaaccggacagtcatccggcatctcatatttggcagcgtcaggcttcctcttatcttttataacctcaacgacctcaggtataacgtctccggctttttgaattattatatggtcgcctattcttatatcctttgaatgaataaaatctatattatgaagagtagcccttgataccaacgaaccagcaaccctcacaggtttaaaaacagcgttaggcgtcaccgctccggttctcccaacttgaagcactatatcaatcaactcagtttcctggcgctcaggaggatatttataagctgttgcccattttggcgttttagaatttgacccaagtaacaaacgctcttccaaactgtttacttttacaaccgctccgtcaatttcaaagtctaaattgccgcgcatttcaccaagcctcattatttcatcatagacctcgtcaatcccgtgctgaatccgcctgtcaggaataactttaaatcccaatttccgcatataatcaagactttcgctgtgagtgacaaactccattccctcaacagcctgtacgttaaaaataaaaatatcaaggcttctctgcgccgtaacactgctgtccaattgtctgagcgaaccggcggcggcgtttctcgggtttgcgaaaagcggctcctccgccacttccctcaactcatttaaacgaaggaacgcgggttttggcataaacacctctccccttacctctaaatatggaatttgttccgtcagctttagagggatactttttattgtcctgaggttattagttatatcctcgccaatatttccgtcgcctcgggtagaaccccgaaaaaacattccatccctatattccaaagaaaccgaaagcccgtctattttaagctctgttacatattcaacagtatctaaaccgagagataactttgttctattgtcaaaatcaaaaagttcctctttatcaaacacatcagtaaggctttgcatctgaatggcgtgagtaacctgttcaaatccctcaagcacgccgccgcccactctctgactgggtgaatcctgagttttatactccggatattcttcctccaatacaataagctctcgtatgagcttatcatattcaaagtcactgatttcaggagcgtctagaatataataacttctgttcgcttcattcagtatttctttcagttcgtcaatacgctgtttagcttctgttttttccattttttcacctttataaagttaaattatatatttgatattataacccaaaaaacttttagattcaagatgtataatagcacaataaaatcccgcataacaagtcacaggattttataattttaaattatatcaatttgttccttatcctaaagccttgtcctattacttcctttgcgtcagttacaatcacgaaggcgccttcgtctatattcataaccatttttttcaacggcggaagctgatattttctcattacacacattaaaacgtctctgttttttccgctgtacattgaaaatccggaaagcgccgttgaaccgcggttaagttcagacgcaatcatttcggctatttccttattatggtcagaaataacgtacacaatctttgcaaaatttacgccctcgagcattgtatctaaaacatacgagcaaacaaacagcataactattgaatacaaaatcgtgtctaatctctgaaacgccaatcctgccgccaatattactataccgtcaatagctataataaattgacctacagacattgacggaaaccattttttcagcacaagagaaagtatatccgtaccgccagttgtaccgcccgaacgcatagctataccaagaccaacgccatatattgagccgccgaataccgaacagagcagcatatcatttgatattggctgaaagctcctgaatatttcaagttcaaaaaattgagctgatactgaaagcgcaactgttcctatcagagaagtgattaaaaatctagaattaaatgttataaaccctaaaataaaaataggaatattgagaaccaataccattaatccaataggcaggttaaacaaataatacaatactgttgatacaccgctgacacctccggcagtgacctgagacggaacaagaaaaaaatccagagcaaaacccataatacttccgccaagcaatattaacaatatatcctgaactttttctttcaattataccgccccatttgttttataataattgctttaatattattgttatgtaaaattctacgcaaattgttcattgcgctataaaaacaaacaggcaaatctattaatcaaaaatatgtttaagtaattcgcatatccgctcttcttctcccgaaagataaagaaaaccaaacagcgcttctactccggttgccacacggtaatccgacatttcagaatttttcggaacatgtgattttgtatttcttccgcgcttaaacactgacatttctttttctgacagcatattttctattttcctgaaaaactccgcctgtcccttgcagcaaacatatgttgtagctgatttatgaagcttgtttacattctcatttccatccttaaccaaatagctcctaacatataactcatatatactatcacccaaataagctaaggttaatggcgaatactgctccggcggcagcttatctatacccaaattctctaaaataacatttatcatatcttttaatttttacaaaccgagacgtaataatattttgtgctatattacaaaacttattcacgtatatctcactctgtatccctaataagagatggttcctccaaatcgtattttaatttcttattttaacaaataccgcctcaaaaagaggcggatataataatatttaattaatcaaacaggttttaccgcacagctattctatcatttagcttaaaacagcaaatccgattttattatgaaactaatttatttaaactttctaaaagcggtaatttaaattaactatagcttaatcaactgctgcccctgagctgtatccttaactgaatagccaaagtctttcagcttatccctgattaaatcagactttgcccaatctttatcggctctcgcattttttctttcctcaagcatctcttttacttcatccggaaccgtttccttctctttgcgcccaagtattcctaaaacgctgccaagctcatcaaaaactgacaatatatattctataagatattcgctcggctcagaagcggaggtaatatttttgtttacttccgacactatctcaaatataactgatatagcgtccgctgtatttaaatcatcatccatagcgtctataaatttctgcttataaccattgaccgcttcaagcacgggaatctcttccggtctcgcgtcttctccgcttgctgtcttctttaagaattttaatgtgtctatacatgtataaattctctctagagcagagcttgccgattccattaaatctttactgaagtttatcggacttctgtaatgcgctgaaagcataaagaaacgaataacttcataatcaaattctttggcaacgtcacgaacagtaaaaaagttgcccaacgacttagacatctttctattgtcaacgtttatataaccgttatgaacccaataattcgcaaactgacagcagtttgccgcctcgctctgggcaatttcattttcatgatgcgggaaaataaggtcctgacctccgctgtgaatatcaatagtcttatcaagatacttattagccatagcgctgcactcaatatgccatcccgggcgtcccatcccccacggactttcccatgcgggttctccgggtttttgcttcttccaaagagcaaaatccataggttcgcgcttatcctcattaacttctattcttgctccgctctccaaatcctcaagcggctggtgcgatagttttccatatgatttaaacttctttgtgctgtaatagacgtcaccgtcaacattataagcataaccactgtcaaccagtttttgaattatatctattatagcgtcaatattttcagtagccctcggatgaaccgtcgcatgatgaatgcccagtccctttgcatcaataaaatactcttctatatatttatcagccagttctttaacagtgatgccaagctcattggctttgtttatcatcttatcgtctatatcagtaaaattctgaacgaatctaaccttaaatccctgatactccaaataacgtcttaacgtatcaaatattataaacggacgcgcgtttcctatatggaaatagttataaaccgtcggaccgcaggaatacatcttaacctcccccggttttataggaacaaattcctctttttctctagtaagcgtattaaataatttcatatgtagaaaaccctttcatctaatttattatatccaatcaatcggtttcatcttctttataatcaccgcactcaatattctcaactttcctatacaaacgctctatagaatttctcaaactgcacaagtccatagataccggatcgggaaaatgaatttggtctaggtctgcgacataaacctgctttgcaggagcaattttaactccttctctttttacaatatgcgccggaacgccaacacatgtgctgttcggcggtatctcgttgagaaccaccgcatttgcggcaacttttgaattatccccaacggtaaatggtcctaaaatcttagcgccgctgcctattgtaacattattacctatcgttggatgacgttttcctttgtccttaccggttcctcccagagtaacaccctgatatatggtacagttatcaccgacaacagcagtttctccaatcaccacacccataccatggtcaataaacacattcttacctatttgggcggcgggatgaatctcaataccggtaacttttctggcgtgcatagatacccagtcagctaaaaaatatcttcccataccatacagcttatgtgcaattctatggtatataatcgccttaactccgggataaagaaaaaatatttgagctttggaacgagccgcagggtcacgttcaaaagtcaaatgtatttcattcttgattaacttaataattcccataaacatactccattatgccaaacaaggcaattttttgatataatatatttatattgaacctggcaacaattataacactaatcttcttgccgcacaatagttattgaataaaattttccgtttttttctctgtagtatttataaattatatcaaattactaatatatagacaacgtaaaatgctatagtttagaaactcaattaaagaaaatataaagaacaaagatttattatattatattgcgtgtacatttaatacaggcataatatttaatttggaaattcaacaaagaactagacaaaaaattaaaggtgtggataggctacaatgaattggacgaaaaaattatgggagtttaaaataaaaaaattatataaaatataatataacaagcatctgaaatgtaactattaccacacttgtaaagagtgtattatacaaagcaacttgtttttgtaaaattaaaattcaatataaaaaataaaggggcgtcttagtgaacgtcaatagggtgcgactccacctgaatggtgggcgttatacaaaacgacttgttttattttaaccttgaatgtctgtgaccccaccataatggtgggtgtaatacaaaataacttgttttgataaaccttcaatgtaaattgcggctacacttttgtttaaaagtgtatgttatataaaccatataatgccatataaactataaacgccaataattaacttaggtgtcatataataaattgcttagttgtgatatatttacttgcacaccgcgttaggtgactaccatctcacgcgaagcgtgaatatacatagaaaacagacaataaaatggacagcaaatttcattactcattttaagtattgttaatatatttaattagcaatatttttaagacaactgtttaatgaaactatccctattttatatatactctttttaaaaattgactaaataaaactatagcaaaaaggggtgtgcggattccgcacatccctttacgaacgccccaaaaggacgtctgcacaaatataattgtgtaaaaaagttatatatattgagtcaagaaatatatatacataataaaaatatactgtgaactaatcaaatcttttaaaccgaaaaactgcggccggcttaatataaaaagacaagtgaataactcagcttcttattggctgctgaactattttcacttccgatttattctatacttaactgttatcttttctactgtcttctttgctaacagacacagtcacgaatttaatatcctcaagaagctgtttaagttcttccgcagcggctttagcttctgaaatactctcctgcatatggttcagtctttcaacagctttatcaatttcactgaaatcaacttttaagcactttccccgtcttcactgggttcaataaaaacatccaaatccactgtcacgcacctgctttatctttcgcttcttctattgtaacatataagtcattgatttgacaatgcaaaatttcagcaatatccgggagtttactcgcccgcggcattgccatgccggtctcccattttgtaacagtagatctttctattgaaagagcgtcggcaagttcctgctgcgttaaacccagcttttctctaaaagattttatactgttcaaatttatcacctctatcgtgcaatttattcacacccttattataagtgaaatttttgcacttgtcaatagtttttttggaaataagtggatttattgcacaccgccttgaaaggtgattaatattcacttataatagggtagaggtgataaaaatgaccgtgttaaaagaattgagaatttctatgaagaaaacacagaaggaagtcgccgattttcttggtgtcgacagaacaacttatgtcaaatatgaaaatggaaataccgaacctaatttagataatataaaaagacttgcggagtattttaacgtcactaccgattatctgcttggaaagtcagaacctcccgcctctgagtcttccgagtcaaaaaatgacaacggattaatattcagctttgaaggaaacaatgaaaaaatcgacctgacttccgaacagctgcaaagagtcagagaaatgctgagactggctatgcctgaacagtttgacaaaaatgacggtgcaaaaaatgaataattcttatggtctatacagaaatgttcgtaatgcttcatggaagtttctgattgacttcaatatatgcgagctgccaattgatgtttttaaaatctgcgaacagctaaacatacaaattaagtcatatgaagaacttccggagataatctcaataatcggtcagcaaggacgaactgttgatgaagagggtttttgtatgttattcgacaaaaactggtttatattttacaaaaacgattaccgttcgtatgcaaatataaattttgttattcttcacgagcttgcacatatcttattggggcataaaacgaggattgaaagcaataacggtaaaattctttacacaaacaaaaagaatatgaattctcagcttgaaaaagaagcggatatgtttgcaatccgcataatgtctcccgcatgtgttcttaaagaactcaacctccacactcctgaagaaattatggaagtgtgccgtctgccatatatttatgcagaaaaacgcgctcagcggattgaagaattatacaaacggaatatgttttataaacagccgctggaaataaaagttcgcgaacaattttcaccttttgtcagccgccttaaaactaactggcagacagaatctatacaagaatttatatcacctgaaaaattttaatactttaaatccttaaacaaagtaataattaatgtatgaaagctgataataacctatgaggtgttatcagtggacaaatactttgattattatgataataaaagaactgcatatcaaaaagctcttgaaattttataccgttataaaatttctaaactgcctatcaatatatcacgactttgcagtttaatgaaagttcggctcggcagctataaaatatttgaaaatttaatagttagcctgcgtcttgaaaattttatgattaacgacggttttacagcaataatcaatgattcatattatactttttttaattccgataaaacagaaagacgtcatttaacaatttcgcatgaacttggacatatagctatggggcaccttgaaacagaaaatttagcatgtatggacggcgtcacagtttggaaccgcagtgataaagctgagccaagcgacatggaaatgttcgctaacatttttgcttcagccttgctggcgcccgactgcgttttgtatgatacaaacattaatactcagaaaaaacttatggaggttacagggcttgataatgaagaatcagaaaaaaagcttatacatctaaagagttttaatcataatcattctataacatttcttgaaaaagcagtatattataattttcgtgactttattcaaagttttaaatagtgtatattgaaagttaaagtatttggtcaatcgtggtaaggcttgacactcttctgtaagatgtgcgataacagtttatattgatttaggtattggtgaattattgtgaattatcgtaccgccttttcaaggcggggcagggctcacctcccgatgcagatttcatctgcactgccgttgttcgctttaaccgcttttatttcgttttaaatatttttttatgacccataatttaatattactttttataagttattatatgatattgtttaaaatagcgtaaaataaaggtttttaaaaataatataatttttttgttataagtttatataaattgattttgtaatgcttgtcaccattttatcaccatgacagatataaaaaacattttatttgtaatcaaatttatataaaaagcaaaaagactatacttctaaaaatatgctgtataaatgtgcgtttttgatgattttttaattttaagacacaaaaaaataaattaaatatgaattaacattttatcaaaattaaacattttaaactgaattttggaataaaggggattaagtcaaagtaaggaattaattccccctcaactgacatattgaatgaaagaacagataagtcaagagtaaatatacaagctacgcccgctcttgacttatctgttctttttgtgcaaaacatatttttcgcaaacgggtactcatttgctgtgcttgctattaaataaaatttatatttttgtacaaaactgagaaaacgcaaaaacaatattgcttttgttctagttttagaatataatattatttataataaacaaggagtgtctagatatggaagttatgtctgcaaaagaagccgccgataagtggggtatatctcaaagacgagtggctgttctttgctctgaaaatagaataaaaaatgtgcaaatgttaggcaacatgtggcttataccaataaatgctgaaaagcctgttgatgaaagaagcgcaagatataataataaaacaaatgagaaaaatgttaagccttttcttaaatgggcaggcggcaaagggcagttgttaaaagaaatagaaagttattatccttttgataatggtgttattacaaaatacgccgaaccatttgtaggtggcggtgcggtgctttttgatattttaagcaaatacaatttaagtgaaatatatatcagtgatataaatacggaactaataaatacttatgttattataagagagcatattaaagaactgctagagtttcttaataaatatcaaagcgaatatgtgcctcttgaaactgaaaatagaaagtcatactatatatcaaaaagagaaaaatttaacgatttgaaaataaatggcagtgaagatgaaaatatcgaaaaagcagcattgatgatatttcttaataaaacttgcttcaatggactctacagggttaataaaaaaggactttttaatgtacctatgggagcgtataaaaatccccttatctgtgatgaaaaaaatcttcgtacagtatcggaaaaactgcaaaatgtaagaattatatgcggagattatcgaaagtccgctgaatttatagataagcatacttttgtatattttgatcctccatacagacctttaaccgaaacggcaagttttacggcatatacagaaaatttatttaatgacgaagcacaaattcagcttgctgaatttgtgaagtgtatgcacaaaaaaggtgctaaaatcgttgtgagtaattcagatcccaaaaatactaatacagatgacgatttttttgacaacatttactctgcacatacaattaaaagagttgaagctactcgtatgataaattgtaatggcaaatcaagaggaaaaataaaagaactattaatatcaaatttttaaggagtttctaatatgagaaacagagattttacaacttggttatccgattttcgtgatagtattgcagattataaatactatattgattttgaaaaggtacacagaaatgttgagagtataaaagttgagcttaatatattaaactcccttataggctcaaagaatatcgaagctgattttgaagcgttaattgaaaaatatcccgaaatattaaaatgtattccgttacttttagcggttagatcaaatgaaatttatgctattgacagtgacggagaatttacatataagtttaagaaaccaaatatgtcggcagaacagtataaagtatttatgcgtaaaacaggattgtttgatttaatggctaatcatattataaataacattgttgattatgtaacaggagttgaaactggacttgactccaatggcagaaaaaatcgtggtggtcatttgatggaaaacttgatcgagagctttataaagaaagccggttttactaaagataaaacatatttcaaggaaatatatatccatcaaattactgaaaaatggaatattgacttatcagctatttcaaatcagggaaagatggaaaaacgcttcgatttcgttatcaaaacagaaaatatgatttatggtatagaaactaatttttatggtagtaacggttctaaactaaatgaaacagctcgaagttacaaaacacttgctatggaagccgatacaataaacggttttacatttgtttggtttacagacggaaaaggttggacaagtgcaagaaacaatcttgaagaaacttttgatgttatggagtatatttataacatcaaagatttagaaaatggtataatcaatgaggtttttaaataatggcggaaaagaaaataaaaaaatgggagcctgaagattttgagcttgaaatgacaacacattggtcttttccgcaacgtggagattgggcaactcacgatgcgaaatggcgtggcaattggtcgccgtacataccaagaaatattatattaagatattcccaagagggcgatttggttttagatcagtttgctggaggcggcactactcttgtagaagcaaaactattaaatcgtgatataattggagtagatgtaaatgatgttgcactccagcgatgtagagaaaagacggcttttgattacaagactgcaaagggaaaagtatatatcaaaaaaggtgatgcaagaaaacttgattttttgcctgatgacagtattgacttgatatgcactcacccaccatatgctaatattatcaagtatagcgatggcatagaggaagatttatcacaactaaaagtaaaagactttctcaaagaaatgaaaaaggtcgcaacagaaagttatcgtatacttaaaaaggacaagttttgtgctgtgcttatgggagatacaagacaaaaaggtcatatgataccaatgtcttttgatgtaatgcgtatctttgaaaatgcaggcttcaaattaaaagaacttattataaaagagcagcataattgcaaggccacggggtattggaaaaccaatagtataaaatataattttttattgattgcacacgaatatttatttgtatttaaaaaataactctatataactctataataagttgttataatttattttgaagttttattaccattttgtcaccaaaacaaccgttttatccaattatttctattcgacacaaaagccgcaagcgctgatttaatcgctgtttgcggctttttatgatttttataaaaatattttcttataaatttttatttagaattttgggttattatatttgataatattttttgaatcgttatatatgaagacgtgcaataaaggtctatgtttgcttaaacattggtgaattattgtgaattatcgtaccgccttttcaaggcagggcagggctcacctcacgatgcagatttcatctgcactaccgttgttcactttaaccgcttttatttcgtttttatttaattgtaatacttataattaaattatgattattttttataatggctgtatataaaacgtgcaatatgaaatatttgattattttataaaccatttaaaattttttattgccctaagattatacttagattatttttaattctcataaaactatctttaattttctaagatttttgtttaaaaaataagtattaatttgtatatataagactgtcaaagcacttatgtccaattcacagcctgcacgctatattaaaatagcgtcaattatttgattttatttttatatatgatataattgtttcggggtgtgaaaaatgaattcaaaaatattaaaatatttatcatttatattattaataatcatcagcggcggtattttattaacaacttttgttttcattcgatttaatagtatagttcaaaattttgaaaacggaatattaatatattcattttttaccttatatatatgcgctgttatattaccgatattgttcagaaaaaaattaaaaataagccggacaatacctttaattttgatattttgcattctttctgcagcacttattaacgcaggggcttacaatatagttaaaaattctgtttcagcatacagcagacaaaattgggataacaatgcaaatcttagaatttatatgattgaagatctcgaaaaacaataccagttttttggaaaaaccgaaacggaagtaattgattttcttggtcatccgtcaaatgtttcatattacagcggcaaaagattagaatactatattggagacggctatatagatccatatacatatgatatcataatcgaaaatgatgttgtttcaggtacggctatagtgcagcattaagataatagaaattatgcttaacccagccttgccaacttaaaacaatctgtcttattataatatggataaaattttgatacataaattcaatttgtttatcacctttaaattttagttctttaaatataaaaattatttttattacattattttctacctattaaatcatacagtattattttattacaacaaaacttttataatcggagccgcagtatatatcttatatgaatttctatacacttttcttataatatttctcttttgattaatattttacaatatctattttatcgtgatgtataacactcttccgttattcgttttttataaatatatatttatatttacgtttatacttttatatgcaatagtatgaaacacatcgcacatttcatattatataatacttttgtataatacttttattaatatttaccaataatttattaatatatttatctataattcaacattgtatttaaattaataatatgatatgatttttatggtaattcaatatttgacaatattttgtaatatttgaattatcaataaaaattaaaaggagaatgtacaaatgaaaaaagtacgaaagaatctaagtttacttttagcggcagccctgctgctcagcactgttattttacctattaactcttttgctgaagaagctattccgcaggaagaaacaaccattgatagctccattggtaaatccccaattccaacggcagaagacaatattttaactgccgaaacttccgttcagacggcagatccttctgttccaactgcggaaagcccgatactggaagaaaacaataacgccggcttaaatgatgagattccgccggattccgccggaacctgtgatgatattctgcccggcaaagttattgtcactctgaaacaaaattccgccggcaaatataaagcgccgttttcagttgatagtaaaaccgcagtattaaacagctctatttttgacaacattgatatagcggatattgagctgatttcacccgcgtctgaagaagacgaaataatgactttaagtgatgatacagcagactcgcccggtgatatattccttattgaattaaataatcaatccgaacaaggtgtttttgacgccattaagcagcttcaagcaaatgaagacgttctatgggcggaacccgactacatacaatatttctatgataccatacctaacgacgagttttacaatgaactgtggggaatggaaagaataaacgcaccgatagcatgggataaatttaccggaagttcagatgttgttgtcggcgttatcgacggcggcgttgattataatcatcctgatttggctcccaatatgtgggtaaatgaagacgagattcccggcaatggtgttgatgatgatcataacggatatatagacgatattaacggctggaatttcactttcaatcataacgacccaatggatattgcctatcacggctcacatgtggccggcatcatcgctgccgccggaaacaatggaatcggcgtaaccggggttgcctggaaaacaaaaattgccgctctgaacgtagggattgatgaaaggagaatcagctcagcggcagttattaaagccattaactatgccacagataatcattttgatataataaacggaagtttcggaggaacttcaagcagccttgcccaaaaaacagctattgaaagattcccgggactattagttttcgccgctggaaatgaaggagttgacactgacgtagttccgaattatccatccggctttgaatgtgaaaacataatatctgtagctaattttgatgagagcggttctttaaacagcacctccaactatggtgttgtatcagtcgatattgccgctcccggcacaggtatttacagcactgttcccggcggagaatataaatatttaagcggaacttctatggctgctccatgtgttgcgggggctgccgccctgttaaaaggatataatccgagcttaaggggcgcagaattaaaagatataatcttatcttctgtatacacttcgtccgaatatgataaagtttccagcggaggccgccttgatctgacaaaccttctttcaacggcggacgggaccgcaaacgatggggttgtgaatcccggaaagcttgagtggtggacaacatccatagaatggagacaatataccggtatagatgaaaatgaaccgtattttcaaaagtgcagatttaacattgaaagcgttaacgttatatgcaaaaacaaaacttatactgtcccggcaaaaacattgaaatatgatgttatcgaagcaaattatgactatgagataaacagcagatacgagctctgcgcaaaagttaactatgacggttccgcagaatactatcttgacccgggagaccgccagcttgaaatggggcaggataacaaagatattgcatattttgatgattatgcgcttatttggattgcagatgtttattccgaccaaaacggacaattgttttcagacagcgctaagcttattgttcctaactatacctggtggaataacagcgtaacctatgaccctgataataatctgaatgccgcttttaaaattgacagcatacaagtatatgcaaatggtaattattacaatgttccgtccgaaacaataaatttgagaccggcactttctgctccgcctctcagacctgagcgggactattctctcggggtgcaaattaaaaacaacggcactgcggagtatggaatatatgcgccatgggcagaccgcgaaacaaaaggaccgatttataacaacgacggaattcttattcctgtctttgattttaaatatgattcaaactataaccttatagtttcacagctttggtttgaaaacaatatctattatccaaatgacggaatcgtttatcctggaaaagattcgtggtgggaaacaaaaattgaatgggaaaaatactggatggatgaagaaatctattatcccagctgtgaatttacccttgaaagcgttgatgtaacttgtaaaaacaccaaatatactgtgccgggcaaaactttcgtataccgtgaggtcgccggaatcttcgattataacgcaaaaagcgaaaaatatcttgccgtaaaggttgactacaacggttcagcgtcatatcagctgtatgattacatcaatgaaaataacagcaacagtccagcggttgtatataatgatacatacgcggttatccccatttgccgggtattctcagacaaaaacggacagatgttttataaatctaaactcaataatttcacttacactaatgggcaaaatataacacagctattatttccgtcacaaattatgtccatgaaatttaaagacattgccgctgaacgtgaaaccgctgtcggtttaacatataacggcgaagtctatgtatggggagacggcgcatactatgacctgggtcagggacaggtaaagctgaatcaatatacgccgctgaaagttgaaggtcttcctgaaatcgttaaaattgccaaaggcaaacaccacgtactggctcttgatgtaaacggagaagtatggggctggggcaacaattccagcggtgaagttcatggtgcatataaaggcaaagtgtatgtgccttcaaaaatttcaggcctgaacaatataacggatatagcggcaggcaccggattcagtgccgctataaagagcgacggaactctctggacatggggcagcaacacagacggcaagttaggtgaccgcggaacaagcgcagcaaacgttcctgcgccggtaacaggtctcagcaacgtatcaaaagttacatgcggagagaaatttatggcggctctctcaggcgaaacagtttacacctggggcaataatgaaagcggacagttgggcagcggaaccaacgacagcacttcaacacccaccgcaatcacgggcagctataaggacattactgccggcaacagtcatatgctcgcagtatccacatcagacgagctgtttacatggggatacaactctgtaggacagctgggcctgggtgataaggtaagcagaaacgttccgacgtcaaccggaaaaaccgctgcagtcataggcgccggctataaccacagcttctataccgacggtgaaagcacctacggtttcggaagcaacagcaaaggtcagcttggaataggaatacaaaataccgctcttactcccactcttattgccggtttgagaaatattgtcaagatagacggcggattcgattttactatcgctaaagataaggacaacaacatatgggtattcggtaataataacgttggacagctgggaatatattaataaatttttaatattacgcaaaactataaagacaattacatttatacgataaaaacagcatactgaacaatagaaataggctgttataaaaaacagatgtagattatgtgatagtacagtacataaaaataggacttcaaataataatgaagtcctattttttatttcttatattattagaaaataaataattttcattattctgttttaatacaacagcattcttctaaaattaacaattcgtcataatacttttccgcagctgctcgccttacgcggcaaactacgtttgcattgagtatacaaattattttttgagtatttaaattagtgatgagtatccacaaataccaaaataaaatggtttgacaacagaaattcgggaaaattccggcaaagtcggaataattatggaacccgaaaaatcaaggcggagctttgcaaaaatggttattatgaattatcggattatgtaaactggtttaacaatcacaagattcactcatcactgggctatatgaccccgaaagaatatcggcttactaaccttaaataagttgtctaaattagtgttgactatccatgttttaaattttttaatttagtcgatgctatcaagtatccttcctccaatgaaagtgtggttcgtgtatcttctctttcgttggcaaataaaactcaatctaatagtttataagcctaaattccccgaaatttcctattatatatttatgaaaataattgaatttgaaaaaaatatatgttataatttttgcaattggttttacatcaaaatattacaaatacataagaaagtttacaaattttgaggtgcctgcttatgaaaatattttttaacaaaatattatattcggctgttcttacatgcctgctgataattgtatttcaaactgtatgttttgcagaagactgcacgtcttacgatggatacatagtaaagttcaaatcagctcccgtaatgctggctgaagaaagtgacgtcaatcagctctcacctatagtaaaagatgagaatatatacacagttacaaatgaatccgaagagtttatagacagcctgatccaagaccaaaacgttgagtatatagagcctaattatatcatctcgctgccggacaacgaggaaataactgatatcaacgttctttctgaatcaaacaattcaaatattgcagttttaaacagtctcagttcattcactcagccaaatgatacatactattataatcaatggaatatggaaatgataaagtcgccatactggtggcaatatggattggatacaaaaaacattaaaataggaataatagacagcgggtcacctgacagacatcctgacataactcaaaatattgcgcccggagttgactacaccggaaccggaatttatgatacatatgggcactcgacatttatatccggaatattagcctctgacacaaataaccttatgggaactgccggtattcttccaaattccactgttatacccttcaaagtgtttacagagaaaaaaactgacagcgctaaagttattaaagccttttatgatgctgtggatgtttacgaatgcgatgtaataaacttaagcctgacatttgacagctatatagaatcttttaaatatgctattgaacatgccgtgtcaaaaaatatcatagtagttgctgcggtcggaaatgacggaaataaagaaacggaaatagctactaaaataaaatatcctgccggctatgataatgtaatcggagttggttcgcttacatattccaaaaagagggcttcacacagccaatataacacttctgtagatgttatggctcccggtgaaagtatttacagcagttctttgactaaagacggtaaaaacaatctgatacattcctattcccgcggtaccggcacatcatacgctacacctcatgtgactgcggccgcagcaatagcaaaatattttaataaggatattacccccgcagaatttcttgaattaatagctgaaacttcagaccatctaggcgacgacggcaagaatcctgaatatggatacggagctctcaatatacaaaatataattgaaactttaagtccaagttttgccccggctcctacctctgcccctgtaagctcacccgaattgcacaccgaaatatatcctttggtatttgacgctgatttaaattcattaaagagttctattcagctttataatgataccgataaaaataaatttgtagactgctatgtagtttcatacacggaatccagcgacgctgatggtgaattggttgaacatgtgacaggttcaatagttaaaaacgacgttgaaattccggcaagcggtcataagactcttccatcgcttgttctgcctgtagataagacaggtttgcgctcattaataagggtatttatatgggacgataacatgcagccgctgatggctccttatgaatatgaagtaaaatattaatatttaatacgtttgtccaaaattccattatttgacattaaaaatctgaataaaatacaatcacctctaatactatctatatatgaggtgattttttatgtttgttgtcagactgaagacgctggtatttttttcagttatatttattatttcagttgtagtcggaatagtgggattctcatctttgaaaaataatgattcacaatttggtttcgccgaaagtttttctgaagatgaccgcacatcagttgaactgcctataattatgtaccatggattgaccaagaacccatctaaagtaaacgcttacgttattcctatctcttcatttgaagaagatttaaaatatttgaaagaaaacggatacactactgttttgatggaagatgttataaattacgtcgacgggaatgaagctttgcctgaaaagccaatagttttaacttttgacgatgggtttgaaaataatttagaatacggtcttcctcttcttgaaaaatatgatatgaaggcggtcgtttcaatcgtcggtcaatatgctgaaaagttttccagtattgacgacagcaatcctgaatatgcgtatcttacctgggacaatataaaagagcttgtggacaacgacaggcttgaaataggcaatcacagctataatatgcacatgcttccgggtgataaaaacaataaagacaacagaaaaggcgtggggcaaaaaaacggcgagtctgacgaaacatacagggaaaaatttatagccgacacagaaaaaaaccaacagctgctaaaagataactgcgacatcacaccagtgacatatgcttatccatacggtgagatgtgcaaaaattccgaggcgatattaaaagagctgggatacagagccactcttagctgtcttcaaaaagataactatataacacaaggtaacccggattcattatattgtttatccagatatttgagaagcaatactaaatcgattgctcagttattacaaaaataaaatgaaatagtattctaatcattgattgaaacggaagacagctttattgatttaaggtaaatgctacatttcttaaaatcattggatttagtagatatattgtaatttatactttcctataaaaaattcaaataattttaaacttattaattaaaaagggttcaatcgaaccctttttaatttgacatcaacgcatttattaaatatcaattctatattattttttaaaaccgttttaatttttaataaaaacctacaattttcacaattattacctgcagtgttttatattttctctcttttcaacttttttactgtcgtttacaataattttcacaatatcggtttctttgctataataacatcacattatcacaactgttgattactgtaaatttccactaaatttttttattttccaaaataagtttaacaatttttctgatattatcgtgctaagtctctcggggcctttttacttttcattaattttatatctgttggcagaaacgtttctcaaaatcttttttaattatagacaacgtttagatgttgcttataactaaaaattacagagacagtttcgtaataattttctacataacaaaaaacggttccgcccatattattagacgaaaccgaatcatgctaaatagcaaatacttttttaaaaattttcataatataatcattgctaaatattattttaacacgtatttttaagccgcatatcccaaaactacccgttctattccggctaaatcaggaataatatctatattcctatatcccgccttaaacattaaaccggcgacgtcaccggcttgacctataccaacttcaaacgctgtcattccgccttttttaggaactgcttttttaattataatacggtaaaaatcaagaccgtcatctccgccgtctaatgcggcaacaggctcgtattctataacctcctgctgaagctcaagtaaatcatccgtcttaatatacggcggatttgaaactatcacatcaaattttggctctaaatccgaaattccatcacaaatatcacggcagacaaaattcatttgctttgtcaccaaatttttttcagcattcagctcagcaactttaagcgcctcttctgatatatcaagttctgtcacaacggagtttggcaaatatcttgccatactgattccaacacatccgctgccgcttcctatatccaaaatcctgatttgctcagatacgttcttatatctctcaatcactgtttctactaaaatctctgtatcctgtctcggtatcaaaacatttttgttaacgataaaatcaagggacataaactcagtttttccaactatatactgcaccggcatacctgccagtctgcggttcaaatacgcgttcacctctatagccagcgcgtccggcacagatatatccttagttaataattcatccttttttaaatccaaaacgaacataattatcaaatccgcatcaagctcgggagatgatatattgggttgttcttttaatctattatgcgcgtttctgcgcaattcctttaatgtcataaaatcaccttctgcctaactatgtgagtcagcctttaccacacatccgcagtcttatcctccggtatcacagctttcagcgaccttatagcaacctctatctggtcatcctctggctcattggtagttataagctgaaaccacattccaggagcgcttatagcgcgggtaaaccaattgtcatgccgtcccgcaaactttataatttcataagaaattccggctactattgggagtaatagcagtctcaatataagtctccaaattgcccacggcatagctgaaaacattacaccaatcacagggatatgagtaaagctttcctgctgccacggtataattgaaaacaccaatatacttatcaccataactatcagcaaaaagctggtgccgcagcgcgggtgcagtcttgattgaatacgaacattatcaaccgtcagcggcagtccgctttcatagcaaaatatagatttatgttctgcaccatgatacataaacacacgttttatatctttcatctgtgcaaccaatgataagtaaactataaaaatagcaattcttacaataccctctataagggtcaaaaccgtattattatgcacctgcataaaatcagtcaaaaaaccagctatcaatgtcggcagcaaaataaacaaacctattgataaaaacatggaaaagataacagaacaatagattataacattcattgctttttctgaatccagctttttctccagccaggcctcaaactttcccggctcctgctcgacttcgtttccatcgtcatccacgtcaaaaaacttagccgaaaacataagtgattttacgccaacaatcattgagtcaaaaaaattaacgcacccacggataataggcaattttacaaacttgctttttctgccttttccaagaggctgttcatcaacaactatttctccgtcaggcttccttaccgcagtagcaattttttcgggacctctcatcataactccctcaatcacagcctgtccgcctatagacgtcttttttgctataccgcataaattttgaacgctgtcagttttattctgatcgacctcatctaaaactccgctcatttgcgaagattcaatctcatttttattatcatcagataaattcatatacacaccatctctttctaactctatcaccaaacaaaataataatatcacattaataacaaaatttcaatgaacatactgttaacaatcaatgtcccaacggtttttcactaagcaaatcatgctcgcaggttaagtcggcatgaagcaggtccaaaaatacgattagcaagattattgtggctccccatatggctttgcctaagaataatctgcataaaacagtagaaattataccaaaaagcacaaaggttcctaacatacacaaatgcttaacacttctgcccaaactatccgactttcccttcctcagccatttgacaaaatttataccaacctgtcttaaatggtttgtacagaaagttgtcgacataggcgttccctccgcctgcctaaacgtattatactgcatagaacagataaagtttacagctacctgcgttatctgatatggagcggtttcaggaagcagaccaagcataaatgttactaaaacctctatacctacaagcagagtatcccagcgaaccaaaccaaactttttaacatgaatcggcagcgcctctgagagtacggctcctaaaaaatatgcagaaataggtatcagcaaatatgccgcaccgctcaaatcccattttccgatcgccatagccagcaatacaaaattagccgtttgagcattgcagaacactccgccgcggattgagtaagtatacgcccccaggaaacctccaacgcccattagaccaataaatataatcaatctctcacattctaaaaaccttttttgacctttatttatcataatttctaatacagcctctttctatactttttctgctgttcctccgaacgttttctcggcattcttgatacaaacgcactccggctttcaggtacagtttgatattcaccgcagtttctatcagacgctgaatttgtaccggtttcactttctctactttgatttgtaaatctgattctctgcatcattttcatctgcattccctgctttttcagcgcttctatcgctcttttaaagttatcctcagaacgtttcaatttttccttttgtgaaagcatgacaagcataaatacaaaacaaagaaccgcaataataattagtcctaaaacaagtattttattttcattttgaaccgtctctaatattttagtatactgatttctcaaactgtttgaatactgttcatatgactgttcaatcccgcccgatacggcagaactttgtatcactacactgcccggagcctcaagctcagcgtcaggagtatcagaaagctgaacgtttattccgttgttctccaaaaacgtcacaactgaactcatgggtatcgccagagatatacggtcagcgtcttcaaccttcatattattgacaccaataacctgacctttttgattgagcagaggaccaccgctgtttccgggatttatagccgcgtctgtctgaatataatgcactccgtttaactgcctgtctgttgttgataagatacctcggcttaccgtaaatcccattccctgcggagagcctacagcgtatacgtcggtgcccaaaggcggaatatcctcagtcataggtattgtcggaagattgcctcccaaaacctctatcaggctcaagtctttagcctcatcagaagctataagccggccgttgtacaaacctccgtcccttgtctcgattgtataagttgttgtagtactcacaacatgctggtttgtcactatcttatcctttgagatagcaaaccctgttccaactgaattcatagagtgaacaaccactacagaatcgcatatctcatccatatcaaactctatcgcgtatccgcaaataggaaaacaagcgagcaaaaccaaaaataacaatactgccgttccgattttcttcataaaataacctcatttttctgttccgctgacccttatacttacttctccgctgtccaaaatcctggtttcgctgctgtccagctttagaaccaaagcaccgctttcgtttatatcttgaactaatgcaaactctcccgtgtttaatatttttattctttcaccaagtaccatagaacgacttttataatcttcaatataatctttgattacacaatcaccgtcgtcacaacggacaaaatccaacatctgattaataatttcggcggcaatcacatttctgtcaatgtccgtgcagtcctcagaatcagacaaggctcctgcgactttggcgagctcctcaggaaatccgccgccaaacacattaactcctatgccaataatcacgctgtctaccatacctgtctcaaggtcggtcagcgcttcggtcaatatgccgcatatttttttgccattaaaaaacacatcatttacccattttatctgaggttccagcccagtggatttttctatagccttcgataccgcaaccgatgtgacagttgtaagccgtacggcgtctacagcctttatctgagggtgaaacaggaagcttatatatatgcctgatccaggaggcgaataaaaacttctgccccgtctcccttttcctccgctctgctcctcagaaataaatatacgcacatcagtagttttatcatttaaagcatattctttagctacgttattagtcgagctgaccaatcggtgaatttctatactatcagcaatcttaggattatttaagtgtttttttatttcaattaccgacagcacattgcttttattcaaaatataacctgagttcctttttgcggatatattatatccctcttctttaagagcggtcacagctttccaaaccgcatttcttgatattcccaaattttccgccaaacgttcccctgatacgggcgtttctccagaatttaaaagtatttcaagaacctctgcttttgtatttcttttttccaaaattttcaccttagttcatatagatagattttacatttatgacttatttacaagcttcacgttatcttcgccgagcatatttttaagtattcttatcttttcgctttcaggactcaccttcatactgtccggcgcctttaacgtcttttttgtatcttcaaaatatattataacttcaatattgccgcccgtgcctgacagtatatttttaacatcaccaagagcttgtctgtcgtttgattttaattttatatataacttgctttcactgtattttctctctttcaaattttccgccggaagcagtctttcaatactctgaaccctgactttaggcgccgagtcttcacttatatccaaatctcctctgacaataattttactgtccttatccaacatgtcgtcatacttttgcaccagggtcggaaaaaccaaacattcaatacttcctgtcaaatcctcaataacaatatacttcattatatcattccgctttgtccgcctaactctgacgcttgttataataccaaacactgcggtctgacttccgggaagaaatttatgctcttcatcctccaaaatatttaatattggcgatactctgccgctgaactgaaactccctgtattcgtcaagaggatgcccggacacatacataccgatactctctttttccatggctagcagctgttctataggcagttcatgtctatcctcaaaattatctgcctcaacagtttcttcctgcccgtcttcttcgctttctatatcaaacagacttatctgaccgggaagctcattctttgcagacgccgccagcttgtctatcagtgtctcatattcatataacaaaacgcttctttttatcttcaaactgtcaaaggctccgctttgtataagattctcaaccactcttttattcagcttcttccctgacattctgcggcaaaaatcagtaaaagagccaaactctccgttcattagacgctctgactctatagcagccacaaccccatcgccaacgttttttattgctcccaaaccaaaaactatacttccgttgacaacggtaaattttcttccgcttttgtttatatccggaggaattatatcaagaccgttcttttttgctatcagtatatatttagctattctgtcgccgctgtcaataaacgaattcataagggctgcaaaaaattcagccggataatgacatttcagccaggcggtctgatatgccacaactgcatatgccgcggcgtgggacttattaaaagcatatgacgcaaaatccatcatctcatcaaagatagaaactgccgtctcctcatctattccacgctttatagctccgtcaaccttgctttcaccgtcatcaatcccataaacgaagttatgcttctcctcagccataacatcagcttttttcttagacatagcccgtcgaaccaaatccgctctgcccagcgaatatccgccaagctccctaacaatctgcataacctgctcctgataaactatacagccataagttacgtttagtataggctcaagcattggatgtttataggtgacactgccatgattgtttttattatcgacataccgcggaatagactccataggtcccggacggtaaagagaaatcccggcgataatatcctcaagatttgtgggtttaagttcggtcataaaccgcttcattcctgtgctttcaagctggaacaccccatcgctgtcaccttttgaaatcattttatagacctcttcgtcgtccagcggaacagagttcatattcagttttatcccatatgatttttcagccatatcagctgcgtcacgtattacagtcaacgtcctgagacccaaaaaatccattttcagcagtcccagtctctcaatagttgtcatcgtaaactgtgttgttataacatcttcatttttttgaagcggaacataattatacaccggctcctttgtaataaccacgcccgccgcatgggtggacgcatgtctcggcagaccctcaagcgcctttgcagtgtcgataagcttttttatactttcgtcgccgtcatacatctgctttagctttggatttaagataagcgcctttttcaaggtcatatgcagttcaaacggtatttgcttagcaacgctgtccacggacgcatacgacatattcagagcacgcccaacatctctgatagcctgccttgccgccaaagttccgaacgttattatctgacacactctgtcgcttccgtacttgcggttgacatagtcaatcacttcctgtctccgctcatagcagaagtcaatatcaatatccggcatactgaccctttcgggattcaaaaaccgttcaaaaatcaaatcatatttaatcgggtcaacgttagttatttcaaggcagtaagccacaacgcttcctgcggcgcttcctcttccggggcctaccattatatcattatctcttgcgtattttataaagtcccagactatcagaaaataatctacatagcccattgttttaatagtctcaagttcatattcaagccgtctgtatacctgactgtctctatctgctgcctcttttggatatcttttcttatatccgtccagacataattttgttaaatattcatacgcgctataaccctcgggcacatcaaactcaggtaaatgcagttttccaaactctatctccacattgcatctctcagcaatttcagcagtgttttgtattgctttaggaatgtatgaaaacagttcgttcatctcatcctctgacttaacataaagttcagaagtagacatcttcatccgtttatcatcatcgactgtttttcccatctgaacgcacattaacacgtcctgatactcggcgtcttcttttttcacataatgaatatcattagtgcagactatgtcaagctccagttctccggcaagttttatcaagccgacattaagttttttctgatcataaagaccatggtcctgaacctcaacaaaaaatctatctctgccaaaaatatcaataaactctttcgctgtctctatagccgctccataattgccggcaagaatctttctcgaaagcactccaaacatacagccgctaagagctataattccttcgctgtactctctcagcagctccatatctattctgggcttataataaaatccatctataaaacccatagacacaattttcatcaaatttttataaccggtgttactttcggcaagtaaaataagatgataccgctccgaatcaagctcataggttttgtcaaacctagttctggcggcaacataaacctcacagcccaaaataggctttaccccaattttttttgcatactcgtaaaactcaataacaccatacatatttccatggtcagttattgccattgcttcctgtccaagctctttagctcggtcaagcaccttttcaaccgtgccttctccgtccaaaaggctgtaggccgtatgcgtatgcaaatgcacaaaaccatttatttccgccatattcatcacccttattgtcaaccgttaattactgtcaagtataacattttagtatttcaatgtcaataatattgcggctgttaaaccgcctgattatacgaccagtacggaagccgtttaaggcttattgatgaaaattgtcggattgttaaaaaaattgcgaattcatattgacgatttaaatttttagttatataatgtaatagttaattatttagttaagttttacttagaatagatgttgaggtttataaatataattatatggtgaaacctatgaccaaataataatttatgaaatattaatataaaaataataaaagaatatatatattgtggaggagaaaaaaatgagtagagtttacaacttttcagcaggcccgtcaatgcttccgctggatgtgctgaaaaaagcccaggaagaaatgcttgatatggggggaagcggtcagtccgttatggagatgagccaccgcagcggcgaatatcaagctatcattgacaaagcagaagctactttccgtgaaatcatgaatatacctgacaattacaaagtattgttcttacagggcggcgcgtcaacacagttcgccatggttcctatgaatctcggaaacaagtctaaggtcgctgattatgtgacaaccggacagtgggcaaagaaagcgctggctgaagcaaaacgctatattacagccaatgaaattgcttcaagcgctgacaagacattttcttacctgccggatgttgacaaaagtatgcttactcccggcgcggattatgtacatataacttataataacactatttacggcacccactataacacgcttcccgactttggagacgccacaatcgttactgatatgtcttcatgtattttatctgaagaagttgactttaacaagtttggtcttgtgtatgcgggcgctcagaaaaacatgggtcctgccggtgttaccgttgttgtcgtacgtgacgacttaatcggaaacgctatggacatcactcctacaatgcttaattatgaaacacacgctaaaaacggctctatgtttaacactccgccgacatacgctatttatatttgcggtctggtatatgaatggataaaagacatgggcggcgttaaggttatgcacgaaaagaatgttgaaaaggcaaagattctttatgacttccttgacaactcaaagatgttcagaggtactgttgttccaaaagaccgttctttgatgaatgttccgtttgttactgattctgatgagcttaatgcaaaatttgtttcagaatcaaaggcacagggcttcgttaatcttaaaggtcacagaacagttggcggcatgagagccagcatatataacgcaatgcctatcgaaggcgttaaggcattggttgactttatgactaagtttgaaaaggagaattcataatgtataaaattaaaacattaaacaaaatctcaaaaaagggtctcggaatccttggaaagaattatgaaatttctgacgactgtgaaaatcctgacggtatcatcttaagaagttttaagatgcacgatatggagcttccggaaagcctgagggctgttgccagagccggcgccggagttaataatatccctcttgataagtgcagcgaaaagggtattgttgttttcaacactcccggagctaacgcaaacgctgttaaagagcttgttatctgctcgctcctcctgtcctcaagaaaagttgttcagggtatcaactgggcaaagacattaaaagatgaaggagatcaagccgcttctttggttgagaaaggcaagtcaaactttgtcggtcctgaaatttacggaaaaactctcggagttgtaggtctcggcgcaatcggcgttaaggttgcaaacgcagctcaccacctgggaatgaatgttgtgggctacgacccttatctctcggttgactcagcatggcaccttactagatttgctgaaaaggcaaccagctttgacgaccttttggctcagtcggattatattactatccacgttccggctttgccgtcaacaattggcatgtttaattccgaggcttttgcaaaaatgaaaaagggtgcaagactgcttaatttctcacgtgacaccttggttgatacaaccgatattcaggcggctttagaggacggaactgtttcatgttacgtaacagactttgctacggccgaccttctcaataacgacaaggttatctgcatgccgcatctcggcgcttctactcctgaaagtgaagaaaattgtgctgttatggcttctaatgagataaaagactttttggaaaacggaaatattaaaaacagcgtaaactatcctaactgtgacatgggcgaaaagaatggcgaacgcatgactgtggctcacaaaaacgttcctaatatgctgaagcatattactgacctgattgcagcaaaaggagttaatatagacaccatgctcaacaagagccgcggtgactacgcatatacaatgcttgaccttcagggcaaaattgacccggctatcgcaaaagagattgaagatattgacggggttataaaggttacacttctgtaaaacgcagaatttattcagttaattattgagtataccagatggttgcgtggcctaatcggccgtgaggaaagtccgagctccatagggcagagtgcaagctaacggcttgtggaggcgactctaaggacagtgcaacagaaatataccgcctgtttttaacaggtaagggtggaaaggcgaggtaagagctcacccattgatatggcgacttatcaatgctgtaaaccccactcggagcaacacctgaatcgaaggctaagccggcccggcatcttcggagattggtggctagaggcgtgtggcgacacacgttcgagatagataatcatcattgacagaactcggcttattgtatgctcaattaatttaaaaatcaagactgtggtttatgccgcagtcttttttgtatacagctttcaattttgactatcagtattttatatgttataataattttattattaattataaggtgatgaatatgaaaaaaataatatccgtagttattatattaacaattctattatgcagttgtgttaacgctcctgtttcagcctttgagaagaacggcgacgtctacactacagatatcggagcgttgattgacgagcagccaatcaagtcatacaattatcaggaccatacctatatatgcgcggaagatttgcgcggttacggctttgatgtggattggaacaacgaactcagaactttgagtatcgagaaaaacaacagcattgaccgaacatcgctgagcaaagatgaaataaacattttaaagtctgatattccgttatacaccaaaattgcagaggtatattcaaccgatataaaaacttatttaagcggcgaacttaccgaagcctgtaatatagacggtaaaactctgatacagctttcggctttaaataaatatggttatgttgaatacgacgacaacagccgtcttgctaaattaaacacagtaaagtatcaattggataatgcttttgaaaccgctgaaaataaaaccgaacttgtattgggaaacggaattacttattacggacaaaccaaaaacggtgttcctcacggtataggaaaaagatttgataagagcgtaatgtctgaatttccgggtacaatttctgacatggaatatttgggctattttactgaaggcaccgaaaacggattttattatgaatccggtaccgaggaatacacaatcggaagttatattgctaaagacgaatatattacattcggcaataaggagcttggtgataatttaggattccagcattcatacagcacatatcatttttggcctacagtcaacgattcaaccacttcaaccattgacaggcgcgatggttttattcgttccgctgttattgacagcagctatctgtatggtataaacgtttcagaccttagcgttataaacaacggtgatttaaatgtttcaaaatgcgattatttgcccaagtttgacagattcggaacaaacaattattcagaaatatctgtaatagatgaaaatgataatttatataccgcaccgttttctactgactcatataaaaacgccgtatacagacgaagaaatatacttgacggaaactacagcgaaaactggctgttggctaaagacaataaactgtatataaaaacatcggatgatgagactgaagacgtgtgcactgttgaaaacgccgtctccgcttcataccaaaattacattgataccgacggaacactttgggaagatgttggatacggatataaaaaaatagactgtgatgtaaaacaattttccggccaaagctatgttatttatctaaaaaatgacggaagcgtttggacatatagaagcgcgcccggtccgggaagcgaatggatagacaaaaaggactactcagctccggtaaagcgtgccgacaatgctatgtcagttgcgactgacggcaatacatactactacataaagcaagacggaagcttatggggattcggcgcaagctacggcggacaactaggatatattgaaacatacagtttcgagacatatgattatttatcatcgatgtccaactacacctctcctgtcaagctgggagacggattcatcaatgtcaaggcagcaaacaatatctgttatgcgttaaaatctgacggttctctttggggagcaggagaaaatgaatatggtcacattctcaccgacagtgatgaaaagaatgtgctaaacatggtcaaaatcgcagatgatgttaaagactttgcgggagggagttcgattatatatattataaaaacagacggttctctcttataccgcggcaaaccatactatcggtcaatggtaaatggagaatacacaaatactatattctcagattttacccgatgtgacgctgtatatgaacctgtgcaataaattttgttataattatttgaattagtacatattatttttatattctagtttttaaaaaaatttataaaaatattattgacaaattttataatatatgctatattgtgcttgataatctgccggaaaggaatatacataaatgtcagacgacgacagtgacagtagtaatttaattaatttaatatgaatatagggcacatccgtattggtataattgatacggttgtgtccttttgtgtttttaagttcttaccggcagaaaatcaaaattttatatgttcaaaataactatattaaaaaaggaggatttaattttgaacagcaatttaacaggacaaatcattttacaagcagtgcttatagccatgaacgccatatttgcctgcgccgagatagcggttatatcaatgagcggcaaccgtttggataaactggccggagacggcgacaagcgtgcgctcagactggcaaggctgacaaaccagccggcacgctttttggccacgatacaagtcgctataacactttcaggatttttaggaagcgcctttgccgccgacaacttttccgatatgcttgtaaacgcaataatgaagttaaacctgcctgtttccgaaaaaacactcgatactatttcggtagtattgattacaataatattatcatttttcacacttgtgtttggcgaacttgttcccaaacgtttggcaatgcgaaaatctgaaagtatagcgctggcaatttccggtttagtatctatgatttcaaagctgtttgcgcctatagtatggctgcttaccgcgtcaacaaactctatcctgagactgctgggcattgacccgaatgcggaggatgaagaaattacggaagacgaaataagaatgatggcaaacgccggaagtgaaaaaggcgttatagaccatgaagaaaatgaaataatacaaaacctgtttgagtttgacgacatgcacgctgacgaaatagcaactcacagaaccgagctcgatgtgctgtggactaaagacgatattgacaaatggcatgaaacaatcaccgcttcggaacattcatattatccgatatgcgataaaaccattgacaatattatagggttattagacgccagaaagtattttatactgaaaaaccctacaaaagatataataatggaaaaagccgtagtaaaggcgtatgctgtgcccgaaagtatcagagctgacatacttttgcagaatatgaaaaaaagtcacaattatttcgctgtcgtaaccgatgaattcggcggaacatacggggttataaccataaccgacctgcttgaaaaacttgtgggagatttatatcaagaagatgatgagtttaagcagctcccaagcggtgaggttataattatgggaaagaccgatttagacaagtttgaaaagaaatacaatctcaagctgagttcagactccgctactgttggaggctgggtaactgagcagttagggaggcttccgcaaaacggagattcgtttgaatatgaaagtttatcaatcactgtgtcaaaaacagacaataaaaaggttattgaaataaacgtgaagtaagttatattttaatataacaaatatgttatataggttaagtcatcatataaatagttttatagaatctgtgacggaacaataaccgtcacagattttttatttatcatattgttacgctttcagctatgatagtttttataataaagtgtggttttgtaaatttatttcttaactatagttttttaatatttgctatacagtcctgacatatatatttattttggtattttataagattttcggtttcgcaacatgcaatacagaaattttctgtctttctgattcttatttcttcacctctcataattatagatacttcgtctttttttctaatttgcatttcgtccctcatgtcctggggtattactattcttcctaaagcaacagattaaatctgtattatatataatattattaatatttttagacaataagatatagattaatatgacatataaattttaaatgtatttacagctaacgacgttttctatcataaaatatttcatattaaaatgctattagtgaacttcggcagggcgcatttatgcgcctcgttaggtgagctgccgccgcacgcttgcgtgcacatatttttttaattatcttattaaatcaaatgtaatgttagattatattcctatttttcatattttaaagtatagtcaatcatacctgtttttgaactaatagtttaatttatgcaatttttatattttcttctttcaatttatcactttttttgttaccgtcattctaaatgacgctttcgctaaaattacaacaaaatagtgtataatacaaataatataaaaaatcaatttttaggagaatatatatgtttgaaaattttataagggaaagaataactgagttgcgaatgagaaaaaatgtatcagaaagatgtatgagtttagatatgggacgttcagaaggatacataaatcatatatcatcaggaaaagctatgccgtcaatgagtgaattttttgaaatatgcagatattttgaaataacgccatatgaattttttaatgaaaatataaagtatcctgaaaaaatacataaaataataaatggaattaataagcttaatgaaaaagatacagaactaataatcagtctaatagaaagttataaagataataacaaattgaaataattattatccttatataactcactcaaaaggaatttgatttaaacattatgattaaaaagctttatatttactatgtatatgaccccatataaaaaattttattattacataataaggtgtttgaaccatttctttttctcgcaagaaaaagaaacgcttcaccaaagaaaaagtgcttgctcgcttaggtcgcctgcggctccaaggggcgctcgcccccgctaatttcatcttgaatctgcgcttcaagatgaaaaagccttgttactttcccgttgactttttgaactaccgtgaataaagattttccgagttcttattaatttaattaaaaaaatagagattctatttaatttaactcataaaaaagctgggttttcagtgaacttcggtaggcttgtgttagcaagcgcgttaggtgagccaacatctgaacacgcagtgttcaatatacaaatcatattaagttttttctagtttatatactatcattaataaagatattacgagaatggacagagctaactcaaaaagaatttgccgaaagcataggtctaaaagaaagaactattagaagttatgaagctggagatactatatataatataaacactttaagaaaaatctctaaggctcataaaattaaaataacatttgaaaaaaataaataacactaataataaaggtttaaaaactttatattttctttgtatatgaccccatataatatatattattttacttataataggtgtttgaaccatttctttttctcgcaagaaaaagaaacgcttcaaaaaataaaaccatctgtaatttaggaactaattagaattaattatttaatataaataaaatttgctactgcgcgcctaacgaggcagattacatctgccctgccgttgcttgcagaaaatattttttatacgagtatatatttgtaaaaataaaaccatctgtaatttaggaactaattagaattaactatttatataaataaagtttgtgactgcgcgccttacgcggcagatttcatctgccctgccgttgcttgcataaatcatttattatataatcatttagatacttcaaagaaataatattatatttccttattattaataataattgaatgataaacattttttgatatagatagtaaatatgaatataaaattgtttaaatattataattatcacaaatacttttagcattataagcatttttattattacaagtctttttcgttattgcaatttgtttaattattataagtataatatactctttaaaaatgatatttgcaagcttcggcagggcaaatgtaatctacctcgttaggcgcgcagtcacaaattttatttatattaaataattaattctaattagttcctaaattacagatggttatatttttacaaatatatactcgtataaaaaatattttctacaagcttcggcagggcagatgtaatctgcctcgttaggcgcgcagtcacaaattttatttatattaaataattaattctaattagttcctaaattacaaatggtattatttttacaaatatatactcgtataaaaaatattttctgcaagcttcggcagggcagattacatcgccgcattaggtgcgcagtcacaaattttatttatataaataattaatttaattagagcctaaaatacaagtgattttatttttactaatattataactcttataaaaaatgatatttgcaagcaacggaagggcagatgaaatctgccgcgtaaggtgcgcagtcacaaattttatttatataaataattaattcaattaaagcctaaaatacaagtgattttatttttactaatattatatactcttataaaaaatggtattagcaagcaacggaagggcagatgaaatctgcctcgttaggtgcgcagtcacaaaatttatttattatagaataatttgttcaaattagagcttaaaataaaaaatataataaacaaaaattttaacgattatatttataacagttttataataaaatatttttgattggaaataatataatagttcttgcagatttaaaatttttaacttttgacttattattttaatcgttttagataataatataataatcagttttaaaaaagtgtttgataaacaaagttgttgtaataatgtaactgtttttagaataatataagtttataaggaaataatatcaaaagaatttataattaaataatttatggaggacatagtatggatattattgcattgattttagtcattattggaggattaaactggggacttgtcggtatttttcagtttgatttggtagcgtttttgtttggcggttcggccagcatcatcagcaggataatttatacgcttgtgggtctcggcgcattgtggagtataacatttttcttccgtgatgaaatcttgtcaagattcaaagctaaaaagctggattaatataataagttatatgccgtgtttcttaagaaacacggcatattgtatattacttaatttgtaataatcagtttatacttccggcgctgttagcgtctgaccatttctgttcaagctgcacccagtcgggattccgtcctatatatgtccaggtctcgtaagttgaaccggcagggcgttcgtaatcatgggtattggttgcttcctgaacagcagtgtaataccattcatttttgtctttgttatctgcccatgtcttcatatttttatgaagaccgcttgtgcgtacatgtctgtttaaaacattgttgacaagcgtcatagcttcggctcttgttatgagctggtcaggtttaaatgttccgtcttcatatccttgtatccagccttcctcagccgcgatatttacataattctccgaccagtgtccgccaacgtcgccgaactttccggttccgctgtagactacatcgctaaatcttgcagcaattgttgcgaattcagctctggttatataagctgtaggcttaaaatacgctgtgccgtcaccaccgagaattccggcttttgtaagagtggaaatagcgttgttcgaccataagtcagccgggacatctacataatagttaacttgtgaccaatactgagatctggatttatcagtaagcagtctaaagaaaatagttgccacttcatctctggtgatattactttcaggtcttatatatccgtcaggatatccgactatatatgcaaagtggtcgtaagtattaaggttaggtttcggcgtggctgtaggtgttgttcctgtggagtgacctgagttgcctccgcccataaccgaagttttatagaactgatgtgagatagtcatggattttccgtcttcgcttatattaactatatctgctggcttgttatttatatatgctgtcattgcgccttcatctttagagaaagtgtatccatcgttagcgtggagggtcacagcggcagtataaacggtgccatagttaaaattgcttcccggatatactgttgggtcccattccgcttggtctgatgtgtaataggaatttcccggaatcttgacatcaaagcttactctttgatttgaagcaggagcttttatctcagctgacgcatagcgcataacaaatgtcagttcttgttttgccagcctgtttccgtatatgatatttataaacctgtctccggaatatacgtcaatatcaggtatttccgtgtctaatcccggtttgaatgtgaaactgtcttttgttgtttcgtcatatacaacgtttgaacttgttccgtctgtatttattatattgagaactaatccggttgggtcaaatttttctccgttgatatattccgtttttgtcggaggagttgatatttctatatggtctattgtgcttgcgtcttgtgtgacaaccgttccggatatgtcatatccgttcacgttcaggcttatgtcactgtttttcaaatcaggctcttttccttcaattgctatagctgaaatatcataagctccatttggtacagaagcagtaaataatactttatctgctgtatctgtggctctaaccatttctgtttcggaagctgtctctttatttataagtttaacatttgtgatgttttcatcagcatttatagaaacaagataaagaggttccggtgtttgggttggtatgtttgcggttgcttcaggagttggaatcggacttatggaagcttcagggtcaaaacttggtgttgcagtagggtctgaacccggttctgttgaaggtgaatttgtcgcttcagggtcagaacttgcagctgctgttggctcagcggaaggaacaaaagttggctctgctgtcggttcaatcgtcggttctgctgtcggggttgttgttggatcgggcgttggctccatggttggttcggctgctggatccaaagttgaagcagcagttggttccgacgtaggtggtgctgtggtcgtttctgcaggaggcagggtgggaataattgtaggctgtaatcccggtgtttccacagctgatggagatgcggaggccggctcaggcaaaatattaaatgtcactgccggcatattagaagtttggtttactgcgccgttattttttacaaaatattgtctcggattattagaagaagccattatccctgtcttattgtttttcaggtttgcgatattaattttatacccggaaaatatttcgtggttttcatttgttgttccatcatcttttagtattataaaatctgacccggtatcactggtattatatttgaaatcaaaaatggcgttaacatatttataacgggtgtttccaagccgtataggatttgctgaatttttaaagttgtttttgactatggatataaccgcgttatctgaaactgagtatatgcttatagcgttgttagctatatttccgaaattgttttcagaaaacacactgccgttttgaacttcatatatcccattatatccggtttctatacaattgaaataagcattgtcggcagctttggaaaaatcatttcctgaaactgtcagttttcctttaaccgacaaagatacaggcgttctgacgccgttgtttatgtatgaattttgggctgtaaatttacagttttttaatgaaaagtcatagtttccggcggcgcttataaatccgccgtcaccaaatgtaaagccattaatggtaaccgaggattttaattcggctttttcgcctgaggttataataacccgttcattggccggctcaattacatcgccatttttagcagattcaacggctgtttttagagaagtataatatgtatttccaattttggcggtgtaattattagttggttcaccggcgtatgccgtgaagaaggagaacatagatataaacacagttattgtcagcatcagaggcagaaaacgcagtttttttatgaaagtttttttcattttttaatccctctttctaaaataaattttttattatatatataataaatctataaccataatgaagttcttaaaaataaatttataagctttcgtataaaatcatcccaatttgtcgaaatgcactaaatatatttttaaaacaacacttagttagtatatatgacttctgttattcgaaaaaagttcccaaaatttaaaattttttctaattcataaaaatataaataataattcaacagaaaaatcggccgtatccgcaaaagcgaatcggccggtttttaaattttaatattcaaagtttactgcaattttattagtttccgcatctgcatccacagccacagccgcggtcattcttaccgcaattagaagatgtgaaatcatttgtctttgtcggcgggaagaattcgtctatcgggaatctaacgttatcaaaaagatcacatggatcctgaggtgtagctccgacgcaggtcttttccggaatacagaaatcaactgcatctatcaaaagctgaacttttctttctattctaacgatagtgaaaagacctagactgacaagaactttcttgatgttgttagctataacaagatcttcgccataacatgaacaaatgtttgtaggaatagaaacatttgtgtcacagcagcagcatgaatcgtcaacaaggcgtgcgctgagagctattgggttaactacctcaacagttattttaggcatgttgttgcttttccagatatgttccatgcagtctccggggtcgattgtagattcaaaactctttgtttgaccttcgcttccatataacataacgcgtttgtcataggttacaagtccgtgaacttctgtaggagcacaaacatccgagaatgcttcaatagtaacgtcaataaagtattttatgtctactgaataatagcctgagctatataatacaggttctgtgtctgtgtacacccagataatttccgcctttttaagtttaacatttattgcgctttctattatttcctgaccgcactctgtgaagtaaacgcgctcgtcaacaacgcaggttctctctctgcatgcgtcataaactttgtcaacgctcacacaaaccggctcagaaaattcttcactgcgtcttcttttgcattcgctgttctcgctttcagtatcctgaacagttccgggaacacttacaggctctgcagctgtttcagcattattacagccgcagctggctgcgcgctgtcttgtaaattcatttttgcagctcataatcaaaaatcctcctaaaatatttaatggtatgcggctttgccgtaacctcaatatattatattgcagcttccgacattatgttacacaaaaatttaattatgtttaggcacagctttttatataagtagatttagtctgtatttatgcggaaatatttgagtatgttgaaatatatataataaaaattttttatgtcatgatgtttattataattttcaatatattttgattcttaaaaattacagttttattgttattatatataagtttttaatatttttttaagtttttagcttgaagtattgtataaaatgctatataatgaaaaatatgaaagtaaaaatattttagagggggtatttttgtgcatttaaaaaaactattagcttttgtattaacatgggttttaggtattgcagggtcttctgctggtatggtaacagtttttgcggctaacccgtgggacggtatggtagaaaccagcgtactggaaaaagtaacggataccactaacagagtggggacagacggaacatttgacgggtatattcaaaccgttcagggtgcggatttgctaaacagcagttatataaaagttacatatactgtaacgggtactgtgaccgatgatacggaaattttcacagttcaaccgtttgacaccgcctggggcggatggaatgataacaagataaagataggcgattctattttatcggacggtgtttacacggcatatttgtcggttgctgatgtaaaagcttcgctcacctcaggaactttgaaaggaatcaatatctcgtttttagaaaactcaggatatgacgcaactttaaccgggtattattatttggctcctgagacagaagacccgggcgtgatgactgataaaaaaagacttaaattaagtcttgattactgtgccgggatggatgagtcaaaatatcagcctgattcctggtcaactttccaaaaagcggtaactacagcccagtcagtttataacagttctgttgccgatacaaaatatgccagtgctagagcagatttagaaaaagctaaatctaaacttttgtttgttgacagcacggaatcttcaaatccaatggattttagaataataagcggtgataacactatatacgaaatgggtgttggctggaatcttggcaatactatggacggtcatacaggttttcatccggcagaaacagcatggcagagtgttgtaacaactcaggaaataatcaaggctgttcatgacgctgggttcaatacggttcgtgttcctgttacatggggggatatgattgacgatgaaaatggttatgcaatcaatgacgcgtggataaaccgtgttcaggatatagttgattattgtacctcgcttgatatgtatactataattaatatccatcatgacggagcggagcaggacggctggctgagagttgccgctgacgatatagataaggtatatgaaaagtttgaatgtgtatggagacatatagctgagcattttaaggattatgacgagcatcttatatttgaatcggcaaacgaactaacttgtatggaaggcagcgacaagaattcgtctgctgctattactaaagatacgcctgttatagtgaatttaaatcagatattcgtcaatgtagtgcgttctacaggctcaaataatactaaacgctggctgtcagcagtatctcactatgcaaatggtggaacgcaaagcggattcgcattgccgactgattactataattccagcaaccgtcttatgttctcagctcatatatataagtcaagcactaaaactagctggacatattcagaggtatatgaggttgtatcggctttgacaaagatggtaaagaaacataaagttccaattatattgggagagtacggaaacagaaataagatgaacagtgctaatccgagcggatataatgacatagacagggcatggtttgatgaaatagttactcgtgcttgccaggttggaaaggttgttccgtgtgtttgggatcagggatggtttgatttgacccagaagccggattcaacattctcagtttggaaccgtgagggaaacgctccgatatttaagaccatcaccgacgctatgatgagaggcgtctatctaactccgtcaagcaaaaataagagttatgatatgactgatatagctatcaatcctgctataaccaatataaccgatatatctttatcagacgccaatattgatattgagtatggtgacagcgtcacagtaagcgcagaggttcagccgttgggaacaaatgacgttctgctgtggaaatccagcgacgactcggttgctactgtttcaagaggaatgataagaggaagaaagataggatacgcgactataacagcattttcgcagagcggctctaaagaggcggaaatgactgtcagggttcttcctaaaaattcagataagcaaataacctcaatattaactgacagtgaaagctatcaggtgatgaaagataaatatgttaatatgagtgttttggctgagcctgccgataatactgattcattgatttattcatcatcaaatccgaaggttgcaactgtcaatccactcggcaaaattgttggtgtttcagctgggcagacatatataactgttatgtcttcaagcggaattacaaaaacggtgccggttacggttacagagtccgcttctgatgaatctatagaactggcggcaaatgtatattataacgatacgctttatgctgcaaatgagataggaacgccgataaaggtaaatggagacggacaatatactgtttcgtttgatactgcagtcgatttgtctgataaagctaagactgccggtataaaatatcttaaaaacttgacctcagtttatataaaggataatgcagtagcaacaggtcaggctgtaaaatcaccgcttgacagctgtgatataagatatgattcaattaagcttgacggggttccgcttacaataaccaagacggactttaagtcagctttaaaagacaacagcgtatttgatacaaacgaccctataaacggttgggatggttccgcggttaaagaggtatcgtcaagtaaccataccgttaactttacttcatcggatacaccgtcaaagattgagataacatttacacttcaaaacctaaaattcacgccaaacagttctgacgacagcaagccggctgagaagcatgaagctgtgtctgataaaaggatagttttaaatgccggtgatagttttgaaataaagacaaaaatttctccgtctgacagtacgtcattggtgacgtttgtgtcttctgatgagagtgttgcaatggttaaagacaatgctgtttcagctgataataacggtgtttgcacagccaaacttacagcgctcagagaaggttccgcaaagataaccgctgttactgataacggacttacagttgaatttgacgtgacggttggaagtatggcgtttagcaatgctaaagccgttatagacggaggaaaagtcacatctgttactgccgatatgaattatgctcctgaaagtgatatattagcagtagtttgcgtttatgacgctgacggcagaatgagcgtctgcgattcaaaacctgtcggtttagataatatgtctaacggaaaacttactgtttcaggttttgatattccggtatctgacggacagacagcaaaagcgtttatttggaattcgtttgaacaaatgataccgcttagtgattaaactgacttctttattatgatcaattaaatataactccctgggagatacggaaagtgcagctctgttttcatagacagaactgcatcttcgatattttcccggggagttatttatgcaaaatttacgccttacgcaatatactttgtcaagattttgtcaaatgccccaaactgttttcagaaattaaaaaaattaaattatcctgttgcataattataattttatgatataattatcacagtaagcggtttcaatcgaattttggcggttttgcagccgaaagggtgcatttgtatttattttttttgcctaaatcggtgttccgcaaaatgaaaggagcaaacatatgaagtattcaagtgaagtagaagcgatgtgccccttggcgaagggtgcgtatcacggtcctgcgcctattcctcaggagggaaaatggacgcaggctaaagaagttacagacatttcaggcttgacccacggaattggctggtgtgcacctcagcagggcacatgtaagcttactcttaatgttaaggaaggggttatccaggaggcgctgattgagacagtaggctgcagcggtatgacgcattcagcagctatggcgtctgaaattcttgtcggtaagacaattttagaggccctcaatacagatttggtctgtgacgctattaacacagcaatgagagaactgttcctacagattgcctatggacgtactcagacagcattttcagaagatggactgcctataggagccggtcttgaagatttaggtaaaggtcttagaagccaggttggtactacatatgctacacttgctaaaggtcctagatatcttgaacttgcagaaggatatattactaaatgtgctgtggatgaaaacgacactattataggatataagtttgttcatctcggaaaaatgatggaaatgattacaaatggtatggacgcaaacgaagctttggaaaaggcgagcggtcagtacggacgggttgacgatgcagttaaactgattgacccgcgtcacgaataagaataggaggaatttaaatatggctttatttgagagttatgaaagaagaattgagcaaatcaatgcagagctagaaaagcatggaatttcttctattgaagaagcaaagcagatttgtgacgataagggtgttgacgcttatcagatagtaaaagatattcagccgatatgttttgaaaatgcctgctgggcgtatacggtcggcgctgccattgctattaaagacggatgtaccaatgctgctgatgcagccgagaaaataggtcttggtctccagtctttctgtatccctggcagtgttgcagatgacagaaaggttggaataggtcacggaaatttgggcgccagactattgagagaagagacaaaatgctttgcctttttggcaggtcatgaatcttttgcggcagctgaaggagctataggtcttgcaaagagcgctaacaaagctagaaaggaagacttgagagttatcctgaacggtcttggtaaagacgcggctcaaattatttcaagaataaatgggtttacatatgttcaaactcagtttgactattacaccggtgaagttaaggttgttaaggagataaaatattcagacggcgagcgttcaaaggttcgctgctacggtgcagacgacgtgcgcgagggtgttgctatcatgcatcttgagggcgttgatgtatctataacaggtaactcaaccaatccgacaagattccagcatcctgtagcaggaacatataagaaagaatgtatcgagcagggcaagaagtatttctcagttgccagcggcggcggtacaggaagaactcttcacccggataatatggcagccggtccggcttcatatggtatgacagacacaatgggaagaatgcacagtgacgcacagtttgccggctcttcatccgttcctgcccacgtagagatgatgggacttataggaatgggcaataacccaatggtaggcgctactgttgcagtagccgttgctgttgaagaagctatgaaataaatataactgcgttgattcagcttgctttatatgggttgaattgaagcggctgaagtgttatatataataaaaataacagaactgcccgcgttttgcgcaccaaactttactggtgagcaaacgcgggcagtttctatatttgcagatatttaatggaagtgtataaaaatattatttttaagcagatgcttatatatgttttatgcaatatattgtaaaggctgcaataatatgaagagaaataaaaaggctgagtaatataaataattatataaaaatgtggctagcaagcgtctgaggagtaacttttaccgtatctgaaagatgtgtacagtcgcaatgacactttgacttagaacctacaatgtcaataatatgaataggcaaattatgactgcgactgtaagatatatgtagcccaaataacactttatataaaattggttaggctacaataaattggacacaaatgttaaggtcatatatcataaaaataatattaatattatataaaaatgtgctcttgcaaacatcggaatgcagatgaaatctgccgcgtaaggtgcgcagttgcggaaaaatttattagtaaaaaggattatggcaaactgtttaaagtttatactaggtgtgatatggcagcttatctaatgagatgtgcagcaacataagattgacaaaccctagttggatagtggataataagagtaataaaattgtggaggaatgggatatatggatagaaaagagcttgttaatcaaagtattgactatataatgcagcatttagataaagatttatcacttgatattttggcttctgaattttatatatcaaaattccatttcagccgaattttcaaagaagaaaccggtgaaagcgtttatgcatttattaaacggtgtaaggttgaccagagcgctgtagatataaaactgaacccagctaaaacaattacagatattggattggattacggatacagttcttccaattatagctcggtgtttaaaaaacatcgtaatatttctcccactatgtttaaacagtcaattccggctaatagtatgacagttccgtttacaccggagagagttgttaattttaaaactgcagatgagtattccgcacgaattgacattcaagaacttaataacttttttgtgatttatgagcggtttattggaagttacgaagatattgaagagaactggtatcagtttttagatagatataatatttatttaaatgaaaatacagttctggtggagcgattttataatgaccctgctataacaaatctgtcgcagcgtatttgtgacatttgcatgacggcagaccgaaactgtaatttgaataatgttacggagattaaaggcggcaaatgtattgtgtatcattatgatggaaaaatcgaagatatttatgagatattacaagggattttcagtgtttggatgcctcaaagcggttataaaatgactcagaggtatggattgaatatttatcacggcattgacagaaagagtcatagagttgttatggatttatgtattccaatttaattagagcaagaattcagaagtcagaagatatatttatttatataattaatggtgttcagtaatacttcaccggagtggatttggagctcatataccaaataagttaataaagaaacattgtatagaaaataaaatacaaattactgttcctaaaatattattagtgtttagaagtacagtaatatgtgttttgttagaaattctattaatcaataaatatttaatatatggaggaaactatgttcgatattagaaaaattcaagagaatataatttatgaagctgtaagggctgaaagcaatgaggatatagcgaatgaagtggtgtatggtaaagacaatatgtcaaaagcagaaaataattctgattgggtaaagtcatcaatgattcgcttagaaaacaattttgaaaccgaaacaataaagaaaataagaatgaactgtcaatgtggttacgaaatggacgaaaaaattgcacttgtaatggaactgaagtcagattcatcaaatatagaagaatttgcaaatgcagagaaagcaaaagaagccgggcttttttgtaaagacggagaactttttctgcaatttgatttttgcccttgtccaatgcttgccgaagtggataaattagagacaaatacatggtgtcagtgcactacaggttacagcaaggttctttttgaaaaggcatttgattgtgatattgatgtagaattgctcaaaagtataaaaatgggcgacgatatttgtcttatgaaaattattttacataacccggtctggcaatgatatatagcaagcaattatcagattttattttaagagaagaaaatgaataataaatatgtttaatttcaaaattgaaattaagtaaaaaaacaaaaaacggatagcaatttaaatgataggctgtcttttttgtttgccgtataaaatagttgaagttagcggagagaaaacaaatttgagtataaatgatatatgtaaattttattaactattttcatattattagcttttgatacgaatgtttatcataccataaagcaaacaatggcaatagtatttttataatcttatatcgtggtgttttaaaatagaacatccattcaaaacagattctaaatatatgttttgaatccacgcacccataaagggtgcgacaattttgcaccgggattatcattcccatatccctcgtttcaatccaacatcttccgttttgtttgatgttcttactatcataataaagtaaatgtttatatatttctatttgcatattgttgcggaaaatgacactgattttatcagcatataagtttatttttaatcgacgtttttactcaggggcgataattcgttgtgtctgcgcattttgtatcaaatattctatctgtactgtacagaacatatatgcaattgaacacacaaacttagtgtatatatctgtatattgtataataagtgttttattaaaattattcataaatgaataacaattttacagacatatagatttttttgaaaagcttattttaatcaagagtgagtataaggtatgataataaataagatttaattttgaattggaaatgtaatttcagtctatttctatataagaagcaacggaaattgccatttgtatagtggagcaaacatggttgaattaacattcttctcatgagatgttgcatatcttaaaatattggttaaaaagtagataaataatatatacgtatttatattggagacttttatgattattttgcatgtaatagattatagttttatacatacccagtatggcagaatttttcacatttataataaactgttttactattttgttccaaaacatatatgatatagattaaaatatatgtaaatttacttaatgtcaacgtaagtttctgccaatagcagaggggaagccacaaaatttgtataggcgattttgacctatgagtttttaataattttatttatctttaaatataagttgagactataaagttaatcattatttgtacaaagatagaaatatcaatccacaaactcgcataggacgacgatacagagatttaccaaagtatatacgtcgcatctacgcactcgtatagagtgcgacacgattgtccgaaacacactattgataagtattaactaatttaaatccacgcactcatatagagtgcgaccggaatacaggtgtaggaaaattgacttgacacagagatttcaatccacgcactcgtgtagagtgcgacatacttttttgtgcaaacatcttaacatatgggtatttcaatccacgcactcgtgtagagtgcgacagcaaaaatatataaaaataaatttgttaaggtatcatatttatgtatttttatattaaataagaataatatatattaaatgtattctataccttagtcatatttaaaaaatacttatatatttctgtttaaaagtggtgcgaatctccctgacattttatgggagcttcaggttcgcactattattttagatatttttaatactgctttatgtttctatttttttgttttttacttggttttaaataattcgataaaatagtttttacataatattttcaattctcaaataatattgttttataatttataaaatattgaacattataaatcttttcttctattatacaactcttttcaatataagtaaatatatttttacttttttatcctattaaataaaaatcttataactcatatttataaataattattattaaaattaaatttatcaataaaacaagctgtttgtatattaaataatttatttttataatttataaacatatattttttaaaaagtacttgattttcatgaatatatagtatataatattatcgacatatgtcggtaatggaggtgagttatgtcaagaccttttaaatgcagaagaatatgtgaagaacctaagtataacagctttgcaccgcttggcgttgaaaatcctgagaaatgtatgatttctgttgatgagtatgaggcggtaagattaattgaccttgaaaaaaagacccatcagcagtgtgctgaacttatgggagtttcaagagttacggttacagatatgtatgaaaaggcacgttttaaaattgctgacagtattgctaatggaaaaatattatgtatcacaggaggaaactatcggatttgcgaaggttcggtaaacaaatgctgtggaaaaaggtgtaaaaaattaaaatcaataaaaaatttagttgtaaagaaaaaaggagaaggtaaaatgaaggttgcagtaacttatgataatggtgaagtgttccagcattttggacatactgaaaattttaagatttataatattgaagacaaaacgataattgacgccaatgttgttaataccatgggcagcggtcacggggctcttgcaggctttttagttgaaaatgaagttgatactttgatttgcggcggtataggaggaggcgcccggaatgctttatctgaggcaggtatcaccctttatggcggtgtttcaggaaatgctgacgacgctgtgaaagcattgatagatggaaacttgggttataatcctaatgttaaatgcagtcatcatgaacattcatgcggcgaacataagtgcggagaggaaaagcacggctgcgaaggcaaataagataatgattaatgaaataagtataggaattttataataaattctgtgatttttataaatttgcaacatatgttttaacatgctatataattaatttgtatttaatgggctgctgtacgaattcagcagtctttttttattatcacttatcttaaaaccaatttgtaaaatatcatattactattggtgaacggaatatgtttttgaagtttttataataatcaaagttattatattaataaattattgtaaattatttgcaaggttaacagaaaactagacagaaaaattaagagtgttttttgtaaacaacggtatataggataatattttaaataaaaagttatataaaaatgaggtatagtatgaattgtatggctttgactgaacctgaaagacgggtgtgattcaaagtgacttgttttgattaatttacaatgtcaataatcagacttagttgtgaaggcggatgaaatctgctgcgtaaggtgcacggttgctgaaaatttattataataaggtttataatgaacttttctaagtatgtttgcgcttagcgtgatatgacggctcacctgtcgaagcgtgcaagcatgcactgccgttgtttgcataaaacacatttaattatcttccaattattgcagcctttccaattatcgggcgtcttacattaacagctgactgtattaaaataaaaaataattaatgaacaatttgaatatatttgacaaaaaaatccctctgtgaattttcacagagggagagaactttttatttaaataatcagtattattaagtgagattatttaaattgtttatatgattaatatattcgtcttttgtatagaagtttaagacgtcgatatctgtttgcagttttttgagaatttcggcggtcgagtcagaagaaccataatcgacaaccgaaagtccgctgactgttatgtttgcgtttccggaagtcaattttccggataattgtctcaagagcccctccacatcgttttcctgattcttgacaaatacgacaagctcagacggaacttcagtttttttctcatgactgagcccttcaacgataccataaaggaatgtaataagaccaattatcgcaaatataccaacaaacaccaacaagatttgatttatcatactgccatcaactccttgatagtagtataatatgctaaaaacctctatttgtgatgatatttatattaatacattccgccgcctgcgcccatagcagcagctgcagcagcgtctgctgccggatccggcttatcagctacaacgctttctgtagtaagaatcatagacgcaatgcttgaagcgttctggattgcgcttcttgtaacctttgtcgggtctactataccaaatttgagcatatcaacatattcacctgtaagagcgttgtatccaacaccaacttcgctgtcttttatcttattaacgataacgcttccctcaacaccggcattgtatgcgatttgtctaacaggctcttcaagagcgttcagcacgatttgggcacctgttttttcgtctccttcgagtgagttcataagttcttcaatagccgggagagcgttgatatacgcggtgccgccgcctgctacgataccttcttcaacagctgcacgtgtagctgcgagggcgtcctcgattctgagcttcttttctttcatctcaacttctgtagccgcgcctacttttataacggcaactccgcctgaaagcttagctaagcgttcttgaagcttctctttgtcaaactctgatgttgtttcttcgatttgagccaatatctgatgaactcttgcattaatgtcatctttgtcgcccattccgtcaacgataatagtattttcttttgtaactttaacctgacgcgcacggccgagctggtttgtctgagtttcttttaagtcgaggccaagctcatctgaaatcacctgtccgccggtcagaatagcgatatcctgaagcatttcttttcttctgtcgccgaatcccggagcttttacagctacgcatgtaaatgttccgcggagtttgttaacgataagagtagaaagagcttctccttcgatatcctcagcaatgataacaagctttttgccttcctgaacgattttctcaagcagaggaagaagttcctgaatgtttgagatttttttgtctgtgataaggatgtaagcgtcgtcgattacagcttccatcttttcggtgtctgttaccatgtaaggagttatataacctctgtcgaactgcataccttcaactatttcagaatatgtctcagcagtctttgattcttcaacagtaataacgccgttgtttgtaactttctccatagcttcggcaataagtgtgcctactgtttcgtctgcggcagagatagaagctacgcgggctatatcgttctttccgtcgatagccttgctgttttcaacaattttgtcaacagctacgtcaacagctttcttgataccctttttaactatcataggattagcaccggctgtaacgtttttcagtccttctctgactagcgcctgagctaaaagagtagcggtagtagtaccgtctccggctacgtcgtttgtttttgtagcaacttctttaacaagctgtgctcccatattttcaaaagcgtcttcgagttcaatatctttagctattgtaacgccgtcatttgtgatgagcggagcgccgtatttcttgtcaagaacaacgtttcttccctttgggccaagtgttactttaactgtgtttgcaagctgatcaacaccgctctgcagtgcctttcttgcgtcttcaccgaactttatttcttttgccataatgcattacctcctaaaataatgtataagtctggattaatcaacaatagccaaaacatctttttggctgatgataacatactcttcgccgtcaagtttaacttctgttcctgcatatttgctcataataaccttgtcgccggcttttaattccattttaacttccttgccgtcaaccactccgcctggacctactgcaatgacctcggcgaactgaggtttttctttagccgaacctgctaaaataataccgctttgtgttgtctcctcggcttccgccatttttgtgactactctgtctcctaatggtttaatgttcattttatatgcctccttaaatttaattatctaatctgttagcactcgtcttgtttgagtgctaacgctattctactcgttttcagtctataaatcaaacttaattatctggaattatatgctattattgtcagttatattcaattataatacaataatcattgatttctaattttttctatacaattacaattaaaaaagctagtctcttcggtataaaagaggagggtgccgttcgattttcataagaataaaattaactgctgaaatgttggatggtatttttatttagcagtatcagattattcttattgtgccttttttatactgcataccgcctgagcggaaattccctcgcagcggccctcaaaaccaagtctttccgttgtggtggcttttacgctgacgcggtctgtatctatattgagagcagaggaaatattgctgcgcataagctcaataaacggtgcaagtttaggttcctgtgctgctatcacggaatctatgttgattacagcataaccatggtttttcagcagctcgcctacatgtttaagcaggtcaatgctgtccgcgcctttatattctttgtcggtatccggaaaatgttttcctatatcgcctagcgctgcagcaccgagaagagcgtccattaaagcgtgtattaaaacatcagcgtcactgtgcccgtcaagacctttttcgtatttaatttcaactccgcctagtatcagctttctgttttcggtcaacttatgcacatcatatcctatgccgactctaatatcattattattatttgtcaatataaattcactctccttgcggtaatattatttgtacagtcaaatgtgtaaaagcggagacggtaatgtctgtttttataatttagaaagtcatgggtttaatattttgttattgtttaaactgccagtctgccaagatattctccgagaataatgcccgaaagacataggatgacactgagtattgcgtaaattgttcccaaaaaaggttcgccgcgctgaaacagttgtacggcttcaagtgaaaatgttgaaaacgtggtaaaaccgccgcatacaccggttttaagaaataacaaaaacttttttgatataaatagattatccgaaagtccgacaataaatcctattaacagcgcacccagcaagttggttatcagtgttaaaaacggaaaggtgttgttaacaggtattaaacttattaaatagcgcagcatggatcccagtgctccgccgagccctaccataataaattgaatcagcatattggtctccggtggatatatatcacatccactttttctttttaaatattaatatcagaaacaaaactatcgcggcgcttactgcaattactgccgggtatccgtaaacggatttaaattcaggcatatcaaaattcattccataccagcctgccagcagtgtaagaggaagaaagatagctgtgacaacagtgaatactttcatcagattgttctgacggtaatcaagctgtgactgataagagtcgagaaccattgctatgtagtccctcagattgaccgcgtcgtttaagagatggtctatgcgccgctgtattattccgcagtaccgcacgccgctgtctgagagcaaatcattctcatttgccaggagctcgtcaaatattagttcgagctgttggtagtaacgtttaaaattcagcaggtcttttctaagagaaataatcttccttgtaaaatctttttcttctcctgaaataaattcatcttcattatcagtgatacggagttcgtattcatcaagccatgccatatcgtttttcagcagcctggcaaaaaaatgatacaggagctgttcgttgttcagcgaaccgtccgaggcggcagttccggcaagttcttcagcgaccctaagcataggctcttcatgacatataaaaaatatattttctttgtcgagataaattgtgattttagaatcttgtttatcttttatttcatggtagttgaaagataataaatcgaaatcttcaaagctgcaaaaaaattctatctgatgtctgtcacctgataggagcttttgaactttgtcgccgataattccgctgatttcagatatattgctgagcgtaagtattttttgcatggtatgacaaccccagtattatgtattgttttgaattttagcgatgatagcttccccaaggattatatcttcgggagtggtgatttttatgttattataatctccggttatgactttcaccggttcacttgttaaagcttcaataactgcacagtcgtcagttacggagaggttcaattctttggcttttttatgagcttccataataatgccatatctgaatccctgaggtgtttgtattgacacaagtttgctcctgtcaggagtgttttcaatatatccgcgttcgtttgtttgcttgattgtatcttttacgggtacgccaatagcagcggcctttgacgagccgctgcggagttccgatataatttcttttatataatccgctgatacaaaaggtctcgcgccgtcgtgtatcagaacaatatcatcattgccggaatttaaatgagacaaaccaagaaaaacagattcctgtcttgtgcttccgccttcgattactgcgctgactttttttatattgtgctcagataccagttttttgattatttcaatatcacattttctggtaacaattaatacagaatcaatttcagacagaaactcaaaaacatttatggttctgattataacaggaatgccgtcaagctcaataagctgtttgcttatattagttttcatacggctgctgctgccggcggctacgattattgctgtagtcatatattaaatcctttcgcgctaggaaattttgctcataagcatatcttcaatgtcagaatacgacgagtttttggacaaaacgagctcagaaatcaatatggttttagcgttgctgagcatttttctctcagcgtttgaaagactcttctttctgtctctcattatcaaagtttttgttactcttgcgatttcaaacaagtctccgtcttttaatttttcaagattatcccggtatctcttattccagttatcatcttcgtcgcagctgcatttttcgaagtcattgatgacagcgtctgcctcgttctcagatactatatatcttatcccaactttttctatccttgcgacgggaatttttatctctagttcaccaacgcagggctctaaaacaaaatactggtgttcctcaccgagtattttctcttcctcaacacattttataatacctgctccgtgcataggataagagactttgtcaccaatttgaaacataaaataacatcacctttctaaattttgcataaaatagatttcaatactcaaacattgtgagtacgtagtctgtttacatccgtttaaaatatatctttcattacctgtgttatattcgagtattgacagatttctatatttttaaactttttccggtcttttgctcccatataaggaacaataatttttttgaatcccattttttcagcttcaattattctgctctcaagaaaactgcaggaacggatttcacctgttaaaccaacttcgccaacagcggctatctcttccggaaccggcttgtttttgaagccggaagccagcgctatgattattcctaggtcggctgcgggctcaaccattctgagaccgcccacaacattgatatatgtgtcataagatgacagatgaagcccggcgcgcttttctaaaatagccagcagcatcatagctctgttgaagtcaacaccggtggtcattctgcgcgggttaccaaaagcggttggagtagctaaagcctgaatttcagcaagcacaggccttgttccctccatagtgcatacgatacagcttccgggaacaccctggggtctgcctgataacatagctgacgatggattttttatctcagacagacctgatgaattcatttcaaaaacgcctatctcatttgttgaaccaaacctgttttttattgccctgattattctgtatgaacggttttggtcgccttcaaagtataaaacgcagtcaacaatatgttccaaaaccttcggtccggctatagagccttccttggttacatgccctaccaaaaaagttgcgatagaataggtctttgctattctcataagcatggaagctacgtcacgtatctgtgaaacgctgcccggggcggaattcacgttggggttaaacatggtctgaaccgaatccacaatgagaatatcaggcttttccctggatatacattcaagtatgttttcagtattggtttcagagaaaatctttatattgtcactgtccacacccagtctgtcagcccttaattttatctgtctgagagattcctcgccggaaacatataatattttctgcgtttttccaatgtgctgacaaatttgaagcagaatagtggattttcctatacccgggtctccgcctaaaagaaccagcgaccctgcgacaagacctccgcctaaaactcggtcaaattcagacagtcctgtgcctgttctgatttcgtcagttgttgatatgtttttcagacgctcgggaaccgctgagtctcctgcgttttcaagagccgaaatagcgtctgatttcatgcctgagcgtgaagatttacccggctgttttgtaattactgtctcttcaaccaatgtgttccaggagttgcaggctgtgcattttcccatccactttggaaattcgtttccgcattctgtgcagacaaaaactgttttggttttcattaatcctccagactcagaatattttaaacacttcatattaaaaaatcatgagttcttacttatatttatactcatttattataacacataaatttacttttgtctaatataaaaaatcacaattttttgtgccggttgtttattgttttatcttaattttgccatttttttggcaaatatggcatatatgatgtgtgaattgtatatattagtatgtgcaattgttagaaaaatgtaataatttcacacttgatatttgcggtctaatattatataatctctctatattgtaaggggtgaggcttgtgcatacgtacgtattggaaatcattgtcgatttcttagagcttttcctcttttttattggtacgtattatgtcgtctgcggcgtattctcttttgttaaaaggaatgacgtcttaagacaagattttcggacaaacagattcgcggttataatacctgctcataatgaaggcgctgttttgggccagcttttaagcagtatttcggcttcaaggtatccaaagaataagtatgatgtgtttgttgttgccgacgattgttctgataatacggctgctgttgcggggagttatggagcgagagttcttgttaaacgtaccggtaataacaataaatcgtccgcggtttcatacgctgtggagcatataaagagtttgagagaagaatatgactgtattgccgtatttgacgcggataataccgtgcatatggattgtataatgagaatgaatgagatgcttaactgcggatattctgctgttcaaggatatgttgacagcaaaaatccgaacgaaaactggctgacagcggcctattcggtttggcatactcttgaaagcaggcttgctaaaatgtcgtgccataacctgggaatagggtgtaaaatatccggaaccgggtatgctgtgaggtttgatgttgtgaagcgctgtatgccttctgacgactgccttgccgaggaccttgaatatactgtcagacttagactgatgggaattaaagttgcctttgctaaaaaggcggtggtatatgatgagaagcctgctgagttcggtaagtcggttaagcagagaatcaggtgggctcagggcgttgttgacgtccagggcagatacggtggtcttttgctcaaaaaaggaaaaataatagactggctgagcctttatggagattttttgggtcagttctgttatggagtttttttggtcataagtattttctccacaatttctattttgtttggatatcagtttgctttatgcagtttgtgggttcgtcccgtctgctatgtggctcttaatttatatttgggtatcggtgctcttagtgcctttgccgggcttatattggaaaacaaacttagccggaaaacaattttcaatttatttggttttctgctctatatagtaagctggataccgattggaatagtcgggatctttaagcataacaagaaagagtggtatcatacggaacataccggttctgttcaatagcacagtgtgtgcagaagctattttgataaaaattatattattttgtgatagatttgtatgatggcaatagctgtcaatattttttggaggttaattttatgtgcggaatagttggatacgttggaacaaagcaggcggcgccgattttgcttgacgggctgtcgaagcttgaatatagaggatatgattctgccggcgttgctataatgactgatgaaggaatagtggttaagaaaaagaaaggccgtttggaaaaactcagcaatatgatagacggtggagacgcaataaaaggcactatgggaattggtcatacaaggtgggcaactcatggagagccgtcggatatgaactcgcatccgcatctcagccagtcgggtagatttgcggtcgtacataacggaattattgagaactatctgaagcttcgcgagtatcttacaaaaaagggttttgactttatttcggaaaccgataccgaggttatagcgcatctgtttgagtattactataacggcgatataatcgacactatgattaaggttataggcaaggttgacggttcttatgcactgggagtgctttgcgccgacgacccggattcttttatagctgtcagaaaagaaagtccgcttatagttggtctcggcgagggcgaaaactttatagcgtctgatataccggctattctgaagcatacgaagaacgtttattttcttgaaaacaacgagattgttgtcttaacaaaagacgatgtaaaaatttataacaccgaccgcgaagaaatttctaaggaaacttttgttgtcgactgggatatttccgccgctgaaaaaggcggttatgagcactttatgtttaaagagataatggaacagcctcgtgccatagctgatactgtaaacccaagaataaaagacggcagaattgttttggatgatatatctttaacagctgattatatccgtgatataaacaagatatatattgtggcctgcggcagtgcttaccatgttggagtagttggcaaatatgtgattgagagcatggttcgcatacctgttgaggtaatagtagcgtcagagttcagatattgcaatccgcttgttgatgataagactttggtgattttgatatctcagtcgggcgaaactgcggacaccattgcggcaatgagagaggcaaagcggttaggggcgagaacatttgccatagttaacgctgtaggaagctgtatagcaagagaggcggatgacgttctctatacatgggcaggtcctgagattgctgttgccaccacaaaagcgtacagcactcagctgacagcgatttatttgatgtctatatatatggctcaggaattggatatgctgacccctgaacttttggcaaaatatataaaggctcttgaaaagctgcctgataatatttctaaacttttggaaaacaaaggcgagatacagtatatagcgtctaagtattttaacagcaaaagcgtgttcttcctgggaagaactttggactacgctgtggcgcttgagggttcacttaaattaaaagagatttcatatatccattctgaggcgtatgcagcaggagagttaaagcacggaacaatcgcattgattgaagaaggcacggttgttgtagcgctgtgcacagtcaagaatttgtttgataagatgctgagcaatataaaagaggtaaaagcccgcggagcggtagtaatagccgtagcggaagaggggcatacggaaatagaaaaagaagcggattatgttatctaccttccaaagtgtgacgagctggttatgcctagcgaagtagtagtgccgctgcagttgttttcgtactatgtatcatcattgaaagggttagacatagataagccgagaaatttggcaaaatcagttacagttgaataataaatattaaaaagcctgcgtttgaggtgatccaaaagagttagaccaaaaatctaacaattgggtcggctcatttgcaggctttttttattgtattttaaagttttaacttaatcggcttcccagaaagggaagccgatctcgcccgggttcggcgggcgaaacagggtctggcgcagcaaagtaagtaattaaagaataattaaatatttttatattcgtattacactttgggtgcatttacatagacaaaaggtctattagtacgcagtttacacagtcatatatataattagtatattaattattttaaggtcacagagtataaaaatatgttcgggactgcgcgccttacgtggtgtactccgtacaccctgccgatgcttgctatatacatttttttgtattgacagatatataaaagcaattcttatataacagtaatatcggtgtatagttgctggataaattaattattaacaaattgtaatattgggtcatataaaaggggagcaaaaaagatgaataataaatttttaaatagcaaattttctaagagagaaaaaagaatacgcaaaacttattaaattgaggatgaattatataagtttttagaagaagcttctttaactcacggtgcctctgtttctgatattttatatttatgtatatcagaattagttagaacgaatgatttaaaaatttatactgctcctaatatgaaaaatccattacataattttaatatagcagtcagcaatgtaaaaggtcttgcaaaattaagtgagaccaccccatttactataaaatcattagtaaatatgtctattaaaaatatcatatagttattattatattataatataattcttaaaattgtggctataatcataaaaaattattataaattaattactatattattgtagattttaataacatttgtagtcgtattttgttagtcgcttaactaaaattatatattttattttgaaagtatttgtattaaatagtatgtatgcagattaataaaggtctattgtaaatatgatagatatttaatagcagcaatattattatagcgaagaaaataatatttcaataactacacaaaaataatctgaatatatgaaaacttaattgaaaaacaaaagaaagaagtaatacaaaaggcataataaaaacccgccgttagaaggcgggttttaaataccatagtaaagtatagcacaaacaatatcttaatttatatattttataaggtcaacaagctgaataaactcatgcttaaatccaaattcatcttcaccaacccctgattgcgcttgtttaattacattttcaagtgtagccgatcctttatattctgaatcatttaaaatcattccaagcagggctgctgcggaagcgaacttgaaattctcagacggattggaatttatatttgatcctataggctcttctataagcttgctttcagtgccgtcagggtccttatacctgattttaagatacataagctcgtcagatggttttgcatttgtatcccggtatctgaagtcctgcgtttcagtcccgtctgccggaacaatttcataaaaagcggttacaacagccccggcgccaagttcaccggcatccttttcgtcgttttcaaaatcttcattgttcagtattctattttcgtatcctacaagtctgtattctttaactttagatggattaaattcaacttgaagcttaacgtctttggctattggatacaaagtctttatcatttcatcagctaatacttttttggcctctttgatgttgtctatatatgcgtagtttccatcgcctttgtcagccaaaatttccattctgttgtctttgtaattcccggttccaaaaccaagcacgctgacaaatattcctttactgcgtttttcagtaaccagttgctcaagttctgtagttgaagaaggtccaatattgaaatcaccgtcggtacataatattattcggttgttaccgtcttttaaatttttctctgccaattcataggctttgtttataccatcatatccgtttgttccgccgcatgcctgcaatgaaaatacagcattttttatagtttctttatctgatgcgttaacgctgtctaaaactatattggtgccgtttgcgtatgtaacaagtgatattgtgtctcgttcatcaagtctgctcaggagcaaattcaaagatttttttacgagcggaagtttgttttctgaaaacattgaacctgaaacgtcaatcaaaaatactaaattgctgggtttgcgttcttcgattggaatttcgtctcccttaatagaaatcatagtcagtttattatcagaattccatgggcacacagcagtttcagaggatactgagaaaggtgttccatcttccgggagaggatagtcgtaatcaaagtaatttatgagctcctcagttcttatagagccgtacttcggcacgtgtccatttagaataaaccttctcatgttgctgtaagacgcagtatcaacatcaattgagaaagtggaaaacggtgatgtaagaggatttttaaaaatattttcgtcttcttttgtatattcctctgtgtcaaagcccggataccacggaacagaagaagtgctgttagatgagtttatcgctgaacctccgcctccgtctccgcttccgtttccgcttccgccggatgtactgccggttacactttgttgtggagtgtaattataattgttattattagtctcatcctgtttagctttttctgcattgctgatttcagtttttagatttaaaaagttttttatattatatgcaatattgattgcgtcactgcgtgatatagcttgttcgctaagcgcttgaaccccgtccataagtccgttatctattgcggctgcgatataatctaaaggataatttttattggttgaaataattcctgttgagacagccgcaatctttgcggcttctttaaataaaatgttttcatttggcataaaggcttgattttcatagccgttaataatatttgcgttctttagcggcattatatagttataagcccaaaaatctgaattaatatctgaaaattctaaagaggtatcatcaaagtttagtattgatgaattttctgattcaagaacttcatagattaattttgaaaactcggcacgagtaaccgggctgttaagttgtaaatcgccgttttcattgcctataactattcctgcattctgcatagttttaattgcttcatcgctttgcgccgccatagccgcagaagatgaaagcagcatagccgaagcaaccaataatgaaatctgttttttcatgacataaaacctcccatatgatttatgttatattagacgaatcaatcaaatattagttcccaaaatatgtaaataatatatattttattattcaaaaaatttgattattaactcattaaagctattgattatgttttaaatggaatattacgaacaaataacatattgcaagcgatataaatttattatataaatatgtcaagtttacacatttttatttttttcggcaaaaaaactttagacaaaattttatttttttcttatatttaactcttgcattttattattgaatgtattacaattatactgtatttttgttgttaatttatatttatatatattggaggaattgtaatggaaaaacttgaacagctctacgaaggcaaggcgaaaaaagtatttaagactgacgaccctgaagttttaatggttgactacaaagatgacgcgacagcgtttaacggtgaaaaaaagggtacaatccagtctaagggtattattaataaccgtgttaccaaccatcttatgaagatgcttgaagagcgggggattccaactcatctgattaaagagatttccgatagggaaacattagttaagaaagttacaatagtacctcttgaagttataatcagaaacgtagcggctggttcattttcaaagagatatggtgttgaagagggcaaggagttattggctccaacgcttgagttcagtcttaagaacgacgatttgggcgacccgcttatcaactcttatcatgttttagctttaggtctcgcaactcaggaagaaattgacactatagctgggtacgcgtttaaggttaatgaaattttaaagaagtatttgcttgatttgggaatcaaacttatcgactttaagcttgagtttggtaaaacaagtgacggcactattgttcttgccgatgagatttctccggatacctgccgtttttgggataaggacacaaatgaaaaactcgacaaagacagatttagacgtgatatgggcggtgttgaaaacgcttatgaagaaattatgaaacgtttaatgggtgaaactgtttaaattataaaaatatacagcgtcagctgaaatcgtttaggaggtttcttgtgagtaaacataatgagatttttggttccgattcacttcatgaagaatgtggggttttcggtatttatgatatgggtgataatcttgatgttgcccggcttacgtattatgggctctacgcactccagcacaggggtcaggagagctgcggaattgctgtaaacaatattgacgaggacggaaaaatccaaattctgcaatataaggatatgggactggttcaggaagtattcaatagttttgtgttaaatgagcttcagggctgtgcttctgtcggacatgtccgttatacaacggcaggttcaagcagccgtgaaaatgctcagcctcttgtttccaaatatcaaaaaggtacgtttgctttggttcataacggtaaccttgtggatatagataaaatcagaaaagagctggaagataagggcgcgattttccaaaccaataatgacagtgagataattgctcatctcatggctaaagaacgtattaagactaattccactgccgaagctatgatgaagcttatgggtgaaatcagcggagcatactctctgattataatgacgcctaagcgtatggttgtggcgcgcgaccctcaaggattcagaccgctgtgtatcggtaagataaagaattcttatgtatttgcgtcagaaacctgtgcccttgattcaatcggggctgagtatataagagatgttgaaccgggcgaggtcgttgttgtagacgagaacggactcagttcttacagggatagatgcggacagccgacagctacctgtatatttgagtatatctattttgctcgtcctgacagcatgattgacggcggaagcgttcacgccgcaagactgaatgcaggtaagtatttagctcaggaaagtcctgtggatgcggatgttgtaatcggcgtaccggattcgggaattgacgcggctttaggttatgcaagagagtcaaaaataccgtatggcgttggatttatcaagaacagatatatcggaagaacatttattaagcctactcaggaagaacgtgagtctgcactgaggataaaattaaacgcaatgcgcgaagcggttgacggaaaaagagttataatgattgacgactctattgtaagaggtacaacctcaggacgtatagttcagcttctgcgcgatgcgggagctaaagaggtgcatgttagaatttcatcaccgccgtttaaaaatccttgttattttggtacagacatagccgacaggaaatatttgattgcctgtaagatgtctgtcgaggagacttgtaagcatataggcgctgactctttggcatacttgtctatttccgctttatcaaagattgccgagggaacaaaatgcggcatgtgcgacgcttgctttaccggaaaatatccggtgtatgttcctcaggaaaataatagataattgcccttttgcggcttacagaaaggtaaaacatatgcagaatgaaacaatagtaattatcgactttggcggacagtataaccagcttatagcaagacgtgtgcgtgaagcaaatgtgtattgcgaagttgttccgtactcaaaaactgttgatgaaataaaggctttaaatcctaagggaattattttcaccggcggacctaacagtgtttttgatgaggacgcgccgaaggtggattctcaagtttttgaactgggtattcctatcctgggtatatgctacggcgctcagctgatgagcatgtcgctcggcggtgttgttcaccatgccgatacccgtgaatacggagtgacggatataacactcgacacaacaggagttctttttgacgggattgcagataaaaatcaatgtctaatgagccacactgacaaggtgtattcgcttcctgacggtttcagagttgtggcaaagacagatgactgcccaatggcggcgtttgaaaacgcagaaaaaggtttttatggcgttcaattccatcctgaagttaatcacactccgtttggcaaagatatgataaaaaactttttgtataatgtgtgcaagttcagcggcgactggactatgtctgattacgcaaagaattatatagagtttgccaaaaataaaattggggataaaaaagttctgtgcgctttgtccggcggagtggacagcagcgttgcggctgttctgctctataaagcaataggcaaacagcttacttgtatatttgtggatcatggtctgctgagaaaagacgagggcgaccaggttgaggatatattcactaatcagtttgacatgaaccttgttcgcgttaactgtgaagacagatttttggacaagctggcaggagtgtcagacccggagactaaaagaaaaataatcggcgaggaatttatccgagtctttgagcaggaagcaaagaagattggtacagtagattatcttgttcagggaacaatatatcccgatgttatagagagcggagcaggcgacgcgtctgttataaagagccatcataacgtaggcggcttgcctgattatgttgattttaaagaaataatagagccgctcagaagtctttttaaggacgaggtaagacagctgggaatggaactgggaattccggagtatttggtatggagacagcctttcccgggacccggacttgcaataagatgtatcggagagataaccaaggacaggcttgagatattaaaagacgccgatgctatattcagagaagagattagcagagcaggactggacagagaaataaaccaatattttgcagtgttgacaaacatgagaagtgtaggagtgatgggcgatgagcgtacatatgactacacaatagcattgagaggggtaacaaccacagacttcatgacaggggagtgggcaagaatcccatatgatatattggatatagtaagcagaagaattgtaaacgaagtcagtcacgtaaacagaatagtttacgacataacttcaaaacccccatcaaccatcgagtgggaatgatatcacactcgcctgaaagccagtaactgtgcgggttacaccgttctggatatatcttgtggcaacgttttggcaacacctgcaacataaattgtattgttccataaatatagagctaactgatttgatttatcagttagctctttttgttggggtctttagacgtggaaaaaaaccttcggttctaccggaggaagataaaaagctttagcataagaaaaatctccatgatataatagtaaatggtttggcgaccgcattacaaaaaatatatcatggaggtttttaataatgttaaagaagagcacaaatgaaataaagagcacagcacactcaaaatacaggtgtcaatatcacatagtatttgcaccgaaatatcggagaaaagaaatatatggtcagttgaaaagagatataggagaaatactccgaaagctttgtaaacaaaaaggagtagaaataatggaagcagaagcctgcctagaccatatacatatgcttgttagtatcccaccatatataagtatagcacagtttatgggatatctcaaggggaaaagttcattaatgatattcgatagacacgccaatttgaaatataagtatggttcaagaaatttttggtgtagaggatattatgttgatacagtggggagaaataaaaaaataatatccgaatatatcaggaatcaacttgaggaggattatgcatcggatcaaataagcatgaaagagtatttaaacccgtttacgggtagcaagaataagtaggcaaaaaatacagccgcacgtgagcggctgcctgtgatagtaatgcggtgtcaaacttctgtgctccttacaggggttaagcctgtattagccccttataggggctgtgcaagccaccagtttactggtggtcttgacttaccaaaataaggaggtggaacagcatggagaaaataatatttgattattactatggtaatcaggcggagcagtacagcttttaccgtataccaaaaattctttttaaggataagacgtttaaatcactatcaaccgatgcaaaggtattatacggatttatgcttgaccgaatgggattatcagttaaaaacagatggtttgacgatgaaaacaaggtatatataatctataccttaaaaaatattatggaggatttcgggtgtgccgataataaggcaacaaaattattgaatgagcttgataaggaaacaggaataggcttgatagaacggagacgtcagggattggggaagactgatattatatatgttaaaagctttgttataacgccggagaaccagcacgaatccggaatcgtgaaaatcacgagcaattaatactaatattaataatactgagtataacaatactgataataataaaactgagtatataaatcatcaatcttatctatcgtgtaatacagcaagtgaaactttttcaatggataggattgaggattatgaaaaatacagagagcttgtaaaaagaaatatagagtatgagggattaattctgcatgaggaaaaagaggtaattgacaacattgtggatattatggcggatgttctgacttttccggctgaaagctattatattaaccatgtacagtatacggctcctgtggtaaaaagtattttcatgaaaataaattacacacatatcagcaatatgcttttggcaatgaatgaaaactgtacgaagatacgaaatgtacgcagctatctgatagctgctatttttaattcatacagcacctcagatgtatatattgactggcgtgtgcgctatgatatgaaaaaatgagagagtaggtgatagctattatggagaataaaatattaaaaaccggaaatggagacaatacagaaataatacagactgtaaacatatcagaactaaagccgtatgagcagcagccgtttaaggtattgattgatgaaagtatggaggagattatggagagtataaaacaaaatggggtattatcgcctattattgcaagacctcatagagaaggcggatatgaaattctttcagggcacagacgtataaaagcatgtgagcttacgggaattacatagattccggttgtagtaaaaaatcttgacgatgatacagcggcaattttactggtagacagcaatttacaaagagaaaatatcctgccgagccaaaaggcttttgcgtatcggctgaagctggaagctatgaaacgtcaaggtgaaagaacagatttaacatctgcacaatttgtgccaaagttaacagcacgggaacaatttgctcaagaagctggagtaaatcttatggaaattacaagttacatacgccttacgaatctaattgacccgttacttgaaatggttgacgaaaagaaaatagccttaaatgcagctgttgggttatcctatttaggcaccaaaggaacaggcagaggttctaaattcaatcgaaaaggaggaggcttcaccatctattgcacaggctgcaaaaatgcggcgtttttcacagaatggtaagctaaatcccaatgttatagattctattatgcaggaacagaagccggaaaagattaaaataacattggcaggtgataaggttaaaaagtatttcccggaagattatactgaaaagcagatagaggatgttatgataaaactattagacgactggtataaaaagcggcagcgtaaaaaggaatatgaacgttaaagcggtatctcatgatattaagggataccgcttttatagtggaggattttatggatatccaaagaataaactcaggatatttaattataaatcaaattaaggttggcgaaatagaaattgtgctggatgttcaccccaaattgcctaatagctttgttacatggaaatgtaaaaacggtgactattactattgggggaactatcatacaagcctgttgtcggcccaaaaagatttctgtaagcgtgctctatcagaaataagaaacattgaacagatatataaaaaacaaaagcaaatagaaaacgagaggttaaggcatgattaatagacctgttagcattccgctgttcaattgtatatatcaataataacttaaatataagaaaatcacatttgtgtgcgattcttttgtgcgatagaacgatatacgttgacatttatggtgattattgatataatattttgtaagattaaacaatgtttcggaggtgtcttaaatgaggaggtggaattatccattcatatttactatttatacatccatatttatagtttgttttatgctcgtctaaatttttatctgtcgtttttataattgcgataccaccctgaaaaattattggattcaatgttatattaccatcataatctataaatatttcatttgatatatcattcgatatatcgtaatagtgaaatgtagttccaaagtcatatacacctgaacaaatatacattccaggactaaactgttcttttggaataacatttttccaatctaactcaatatttttccccacaatatcctcaattgtcatatttcttataacccgttcacttgcaaacacattactacaaaaaaatgaacatataacaactaccaataccaatatttttttaaatatattttccatttataaatttatcttcctttctaataaatttttaatcttcataaaatcttttataataccatcctagagaatatctatctaaaatattagtgttatcagcatataatataccgtttcagttttttattcctacgcttgtccagcttttttggggttaccggagggcgtaaataattacgccctccgtaacaattttagtttgtataaatatctactctttgtaattcttcgtcccattctacctgacagccgaatgcttctgatattgctctcaatggcactaatgttctgctgtctcctactaatcttgcaggtacatccaattttatttcttctccatttttttgcatcctattactgtcaattgtcactgatactgttattccatcctttgttgctgttgccgtttgggtttcattttcccattctacttctgctcccaatgcttcaaatattgctctcataggaactaatgttctatctttttccgttattggatatatatcaaaatttaactgcttattgtttatatatactgtaatatttttcggcttgctagactgattcacttttattttatctggattaactaaatttgttttcttcattatattaattttatcggtactaacaatatataaactttttaatatgatttcatttaattcaacgtttgactcagattctatattgacaacaacacttccatccttgtttaccgcctcttcatcatatacatttatacttcctaatttattaaaattttcatcataaaaggttcctatactacatatcttatctcctatactgcggaacaatttactactagatctataaaattgttttgtttctgataaggtcttgccttcatttgaaacaagcttaatatttgctaaagaattatatcggctaaaatcttcaggttctgaaaaaatgacatttccatttgctaatacatttatataataaaaatcattaactggttctaattcaggaagctgtaattcatatcgataagattctttgccatcatgcccaaatatacgataaatttgtttatgcgtatactctccatttattttttcagggtacatatgcactaaagtgccaccattaaaaataaactcgccatcattaaaatcacattcatttccaatatcaatttttacggaatttaaatctgtatccaaataaaatatttcattattttttaagtatgccgcatatccatttctaaacactgttcccggattgtcagaattttgaccggtaaaatagaagtcatctgccgctagacaaacttttccattaatatctattaaataactttttccggacacttcttttactaccccatagccatttgaaaagtctgaagcataataataatttttatctgtaatccaatcataatctttatttatatatccttgtttatttccactttttattctggcaattccttcacaaaatatatttggtattttataataatcactacaggaatcataataatctttatattctgtaatatttccattatagtctatatatatatacctcgaattatctttattattgatttcataatcttgagcaaataaaatcacgccatttttatcagtattcataatactaactacagaagcattttttaaagtatagtttatatctattttttctactattgtatcagttttttttgaaaactcctcataattattcatcgaatagactggtaaaactattaaatttaacattattataaaaacaatagcatttatatgttttaacaaatttactcctcctttttatttttttatccatccaggtgcatatatattcaaaagatttgggtagtttgtgtagtacagtggttgtttaaaattaccattgtatgcattaatcaacatcattctatctagatctgtaaccggaattaaagcatcattcataacagttggaacaatacccacattttctatgtcaaaataagcatccttaattttgaatgcactgtgtcctccgccttcatgtgcgcatacgtttattatatctattaatgcacgatcgtttggatcaatgcgattttgataataaatattaaaactatatcccggagatgaactttgatccctatttccatatacgaaattggccttaactgtcttgtttgtattactttttccatatacaacatttacatttatatttattccattaacactaccagaccaactttctatgcctttacaaagaatttccttaaatgtaattccacctgagtttaagtactctatatcacctaggtcatctttatttaacatcattgaatagttttcttgcgtataaattccttttaccttttctccagaatccaaggtcgccataatttctatagattctatatttgcataaaccgttatgttcaaatcacttcccaccatttctgctactacagcaggtccctttgccaattcacttatagttcctccgttaagtgctaaattttctaatatatctccataggataaaactccatcatgatatgcatttatagctgagttcattgcttttttctgttctaatgttaatttatcttcattagtacaataattttctatactatccaatccaaacgggtcaacgaagttcacaagattattaccgcagtatgcgtaccagttcagtccgtccattaccgggtcttcttgtgtgaaccttcctgtttccgggtcataataacggttccttaagtatatcaatcctgtctctttgtccgtatactgttcccggtacttcctttgtgcctccaaacgcgtcatactcgtatctcgtcagcatctttgttcttgtgttttctaaacctgttatgtctccgtgtgcattatactgacaataacttattcccgcattatctttctgcgctatcaggtttattcccatatagtataccgttggattctctccagcttcgctcactatattgcttccgtcccagcggtgggtcgttgtctttccgtttactgttttgctctctcttcttcctgtcgggtcatatttatatattgcttccgtcttgtcgcttttcattcctatcagctggtttcttccgttatagctataataccttacatattcctcgttttcaaaatatccttttcccagctctatttctctttcctctccctctattactccgtcatactcttctattcctttaaacaataggtttccgttgttgtcatactcgtatgatgttatcttctcatacatgctgtttatcggattcgtctccctttcctctttcagcctattgttcttgtcatatttatattctatctccgacgcttcctcatacacatcactgtttgactttaatatcctgtttcctcttgtgtcatactgataatatgtattattataatcccattcatcttctttgggcgaaactacattttcagttatcagctgtcctattccatcatatccatatcatactgataatatgtattattataatcccattcatcttctttgggcgaaactacattttcagttatcagctgtcctattccatcatatccatagtttgttatctcctgtcccgacgcttttacagtttgatttcctgccaagttatagctgtatgtatagctctgacctgaactatttttcatctctgtcaccaatccggctttgttatatgtatactcgcttgttatatttcctcttgtctcctttgttagccttccattcgcattatacatatatcccgcgcttactgttccgtaatctatttctgtcagtctgtccaatatgtcatatgtatatgaccctgtcagtattgtgtttgttcctgctttttgtgtataatttttcctgtttccgtttacgtcataactatatgtattctgaatattcccttggctttctgttttcatatagccataatcgtcataggtgtattttatctcttcctttccttgtttggttgatataagaagattattcttgctgtatgtattgattatatcttcgtctcctgtcaccttgctcgtcagaacgcttccatacgcattatacgtatttactgtttcatttccatttttgtccgtttgtttggtcggcagtcccattaggttatattcacttattacgtcctgtcccagtgcgtctgtagcttttgtcacatttccaaatctgtcatactcataagtttgatacgttgcttcttccggcagggttccatacaaatcttctatcttgcttgtctgaccggttaccatttttatcacattccctgctccgtcatacgcatactgcgtatatatgtcccgctcaccatcgtttatcttcaccgataccagcctgttgcggttgtcatactcgttttctgtctcagtataacttgaagccgtcacctgctgctttgtttttatcacgtttccgtttgcgtcataatatgtcaggctttttgtggttgtcgtttcatcaaacggcgcttcgcaggctattgctcttcccagtatatcataacataccgttgttgtattgccttcatagtctgtgcttgtcagagcatttccgtaatcatcatactcagcggttacataactaccgtccgtctgatatactttagtgggcttacccatataattatattcagctttgcttgtatagcttcccaaattctccatataagttcgtccgccaagagtctccgtcacattcccggcatagtcgtacttatatgtgtttttgttcagcactgtatcggttccgtgcttatagtaagtctctgacactttatttccaaatccgtccaatacagtttcaactgtcggtttcacatatgtttcatcccctgtatatgtcgctgtaaccgtttggcttgctccgcccagcaggtttatattctgagcagtctcttcatcggtcaggaatttataatatgctccgctgtatcccgccgaaattcttatttgggacaaccctgtcacatcgacaacggttccttttgttttaccgtatgtcatattttcggaaaaatatacgctgttgtcgtcctgaacagctgcatcatagttcctcgatgatttgctgtagaataaaactgttagctttttggcgttagaaggaacgtttactatattaattccctcacccaaactttggtatccctctccataactatactgatagttgattttatctaaaactgtatcatcctctttgctggtttgagtctttattctgtcgaactggtcataagtataattttcctttacagcctttcctccgatatcctgatatgctgtttcgcttatttttctgccgtggttatcgtatttatactctgcagccagcttgtttaaatcattatcaaaataaatcttatccatatagccaagcggagaataatctttggttgttgcatatccgttttcattagtaaccgtaacgctgttgtcagaaacgttatagtctattttcttatatgtttcatcaggatttatttgtctgattacccttcctaggttatcataccaatatacagttgtattccccatagcgtcaacagacgatgttaagtttcccagccagtcataattctgcaccgttgtcaccgacttactgctgccgtcattatccttaacgttattaacggttgtcgttatgctgaatgagccgtcaggattatatgtatatccaaactctgtagtaagcggttctccgactgtcggtgtgacaatttggcttgctacggtgccatcactattatatgtatatgaagtaactgtcttttgagagccgttttcaaaaacttctgactttaagatactttttccgtccgcggttatggtattacttactttcattttagtattgctgtctttttgatattcctttgataataatataccataattattatcatatgtatataatgactctaactctccgttcatagtatacgtaggaagatttctgctgttatactcattataagctatatttaccatgttattgtcataggcagtaatggtgctcttcaaatatgcctttctgtatttcagcatattttcttccggaattgatgataaaagattctgagaagtataggaatacttatattcttctgtatattttttgccttcaatttgtccgcttttctcaaacaatctgccggcataatcataactataagtcatactttttttacttccgtcgtcatatgtgtcctcaactgtaacactgcgttctttattatctacataacttttctgggaagcttgttcaaacgaatatgttctttcatatttttcactgccgtcttcatatactttttctttatttatatgataatcacaatgcgaaaccacattcgccccaatactggaagcaaactttttaactgttggaacagtttcgtattcatactctaccgaagcatttgtcggaaatgtaaccttctcaattttatcataataacttacttcaccgctcctgacaaaaagcattgtactcttatgcgatacgtattctgtagtctcataagaaacgccattatacttcttaacatttaaaatatatttcgaataacaatccagcagaccgtatgggtctctgtcactgtttacccttgagaggctgtattctacgctcttagtaaagttcccatttgagacagttatacctgcctgcgacacgtgtatatttctgccataagtatcaactatcgtcacgcttccgtcagcgttcgaagtataacggacggcattgccgtacctatcgataattgcggcaggtaaaaagtatgttttcaaggtttgttcgtaataatatgtcttcccctcaccgtctgttattgttatatcatagttaaatcctaaactatgcgtctgaagttcgtcatatacctgagctgtatattggctgtctgaatctgaaactttacagcttcccggtttatatatccagcctgaatctttcgattcttctttcaaatatgaaaaattcattgtctgaccgttttcatctttaaataaatacttatatttcatatcagaggcttgttctgacttgtttaccaaagtcaactgcggcattgacacataccagccataacctatttcaatatcggtagcatgcactgtggttgtataaaactcattaggtacttcgctcatttttactgcagccttacttttatctctagtgaacaatactccggatgtatcctttatagttgagtatttataatattttttacctatggcgtcagtctcaattgtatttaattttgaagactcggcataaaaactgtctaccaaatcctcctctttatcaaacgctacatatattgtctttgaattaccgtttaaaacatatgtaaacacatacatcggacttgtttgaacgcttccccctctggcaaatactcttgtgccgctgtaactgacaggtccgccgtttacataatgagtacgcctaatattaacatccataccatttcttcctggcagactcatatccacctcatttatattaacatttccgtcactcagcgacacgttgccgccaggagctataaatggagtttcataatccgctccgtactgctctatcaagttttgggttaacgattgttcatacaactcatctgacgttgacgcataacatgtgattcctatcatacttactaatattgacactatacatattattaatctgcattttatcttattcatcaaacacaacccccaaatctttatctattctcccttctaatattccctcatttatcagctgttttaccagttccgcatttttttcatttcttttttccaccagtctttcagctgttttctcatcggataaaatctctgaagcagattcctcaatctgtttattctcaagcgccgcaagctctttgctgttcaatatactctcgtcagatttttcattttcacttattccaaacaagctgaccggctgacttatgcttgtgccatatacttcgtttataatgtttatcattgtatctccgccggcaattctgtctaaaatttgcttaattgaataaactcctttgcggctcaaagtatttgcgttctgtatatctgaaacagttactcccaaagaaagataattatttatttcctcagattttaaaaccccatgaacattttttgtaatattattataagcattctcaatccaaaaacgcccgccttcataatcgccttttttattatatatctgttcaattatggttatatcttcacaagtgtcagcccaaaagtatgctatgtctaatatactgtttgggtcggctccattggtaataagaccggctatatactcaagctgttcattattaagaccataaatatctcttaaatataaataagatgccaaaatatcagctatactttcagtatctgaaatatttgatttcaatatctcaaccatggaataaaagttggatgggtatagtgcgatggccttatctgataaatccgtacttataacagatttattttgatcatcatttaaagatattgaatctgtctgcacactgtctttctgaactaaacttttttcagatttctcagatgaaaatacttttgacaatgctgattttatatctatattttgattattatacgcaccgcttgccactgctgcaacagtccccgctgcaagaactaaacatattcctaaaataataattttctttttcatactccgcccctcctaatataacaatgaacaaacagtttcgcaggtttctttggcttttaagactattccgtttacaaatcctgtgaactgcctgccggccggtatttgttttgttgtctcaaattttatgattcccggtccggcatacgtgatttttatatcaccatatacagctccgctaagcgtttcgaatgttttcgatcgtgatattgcatccaccatttcaaaacgacttccatcatactcaaactcaaactcagttccgcttatttgagtagcatttttagcggtgatattaattatgtatttttttcctttttcaatatttaaggtctgagttttcaacgttttatctcccggctgtccctcctccttttttaaaacgcagaaatcatatttaagctctcttattacttctccgtaggaaacaagagcggtcagcgttaccttttcatcttttgcataactgtttggtcttcgcacgcttccctgttctgaaagataaaaagcattgctgcttgtccaggatacttgcattccattctgcatcatgaccggcagctgtatgttttcagtcaggttctgcggaatatctttcatatatttatttagctctctcaaatcttcagcataataatcctcagcaactatttcaggtgtctgtgaatatacacccaatcccccaactgcatttgagccaaacgagtacatccttccatacttatcaaccgcaattgtaaatccgtcagaaccgacaatcttctcaatatttaaaccattcaaacttgtaatttgtgtcggaaccctgcatgtaccaacggacacagtaccaagctgatgatttgctccgcttccccagccccaaacagttccgtccgactttattgcgtagctctgataaaaccctgcatttacatattttacatctgacaaattaacctttactgcagttgatttattatctttgtttcctattcccaactgccctacgccgttattgccccaggcgtatacattgcccatacttgttaaagcaatacaatgctgcggtcctgtttttacatcctttatgtattcaccatcttcaagactaatgttcagttttttcggcgacgggttatccgagaatgtaccgtctcccaactgacccttagaattgccgccccaagaatacacgccatcatccgcaatagcgattacagaattttcacatgcggtcacatacttaaagtcggctttatccgtgatttgtattggaatatcagtattattaagttcctccggagatatacccaactgacctttatcatttttgccaacgccccataacgttccatcattcttaataaacagactgaactctgtgccgcctttaatctgtttaacatcagtaataccaggcaatttttttattatcttaacttttccgtcaagtgaacccataggataatttgagttgcttccccaacaccaaacgtctccgttttcatcaagcactagattatggttttttcctctggaaacacttaccgcatttttgatttcacatttttcatcaacattataaggatacgatactttactcatactcccggtttcatcaggataatatccttcaccccatgcgactatgctccctgccgtatctatagctaaggtttgcgccctgtatgagtcaatatccacaatatcgtatttatactcactcattattggatttacactgtctccggtgccaacgttatattcactcatatatccccagtgccaaaaagttccgtcactttgatacgcatagctattgcttcctaaggcaattgaagcacagtcagcaggcaaatttatttcttttggccacatttgaactccaatatcatttgttccgtccaaatacactttaccgtttgagatatacagcgtcatattatttccggcttcaacatccgttacatctataccggtattaattggatattgggaatatgttccgccgctctgcagattaacaccaagctgacccaaactgttgtcaccccaaacatacatctttccatttattcctattccaacaacatggtctttacccgctgaaattttggtaaagcaaatcatatttccctctgcgtccactgaacttccaagctgacctttatcattttttccgcagccgattatctcactgtctgtaccgctgtagtatgtctggtaatctcccacttcagatagttctgaaaaatctgtaacaagtattggtactaaagaattagaactgtcagttccggagccaagctgaccgtaactattatccccaaacgcatatatttttgtgccattctcgctgttttcaataacagcatgttcaagccctgcagaaatctttttaatgctgccttccattccaacggctgcaagaacaggcagattactgcttacatttgttccgtttccaaattgtccttttgaattgtctccccaggcatataaatatccgtcagaagtcagcgcatatgaagtatttccccttgtttcaacctgtgcaacagttttatctccccaagcacccgtcacatcaacaaaatcatttgtcggctcattattcccggttccaagctgtccgcaggtgttgtcaccatatgcctgaacctttccgtcgcttatacgcaaactgtggtttaaaccgctcacaacagaataccggacaacagaattaagcaccaaaacagacccctgttcattttggttagattcttgaatgttattagttattaaagtttcatcttgctctgtaacttctgatacttttggagaaggaaccgccgatggttgaacatcctcagttgaaaaatctttactagtattttctgtcggagcttctgtcggtttttcccctaaattatcaaaatcttcaatatctgcattttcatcaaaatctttagattcattaacgctgatttcaaatccacctgttgacgcttgtgagccactctctgcttgtccttcattctcggcaaacacatatacgaaatttaccattcccgctaatatagctataataagcgctatactcagcaatttttgattttgtcccataccacaatactctccctttgctataaaaatttaaaataaaaaaattaggactgtaacgatgtaaaaaataacatctgccacagtcctaattaaaatatattttgtgttttcattgtctctcagcaaactcccgcaaatttgctggtgcctttggctgatatattttccaaccacatcttccatctgtatatacagccatgaaagccgcaatagcgcagatagttccaccaaatcggtacataaattgttttaacttattcatgatttttctctcctttttaaatttatattgaattaactttttctttttttctcacaaagaattgaatcatgaccgacatagataccataaacaaccccatacttccaaatgcacaaagcttaacaacaaacttaactgatgggaaaatacttaataaaagtataacaactgccaaataaattaagtatagcagccttgtttttttgcgaagacgcttaaaatcattttcgtcaaacggtttgttcttatggtctataggagcaaatatccaaagcaaaatccccgctgctgttaggcacgcccctattaagtaaaaagaaataccggttgaaatagttttaccaacaaataaccctatcaaatatataaaagtaaaactaataatacatccataatgggtgtttgcatgataaccaccgccaaatgttctgaaaataataaaactgaatacgaaggccatactttctaaaaattcacctgatataattgctataggtattataatcagccagcttattatttcggaaacaaacatttcaaagccgtaagaatatatttcactgtcatattctttgattaaaccatttcttacaaaaaaatttgtcagtcttttagaaatgctttctatcaatttgcttcctcccatttctgcgggtaacttttttcaacatttttctctaattaaattataaagtatcggcatattaaaatcaatatactgggacgtaaacttattttatggtataaatgaattttcggcaacaactttcctggtaaattttaccaaaattattttcactcatttattcattttccacaaatttttaattttgtcgatatttgaattatcataaaatagttttttcataacgtttaaaaaattatccacatttatgactttttacattggttgacactttcgcatgtgtgatatataatattttatgaagttaggagagcatttatgaatgttttaatttatgaagatgaaaatatatatattgacaaattacgcatagtattaagcaaatataatgtaagtttaacagtctgctctacagcagatgattttttaaattgcagccaagtatttgatattgctttagttgatatagaagttgaaggattagacggtcttaatgctacaaggattttaaaaacacgttcaaagaactgtatagttgttgcgtatactcattatgacggttacgctgtcaacggttacaaatatggaattgacagatacatacttaaaacagcaactatcgaagaattaagcaatgaaatagagataattataaatgaatactttaaaaacaataataaagtgcagatagttaataatggaatacattacaatattcttttaaatgatattgtatatattgaatcgtgtcataatagtttatgtatacatttgctagataaagattttactatacgttcaactttttctgatttgtttgacacattagactgcgattatatcgttcgtgtacataaaggatttgctattaacctaaaaaatatattctctgtttcaaaaacgcaggctgttatgataaacaaagaagttgtaccaataggtaaatcatatagagaagattttgagaaccaatattttaaatatagtgttaaagagggaatgttataatgagccttatacttgatatatctatagttattattgaatttatagccttaactattatttttaactatgcttttaaattcaaaaagttttctgttttatcttttttgggggcacttataccatttttaatattgtgttttacttcaacatttcatttaaatagtaacgctaatttaataatttcaataatttgttatacaacattctgttttttctcatttgaggataaagcaactaaaaaaatagctgtagtagtaatatattacgtttgttatataatttcgcaaatggctacactgcttatattatctcaactatttgatgatacatattcagatatattaaataccgacttttcactaatattagctgcatgctctacaacaatactaacgctgtgtttggcttttccaatgattaaagtgtttattaaaaaacaacgcaatcttcctattaagtattggatactaattatactttgtcctttagtaactatattaattgttgttattattgacgctatattgatgaaatcacaatttaccaactatgcactgttagttataccatacataggtcttgtgtatatcaatgtcgccatatttgatttgtttgaaacctattctgcgcaattaaagtatggcattgctcaaaaaactatagagcattacaacaagaactatactctactcaaagaaaatgaaaaagaaattcgacgtttaaaacatgatatacgcaaacatttggatattgtatattcgctggttaaaaatggagatacagacaccgctttaactcatctttcagatatcaaaaacaaaaactattctgatacctttgtagtatatacccaaaatcaaaccatagattctatcataaacatagaaattaaaaaggcaaaattaaagaatatcaactttaagatagatatggaacttggacacgatataactgtaagttcttcaaacatcactacaatactttttaatattcttgataacgcaattgaagccgctgataaatccgaagcaaaagaagtttctcttcacatacacagcgacgccggaatgataaaatttatagttaaaaattcaactgtcaaaggtctgttatttgaccctgacaactgtaaaaccgacaaagaaaattcttctgagcacggttatggcataaaaagcgttaagaaagctgtcaaagacatgaatggtattataaaatattcaaacgaaaatgacaatgtaatagttttcatttctatacctcagaaactctcagacagtgaagaaaattaaaaaagtattataataacatgaaatttggttccaaagaataatttggctcatcagcttaaaatttggtaccgaagactaaaattgtcatatatccgaagacactcgtcatgtaatgcggagaacattatatagaacgagaatatggctatattacaacatattaaaaacatcttaccactaaaaaaagacccgctgtatgaaccgatcttccaaaagttagaccaaaaatctaacttttgagagttagctcaatacacagcgaggtcttttttatatctcactttcatatctaattattttataacaataccaaaacataatcaagcgccaaagaacaaaaagtatgcaatcacaagagcgcctaaaactatacgataccagccaaacactttaaagtcatgttttttaacataattcataaggaattttattgacagcattgataccacaaacgcaaccgccattcctaaaatcagaattataatttcgcttgaggtaaatgccatcccgaattttgcaagctttattgcgcttcctccgaacatggccggtatagccaggaagaaagtaaactcagcggcggttgttcttgagatgcccaaaagaagggcacctattatcgttgcgcctgagcgtgaagtccccggaaatactgccgcaataagctggaatactcctattataaacgcggctttatatgtaatttcagaaatatcattcactttcggaagcttattcttatgcgcattttctatccatataaatagaataccgaatacgataagcattattgcaacagtccagtaattatagaaccaagcgttaaaataatcgtcaaacaggatacctataatcccggcaggaatagacgctaccaaaattttaagccacattattatcttctctttatctactccaaagccgcctttaaaatgaaatgggaaaatagttttccaaaacattaccacgaccgcaagaatcgcgccgagctgtataacaaccaaaaatatttctttaaactcaggagttacatttaaatgaatgaattcatcaaacagtatcatatgtccggtactgcttatcggaagccattctgtgaccccttcaacaatgcccagcaatatcgtcttaagtatttctataaaacctaaacccacgagcaaaatcctcctttaaatttcaattaaatattgcgccttttaaatgtatatgacgctcagaattatattatatacgccaacccaaattatagcaatagttttttagaaacttaactaattttttagaaacttttcatatttttgattttaatgaatctatcttggtaattgaaattcaatatatctaatgatataatagcagaagttaaaaaggattaaggaggatgaatatggacaatacaaataaattcaccggcaagtcttctgtctacgcctcttcacgacctaaatacgctgaacaatttattcagtatctaaaaaactcggcaggattgggtctagaatccatcgttgcagatattggttccggaaccggcattttatcatcccaattactggatataggctgcacagttatagctgtagaaccaaacgatgatatgagaaatacggctgaaaaactgcttggaggaaatgaaagatttaactccgttaaaggaagcgcggaaaacactgctcttgaagactattctgtaaactatataacagtaggtcaggcgtttcattggtttgaccataaaaaattcaaagctgaatgcaaaagaatcttaaaacccggcggaaaggtaatactggtctggaattccagagtttcatccaataaaatgataaaagaaaatgcggaaatatgtcaaaaatattgtcccggatttaccggattcagcggcggtataaaaaatatggattcggctgtttcaaacttctttgatactaagtataaaaagaaagtattccaaaatgatcttaaatttactaaggaaaaatttatacaaagattaaaatctgcctcatatatgatttctgaggattcaccgaattacgaagcatatatatcagcgcttgaaaacttgtttgataaataccaaaaaaacggatttcttactatgccaaatgaaacaaaatcatacgcaggtgaaatatgagatttgaataacaaaaaaaattggttaaactaatcagcctaatgtttttatagcttaacaattttatattattagcaggagatattaaaacaaaaaatccacatcactctttagacaaataacttttatcgctgcttaaatagatagctttccacctctgcttaacctttattttatattactggtgtgcacatctagctttcgcctatcatttttaatattttgatataaagctcggctaaagccgagcttttagtatattgataagcagtttcgaaaaattgtgcaaaatgtgcagctccctcaaattatcatctgttagaaaaactgctgaggaaaggaaaatgttttgaaaacaactcctgggaccacaatgcgttcttatccgcccacggacgcgcggattaaaacattggcttttgcacatatctctaaacgcttcaaactttaccgacagtaagaaagcgcagctttcgctgcgctttctaataaatataaaagaatcaaaatccgttaatttttattgaagaaatatttaatatcttcttacttaaattctgtaaactcaactgttatatcactgatgacataattatttgcacctgcgcttcccggatatactgcgagacacatattctctcggtcaacatcagcttcttcagggaatccggtaaacgtatagtcattccagcttgccgcctctgtaaccttagcagaggctgtcataacacggtttttaaagtctgtaactacttttaccgactgtggcttatatgagttcttagctataccttctccggcacattttagccattgatgctcggtatcctgtgaaccgcttcttgacgcctgggcaaagtcgagcatattcatctgatcccaacgacccatgttaactctgtttatgcgtataggattagcattcttatttaaagttcccggtattcccgaaagaacatcaatcatacatcccatatcatcctgcttataaggcttatcggcagagaatgtcacagtatatgaaacagtaaccgaatcactcgtttttactccctctgctaacttggaaagattccagtatgcgccgtcagaagttccgcttgggcttgaaactgtatatgaaccattattattaacaactgaagctccgcttcctatggctgttgggtcagtagtaatatttaaaacggtatgggtcaattttccaacgcttgaatcaaccattttaatatctccttttgcccccgatatttctaccgtgccgtctgcagggactgtaaccttataatcagagctttcggcatctataaccagcttataatcaccaacaggtataccttcagccttatatgacgccgaagttgttcccgcctttattattgcagaagctgtcttaatcactgccttgcccttatagagcttaacgctgataggaatatctgtttcaggcgctccgctcgtacttgttacagtaccgtttacttcaaacacattttctttatctgttgtcggattaattgttacaggtataaccgcttttgttccaatagcattcgcgtcagcatttctaacatacaaaattatttcggtttctattggtttctcaccgctggccggtctcgtaacaataatctttgttccgtcttcacttactacagcatattcagactcagatgcccagctaaattcataaccgtttggagcagacgggagcacaacctctgtgctcgttccttccggaatttcaacgttagttgcttcagcaacgctgtttacagatttataatcctcagctgtccctgacggatcccaaccgtcagtaccgcatgtataactataaggattatattcaagcattgtccactcgtccagtaatttactctgtcttaaatctcctgaaatttgtataggataaccctttatgtcagttgagccaaactctccaaatcttgcattctccggcggattatcactcattgttgcccacccggattcacttatcaacgactttgcattgtatcccggtcgtgagcttgtgccaattttagtgttaatatatatcgcttctccatttggattccacggtctgccaaatgctcctgcagttgcagtttcagagcccgttaccttacaattatagaatacataacctttttgtgttgactggcttggcgccgtaatatatcccgaatctgtgtctgtggatttagaagtttcctttattggtccggcattccaatataactcacaattattgaatactgccgtcgcacttccgcagatataatcaacagttccgcctattttacagttttcaaaataaattctgtcgttgtttattcccatagtatcctgcttagacataatggtacaatttttaaatactattctgtcagccttagtatttattgcggctgctctttctctcaagctcggctttgtatccttaattataggtgaacgcgactgaatccagctgtttattgtttcgtcatctacaccgttattcagctgttcattaagccatgctcctctgtcaaatgaaccttcggcaggagccatatattcattcaactcctcctgagtgtaatactcattaaacgagttttcgagatacaaaccttcacaagcaaaattgtcgccgttttcttttaccactaaggccggaccccaatccttaggagcgtttttggtaacccctccgtcaattacatcaggattgtaatatccgctctcatcacagctgtcatacaaagtattagttccatagtaccatgtaagcttaacttctccctgagaattaggctgtttctgtaatgttatataaggaacatttataactacctgttcacgatatgttccgggaacaacatttatataaattcttgattcctcatttgacggcggattagcagaaactgcagcaaccgcttctctaattgtcttataagttccggcagcaggttcagattcttttgaaccatcaaccgtaatggttcttgccgggtcagttgtaggtacaggcttatcagttggagcgtttgtcggctctatagtcggaacaggcttttcacctattgttccaacaccgcttaaaggtgtaattgaatttgttccatcccaaacatatatctttacaaattgaccatcctgaggcttagcgtaatcaaattcatatctatttgagccggttatatcatattcacttgaatttattaattcctcttgattctgagaatcatatgtaccaatcaaaacctttgctttaggctctgactctgttccattatatgtaacgtcaacacataacttatcattctcataataagacgcatttatatcataaacatgcggaacattaggcgcaagtgttggtacaggagtattactcggaaccgggcttcctttaatcggctgttctgttggctcaggaacagatgttggattcagttcatttccaaaattctttattgtataatcctgaccttcggcagctgtaaatgacaataaagtattatcactgctgagtttagcttctaccttatttccatttgcgtcaaatatctcagcatttgcagcatactcgcttctaattttcatttccttattctctttagcgtgtataactgcctctcttggaacattgttatcccacttcaaatctacggttgcgccttcgcgggtattaaatcctttgaaagaacctgtcttccatctttcaggaattgccggaagcagatttatagttccgtcatgactttggataagcatttctataacacctgcggtaataccatagtttccgtctatttggaaattcggatgctggtcaaagagattcggtgatgttcttgttgtaaataactgttcaagcatcttagacgatgtgtcaccgtaaagagctcttgcattaagagatattctccatgctactccccagccctgaccagaaccggctccacgtgctgttgtagaatcctgaaaagctttaaaaatcttttgctcattttcattttcactatacgcgctcaaatgcgttccaggatacatttcccataaatttgagcaatgtctgtgactaccattattgctggcagtatgatcataaacacctgttttctcatttgtaaacggatttataacctgccatgttgcatttccgcttgaaatatcaaagctcacgtctccgcgtacccattctcttatcagacctgcatcgtcaataatatttggagcaatttttcctttttcatcagctaaatatgatgaaggcatctgctcattaatctttgcaagaagctctgcgttttcacttgtctttccaagtatttctgacgctttctgtaccatatcatagaggtttctgacaagctgtgtatccattgccggtcccggttgaactccgccctgctcaggcgagcatgaagccgctgttactaagtaccctgtcttggggtctataaccaaaaactgtgtaaagaacttagcagctccaaccatataaggatatacttctgctaaatactcagtatctttattgaaattataatactgccaagcatggtcaagcagccaaacaccacctgtcggccaaagacctgccgttgcattgtcaataggctgtgtgcctctccaaaggtcataattatgatgcattacccacggatcaccaggcttgtactggtcgtctcccctgtcatttgtaatgccatactgatatgcagccgttatacttccgctctgagccaagtcgtcaaacgtatctataagcggctgttcgcacacatcaagtccaagaggctgggcggcccaataattcatctctgtatttatattaattgtatactttccattccaggaagctgaaagcgcagcattccatttacctgtcagattaagcggctggctctcaggtatatctatctcgtcactgccggtagcttctcttcctgctctcgagccgctgataatcaaatactttccatagttaaaatcaagtgttgccagctgattatcaccttccgaataagttgaataaacaccgtttgcattagctttttccagacttgagtcagctccggtcaaaaatcccgacttaccatctatatctttacgaatacgcttttctgtaggtgtattactatattcatctgcgtattcagtatcgttctgaatagtaagatcggttttgtcaaactgttctttaaagtcagcgatatgtcttgcttttatctctgaatatgttctcttcttaacatttgctgaatatttgtcacaatctttacccggctttgtattgtcaagatttaaataatcaacataatttgtagctccgacaacatatatatcggcgctgtttccccccactactgaaacggaagtattatcttttgcaactgcaaaccttgtgtccttatctccgtctaaaaacatgtgagcttcaaatctgattgcgtttacagttcctggttcattgtcgtctttgcttccattataaacagaagcagtcaatttaacttcattgtcactgattttttcatacttatagtaatcagttttttgattatgatatgtatgtaactcagctaagaaatttaattcttcagttgactcaacatgagttgcaacaacctggtcagggtaacttgcaaaagattcacgtttataatgctcaccgtgataatcatactcaacagtaactacgcctgtcttcatgtcaagacgcttaacataattttcagcctgttcatggtgctgtccaaaatcaagataaacctcaacaaatgatttatatgctctttgtctgtttggacttcctaagaaagtctcctcaaccattctttccatactccatctgtcctgaacagcctgttgctcttttgaattatctatattcagtgactgatatgaaatacttttattagcaaaatcggggaactttgttctaaaagtctcatcaccaacgattgcatcagctgaaccgatctccgccggagtaccatccgcatttgcaccgcggaaatacttccagtcatccttgatacttccgctggttggattctcaacgcttattttttctgcattggcagtctgagaaattttcgtaagtgtgtttccgttttcatcttttagagttccatacggtgacccatcccaacaagtatcttcgttgatttgaataacttctttatcaattcctcctgcaaccatacccgccatgcgaccgtttcctatcggatacgaatttgtccagcagaattcagaatatgcccagcccgtaaacttatcgccattagctgcataaggattctgcatactcacattactttttgaatctgcatttggattaacttcggcagcattaccgtaaattccggtctccgccaatacattttcaattggattatcagtccacattacagtttccgggtcatatcctttttgagaaggatatccttcaaggttgacatcagcagctgccgcggcagccatcgaactgcctaacatcataacagacataactaaagctcctaatctcttaaacattttctttcctcccaacaatattttttattttattatataccaaacaagtaaatatttttaggtccagattaagaatatttttataggtccagtacaaattaatagaattgagtatatattcaaataatattcattcgtttttaatatatagaatgaagcaaaaaaataaaaaataataaacattttttatttttcaataatttataaaagtaaaatctctgtctgaataatgatataataaaataaacatcttttttatatgatttatataagaagaatgcaaactaaactaattattttaagaaataaaataaagcatatattcataaaacaaatgagttttacatgatatatattccaccttataaacccgctattctatataagggataactaattatatattaaactacactaataaaaataatttaaatatacaaattatttcatataggttatgatatttttattaagtataatatatatgctatatttgtataacatttgtgtcatataagttgtgatatttgtatattgaacactgcgtgttcagatgatggttcacctaacgcggcaacctgcgtttgccctgccgatgttcactataacacagcttttaatattaatgattttggtattaatattagtttcttgttacctgaataaacaaaagtatattatatagtaataaaattctatattacttaaaaccaaaataaagctaatcaatatatataaataatagagtaaaaaaagtgtgtttgcgaacatcggtagggcgcatttatgcgccgcgttaggtgagctattacctgtacacgcagtgttcaatatacaaatatcataacatatgtctcacaaaagttatacaaatatttcgcacatatcatacttcatacaaatacatattttaaaaccgttcataaatatatgatttaattccatcataaattaaacaaaagtacagccacaattgatattgcaggtttgatataacaagctagtttcattatacacactatacacacttttttaagtgcggtcactatccatcacagcttaacaatttattggtatctcataacacacatcattcagatgcagagacagcaatccaatatattatttgttcgagcataaaaaaagcacctgaactttcgttcaagtgctctgatatgttttggcagcgtcttatgttcccgggcagtcacccgccaagtattttcagcgctgagaagcttaacttctgtgttcggtatgggtacaggtgtaaatgtgatttagcaagcttcggagggctgtgaccacacttttttaaagtgtgtgtgatacaaatcactttgtattaataaacctacaatgtcaataatcaaacttagttgtgatgtgcaaacgtagtttgcctcgttaggcgcgcagtcacggaacagattttataaaaggattatgacaaatgttattagtatattcacgcttcgcgtgagatggttgctcacctaacgagatgtgcttacgcacatcctaccgatgttcaccaaaaatactgttttgaagatattaattcctaaaaatttcttataaaaaatgtgatttagcaagctttgacatggctgtgaccacactttttaagaaaagtgtggtcacacctaacgatgttcactattaacaccgtatgttagatattaattatataataaattataaaaatactgtatctaaattatatcaaattcatttttataattcaggtatgaagtattcattattattatcataccatacgggtacgccgtctactatttcgccgtcatcaaacatttccaaaattattccttttcctggattccagttatcaggctccatagcggcattgtttttcttatcaaaaccggatgaaacatattttttgtcattcaaatacttatatctgcagtcttcagtgtattcataactcgaatatacgccttcaagataattcccgtctaaatcacggctgctcatttccatgaaacgggcgttctcctttttactgccgcccatgtccgcaaaacggtcttctcccactgctatatggtcgcccatataacatttataaaatacagaaattgctccctgcttccacggtctgcctaatttaactttgccgctgttttccagctgtgataactcatcatcaccgtttaagcggcagcaataaaacagaaatcccctggtctgctgttccgaatgcgaacctgcggttatatatcccccatttggatatgcgcggctttgaatattgcagtaattaaacactgcgttcgcatctccgaatataaaatctacagttccctcaatatatgacaaaagaaaatagcatctggctttatccttaatatatagtgtgtcctgccgccctataaaacggcagttgttaaagaaacttctgtccgccgaacatctgactgccacagcctgggtctgcgcgtctttgctttcgctcacagtcacatcagcctttctggctttggcggattggtaccaagcttcattgcgctttttagtatccaaattttctttcagcaaaacgtctgtttcactgacaggctcatatatatcctcctgctcttcgtcagacttgtaaatattatatgagttttcaaacgttatattttgagctataaaatcatgcgcattttctgtaatcgtaacgctggcgctgttttgcgttcccacaccgcttatatatccgtcagatttgacatatggctttccgttcagcaatgactttttgctttcatactcctttaccaattttgcaaattcttcatcagaagaacaatcagccggatattccatttcagggcttaaattatcatagcttttataatttcttgaagctccgtaataaaaagtcaataaaacctcattcggcaggtctctgtattcaggatttttttcaaacgtcaaaaatggcttgtctatccaaattctttcacgatacgttccggggcttatgtatatatacactctgttttcttcactgtcagcttcaggcgctgcccggagagcttctgaaaccgttttgtacaaaccaaattcagggaaagatttctctatggctccgtcaacctgaattagtgtattctcagaactttcaaacatacttaaaacatgaacagcgtcacagcgccttggagtatcgccgaaaaaggacaccattgaaggcttttgaaacgcacggtaacaaatagtgccgatatccataaaatcaacatatttgtcaggttcaaaagaaccgttttcgttccccttaataatcttgttctgataagcaattttgacatagggatagaaccagttgtcctcactcacatcagaaaattcaggttccgcccctcccgaaatctctgttttttcggctgccagcacggccattttaaccaactctgcccgagtaactctctctaacggctcaaatctgccaaagccatcgccttctataacgcctttgctttgccaatactcaatatcgctgacaaacgttgtgttattatcataaatatcattaaacacgctgttatcttcaatatcgccggaagcgcaaaccgctaaactttgaaaaataataaatacaaccgctgttaacagaattgtctttttcataaaacacactccctgcccttttataattatcaataaatcatgaactataaatcactataaaattattctaacacttccaccaaattaattttttctttattctgcttaaagctccgcgtcccctttgaactatggattctctttccatgcagggcaggttgataagcagtccgcagatattcttggccgctttttggagttctcccaaggtcaaatcgccggagcctatagccctaatggtattgtcctttccgctgttatgctccggatcgttaactaccatataaatatcggtgcctgacctgagcattgcggctgtattttcctttgtcgccacatgactgccaatctcattcatgcttgcccaccagtcagtcattattactccgctatatccaaactcgtttcttattattgtagtggttaaatcgtaattcgagccgcaccactgcccgttcaacggattataagacgtcattatagccgtaggctttgagcattctaaggcatattccaacccttttaaatatatttcccttactgctctctcagagactacagaattaacacgcttcctctttgtctcctgattgtttgccgccaaatgtttcagcgttcccataacgcccttatcactcagaccatttattgccgcccccgccataactccgcttatatatgggtcttcggaataatattcaaagttccttccgcacagcgggtttctgtggatattcatacccggccctagcaacaggtcaatatcatttgccagcatctcgccgccaatacatttataaacctctctaaccagcggtgtgttccaggtgcacgcaagcattgttcctatcggaaccagcgacgccgcgtcaccattgtcgaacctgagcccggacggtccgtcggttccggcggccaccggaattccaaaatccaaaagcctgcttgaaacgccgccaaacgcacatcccgtccccggtcttactctcttgcttcccattccctcgccgcggactaaacaagccaaatcctcaatagtgagctgacctataaacttatccatgctcacttttccattcttaacatccgcaagtttatatcccttatcaatagtgagttcaactctgtcaggaaggttgtcctctatcctttttctgatatcatattctctttgcggtacgtttacatagtcgtacccgcctccgggctttcccttcatacatgtaaacttttggtgcggagccagtgctgaaacacattttttaactatcttagtttcattaagcttaaaagaaaaagtgcagaactccgggtctctgacatttttacctatcagaaccttatactcgcccttttccagacaatagcagaacctattgtccgcccctgtatgtcctgaatcatcaaatgaagacatacggctcataggaaacgaaaccgtctttttatgactttctccgggcagcaatgtttttgttttataaaacgccgccagctgcattttaggcttattgattttcccttcgggcggagtaaaataaacctgaacaacctccttgcccgaaactttgccgacgttttttactgccgtctcaaactttactatatcgttttcaattctgaaatcagcacatgttattttaaaatccgtatacgacaagccaaaaccaaacggatactttaccttctcctttgcaaaggtttcaaaatatctgtatccaacataaatatcctctctatacacattttcttccttgctgccaaaattatcagacaacggataatcagtataattattcgctattgtgtcagtcagtctgccgctggggcacttatcaccgcagagtatgtcggcaacggcttctccgccctcctgacctccctgccaaatatataaaacactgtcgatattatactcgtcgacccatttcatatctattatgtttgacgtgttaagcagaacaaccgtcttatcaaaaacatcagtgacgtttttcagcattaaatgctcctgctgggtaaggcggtaactgccttcgccgttaaaattgtcctgctcttctcctgctgttctgccgataatgattaaagcagtctcagaatgctctgctgccttagcggcaatttcactcgtcactgtcatctctttctgaaaatgaggtctcgcggcccacacgcccaggcctgttgaaataggattattttttatccattcttcatacacagccgccaactcttcgtttacctttattttcagtttttttctcagactgtttaatatgtcagccacatataaaacattaacgcttccgcccgagccggttccgccggtgttataatccagctggctcctgccgaaaaccgatattttcattccggattttaaaggcagcacgccattttcatttttaagaagaacaattccctccgcagctgctttttgtgacgcatgcgacgtctttataagatttatattatttaatccttggtcaaaatcaatttttttcagcatatttctcaccctttgttaacttttgctatttggataattatatattattatataaattgtgtcaattaatttaaacctctaattacaaacaaattttactaaaaaaagactgcccgttttaaagagcagtctctgcaataattacttaaattaataattgttgaattgtcagatattcaatcatcagcgcttattctattaccatccaaactgtttgaaccttgccgtttctgtcgccgaatgcgagccacattgtgttaacctcatcatcaatctgcggcacaacataaggagctatagttaaagacgtgtcataaccgtttgagtctaccctgccgaaacggctgtaaacgatttcattttctctctgaacaaaaacatcgtctgtggtattcaagatacgctgaactttatgttttataacatcataaccgtcaatatcctgcggacctgttatcacataagaagattcgtccaaaactttatatttcaggtcttcatgtccgataggcgtatgatccattattctcatagtaccgagcgaatactcacccgattcaacaatatatcttacaaccctggctgtattcttatctatagggctatctgtcggaataggattttccgttgctgacggcggttcagtcgccggggcttcagtaggttcgggttttgtttctccgccgtttattattgtatctattatttcactgtctatagttttagcgtcgccaaccgcaaatgttccggtgccgcttgcttccgctgtatcgcagactgttaagccgtatattatcgactgagctgtaaccgtcacattagattcaggagcgtaaatcataccgtgaacaacagacgttcctgaaaacttcatatcaccggttgaataaatgtttccgttgaagtcaatattgctgacgttcacctttttagacaatgaaataatattacaggatatctttgcaaagtttgaaagatttaaaacgtttcccgtatatacgaatgtcaagctgtcgggatttccataaacgctgtttgttgcatttattaaagagttagaattaggataacctccgccgccgaaaatgtcgtttgtatagattataactttgcctccgccttgaattttcaaagctcctttaaagttaaccttttccgctcttataattcttatctcgccttcaggaacatatatgttcatatcaagagtatcacttattgtcagttcattaaaatatgaattttcagaaagtgtataattagactgataagtatcgttgtttccccaagagctttggctccaccctatagttacattgcgcgttccgtcattatatttgctgccttcaaaaaattcgcttcccgggatattgtccgtatcaaacctaaaagcttcaaaggaagtattatcaggaacatagcgttcgatattggccaattccttaacatcattattttttaaatcaatttctgcgccttcgccaatcattagtttatctgctaaagctctgccgtctatataccagttatccttaccgccgtttgcataaaacggaccgttttttacatatgcagtaccgccgtaaattgagccgctcgcaataaaccgagcctcgttttcaacataaagcggacatttgctgtctgtcccgggaatatcatttgttacgcttgctgcaaagactgaggtgactgaaaacatagagataccgagaacaattgttaaaacaatacacaataatttcttcataatttccatctccttataaaacaatcatattaatattattacctgtaataaagctgataaacactttattgtggacatttaaaaagctgcaatattgtgagcgtttttgctcaaacattgcagctagacaatcatacttcaaaaacagaagcttagactcttaactttgcgtcagaaactttcatttcctttgccaaatattagattaatttaataattataatgggaaacaacccattctttattacattttgattttatcacacataaaaaccattgtcaatactttttttacaacttttttccagttttttcttatttgttaatttattataactgcggcggtttcgccgtcccattgaacatcgtttccaaaagcttcggaaactgctctgagcggaacataggttttgtctgctgtcaacctccctgcttcgctcagggtaatagcctcaccatttctgtaaagaatgctgcttccaatctgaattgaaacagttattccatcttttgaagcaatcgcagtgctgctggtttcatcccagtctacatcagcgcccagcatttcaaacaccgctctcataggaaccaaggtggttgaattattcacaacaaaagccatagggtcaaaattaacgttatttccgccgtatattacattaacaatttgataaaacgggatttcattattattagcatattccattacagaagaatgttcattcccggctatcgccgcctgtgaagctccttcaaaaacgtctttatcaaactttgtatcattgccgtaaaatgccgcaagttctaggtttgtgcagtttttaaaagcattttttcctactgctcttgtattttcgggcagaattattttaaccatagacgaacatctataaaaggcgagctctcctacttcttccactcctgaaatatttacatcgtagagcttctcacagccaaaaaacgctttatcccctatttcctttatatttcctatagttattcctgtcaaaattttattatccataaaagcggattcttcaatttctgcaatattttcaggaacagtatattcgtcgtttgcctttccgggcggatatgaaaccaaactgttttcttctgtatcaaacagcacgccgtcaaacgacttatatttattatttgaagaattaacagttatagattctaatgaatagcaccaaagaaaagctttactgtctatatcgttaaccattgccggaatctcaattgtttccaaagatttacaccaggcaaaagcctcagaatcaattgtcttaagattatcagacaaggttatactctttagattagaacaccagccgaatgcgtcaacacctattctggcaaccgtactcggaagaacaattgaagtcacgttttcacaccagcttaaagcataatcgccaatcccggtaacaccttctgatatattgatattcttaatctctttagaatatgacttccatggtattgaaaccaaatctttaaaatcattaatatcaccgtttcccgaaattgacaaagtctgactgccggagtcatattcccagctaacgcctgagctgaaaacccctgatgtttcagccgcaaaaattgaaaccggaatcacagagaaacataaaattaaacttaagcatactgccataatctttttcatgtcattcactgcccttcttttgtagttttaaatttttattaagtattattattaattttatacctgacggcagatgttgtcaatataacacaatatattacagactatttaacatcaaaccatacggacaaatattcattttcttcttccgcttctgctaaaacacgaattaattttgcgcatagttttttattatcatttaaaaaatccgacatatttttaaaaacaatcataactctttcactgccgccgatatcagataaaacatcgctcaaggcgtcaaaattatttccataataatcaggcgcgttcaggctctctgccaaacacttgtgcatagtttttttattctgcattggtccgcagtcgattactatttctttcatttgtcttatctcctatatattatgctcaatataaaactttgctaaacttcagagaacgtttcataatggtcgtttgtataatacacatgcccatcgctggaatacacgattctctccgctcctctatgtccgccgctgtaatttatatcgcactcaaagtattttactccctttttaaccggcaaagtctcctcatagtttgaatatctgtcgccgcctatacttttgcccggagcaacctcccataaattcccttttttgctgtcccagcccaaacttttggcttcggattttgttataaagtttcccggcagctttccatacttatgtatgtatcccgcgacctcttcttttgaactgtaatttccgtcctcacgaatatctatgcttttactcgtgctgtctgacaggttagactgagtcagagtacaggaactcagagcaaaacataaagaacatataattaaaactacagataataaaagagctgttttctgaaaaatttttcttttcatttaaaaatcctccgtttgtataatcagctgaatattatggatataaacgcgtttagaaatcccatgacaaatccaagcaaagctccgagccaaattatagcgtttaattcctttttcattatggaaaacaacaaatcttcaaactctttaatattgtatccgtttattttatcttcaacaattttcgcaatattaagtttttccataaccttaggcaaatcattttttactgttctgatatatacagactgaaccgcggactttattttgggtattgaatgccaatatctttcagcaatttcactggtctttgtgtccataatcctgccggtctcattttttattaagtcgcctactattgcctccgaattttcagaaaccattttgtcaatggtctttccaataggttccgccaggctgttaatcatattgtcatccaccaatttggcaaatgcggcttttatcctgcccttttctatatattgatttctgatattaactataacttttttggatatctcagttccgaaattaaattttgaaagtttggcgtgtatgagagcggctatatcttcctccgccttttcggtcatattatcaaccaaatctttatcaagtttctgataaagctcctcacggacagttttctcactcagtttcattttattaaacagtttttccaccagcccggttatacctgatattataccgtccgacaaaagcgtcttgtttatggtatcgttgtccaaaagctcagtgctgacaactcctccgatagttttcgctatccgctctttttctttcggtatcaaaccgggcgtaaacggaacgcgccgcttgccgatatatacaggcttcagcggcctaaacagcatttttatcgcaatattgttagtaacatatccgataataagcccaataaccggtccgattaaaaattgtatattcattataattaccacttttcaataaggcgcactgcgccgccattcaacgttttcattggcaaaaaaagctgtccattaaaatattaagcgaacacgccgcatttgcggcgggttacttcttaactcagttgtaaaaatattttatcatataattctaacaatatcaaggaaatttcttattgaaatttgtaaaaatttgtagtataatttgttttaattaaaaaggaggttgaattatgaaaaaaattataggcgagttcaaagaattcataatgcgcggaaacgtgctcgacttggcagtcggcgttataatcggcggagcgtttaagaccatcgttgattcactgacaaatgacataatttcaccgatactcggcttattcggaggtcttgatttttcaagcatggttttgtctatcggaggagttaacctcaaatatggttcatttattactgctataataaactttttaattatggccgtagttattttcatatttgttaaaatagttaacagtgtgataagtttcggaaaaaagaaacctgcagacgagcctgttacaaccaaagtttgcccatactgctgcacagaaatagacataaatgcgacaaagtgtcctcattgtacatctgaactgatagaaattgaacctgaagctctagagagcgaggagcctgatgttatataactcattatagttatatagtaaggtattatgacaagttgccatatgtatattcacgcttcgcgtgagatggcagctcacctaacgcggtgtgcaagcacacccttccgatgttcactccaaaacaccgcatttgggataatagttctaaaattgtatttagcaagcttcggtagggctgtgaccacacttttcttaaaaagtgtgtgttatacatatgattttattttgctatagcctacagtgtcattattatgaatactcaatgaagatgaaatctgccgcgttaggcgcgcagtcccggcaatttttattttataacaaattattatatgtatattcacgcttcgcgtgagatggcggctcacctaacgcggtgtgctttgcacaccctaccgatgttcactcagaaacattggtttatatagacacgccgatttgtatcatacccacctttgggtgggggtcacacccttccgatgttcacttaaaaacaccgcatttgggataatggttttaaaataaataatttaatcgctgacaaaatcaatattagtattaccattgttatttgacacacttaaaattttgtcaccgccctttttgtccggcggcagattgctttcccctttttttatattgctctcaacagaatattcatcataacttcctttaaccgaaccgtttatatctccgttttttgattttattattatactctttcccgcattaagcttatcaaatgttgtatttcctccgtttgcagaaatggatatagaatccgttacatttaaactcggcagcgttatatcaccgtttgacgttgacaaaaacaacgtttttaaaagcgcggcgggcagctgcacatatattttcctattgccggctgtcgtttttcctccaatataatccggccactctttaccgtcttctgcattcatatgaagaaccttatcatcggaaacaaaaatactgtaatattccttgtcactttcaaaatagtcaatatgtacttggttatcatttgaaaacgttatttttatttctctatcccgaacgtcaatatttaatcctgctatctcttctccatttgaagtatagtattttttctcaaaattatcctcgccgctctcagaacatcccattaaaagaattgctccaaatgttaaacacattataattactataacttttttcatataattcacttctttcattaaacttgtatttttaaacaacaatttcttttattccaataacgttataaaaaaataattgcagacttcattgcttttttaccccctcgttcttatcaaaataatttttgatttttatgattttatttgctataataaattataaacctttgtgttacacataagtcaagagaaagtgtgaaaaaaatgaaaaaatattttttaatcggagaagtcgccaaaatggttaatatgacaagcgagactctccgccattatgaccggattgatttagtgaaaccgagcaaatatgatgagcagacaaaataccgctattatacacagcaggatattatacgtttgaacgcagttcgagcattgcagatgatggatttgcctttacagaaaattaaaactgttctggaatataacgaccttgaaaaaattattaaatttctgacagaagcagaaaagaatgccgatgaaaaaatagcggcgcttcaatacagcaaatcaaaaattcaattagctaaagcggactacgaaagaaaactgaaaggacggcaaaatattcaaaataattttgtatataattttcccgaacgtgtaattatgctttcagatactatggagacgccaacactagataatctttggaactatctcagccatttttatgataaaattgagccgtcgctaaaagaacagtttgcgtttgaagatttggctggtatctatacggagaacggaatatcaagattattcgctgtatgtatacgccatgcggatatagaaggattaaaaattctgcccggcggtaaatatttgtgttcttattgtactgaagaaaacagaaaaatcattttagacaaacttatacaaacagccaacgaaaagtacaacataaagcctaagtttacaatacagcaaatagtggtgtccggtattttacaatggaattatcaggctcaaatatatttgggttaagaaatcaaactatataaaataatactttgacaagaataatcataaatctctagacgctaaatttatttcacacaatttaatcaaaaaggcaagcacattcttcttttgagcgtgcttgccttttcaatatattcatttttgacatccggttataaatcggttagttttcatcagtatttaaataacgctgtttatcaaaatgataacaattaaaaacatattgtaattcttaatatataaactactcttaatttttaataatcaaactgcttttaattctttatgatttcatcagctctgttttttactgttcaactatttttaaatatcaattaaacaaactgctcaaaaacttcatctatgtattcaggttccaactgaatctcattgcatattcttacaatcttttttactatctcctcatccggagatatatccggcagaatactaatactttgcttaacataattatttatttttatcgcataagaataatagcttcctatatcctcatgatagtatctttcttttaaatatgaatatctatagttttctctcattttttctcttgcctcgcatttttatcatctgtaatttcataaccggactcaattaaattatgaataaacacccctatatccatatcacatgcaatagttatatttataaaagtttcaagcataggtattcttttggagttttctaagtctatatattgtctgacggatatacagcatttttcagccatttgttcctggctcagattcagctccatacgctttgaatataacatttttcctatatttacttttatcaaattcaatgcattctcctccaatcgacaatatattcaatattttatcaatataatgattatacgtacatgtgaactgtttcagataatttctaaattacagaaatttttaaacaataaacgcagattaacatgttcagcaaacttattaattatactttttaaatgataatcaatattttaacacttttggagagcaaataaataaatttgcactaatttttataccttttttatatattttacatcagcaaatatttatattattttaatataaactttattataaaattcatatttgaaagacgcattctgacgttaaaataaaacacagtatccggctccgtataagattttgcacactttaaaaacagcagttattcaaaccaattttttgaaccaaatatcccgttttgtttttgatgaaatttttaaaaaccgtttatgtcaattagtgacttaaatgtgatgtatcgtgacccaaccttcaggttgggtgtgatacaaagtgacttgttttgcctaatctacaaagtcaattgcggctacacttttgtttaaaagtgtatgttatataagcaatgttgtattatgcaaactattgatgccaataattaacttagttgtaatataataaaatacttagttgtggtttaatgtgaccccacctataaagtatcacacttgccgaagcttgttaaacacaattttaaaactattatcccaaatgcggtgtttggagtgaacatcggtagatgtaattccacctgtaaaggtaggggcacagacattgtaggctataaagaaatgagtatgtatgtataacacacacttttcttaaaaagtgtgatcacagccctccaatgcttgcaaaaccacatttaattaattttaatattttttgttatgatatatgaccttaacatgtctgtccaatttattgcagactttataagttgaatatatgacattttatataaatcaacatctgtgaaatttattaatataaaatttaattatcaccttttaaacagttatttataaataaaaatcatttgttccagtttaaaattatataaatataaaacatcaataataccggctttgaaataaactttataataaaacaaaacctcccgtgatattttctatcataggaggttatttctttatttaaattttagcttattctgttatcatatttataaagactttttaaattattttgtcttcatagcaatagcagccttagccttttcagcaatagtcttcgcatcaagtccatacatttcaagaagcggatacggctttcctgaacggccgaatacatcctgagttccaaccctttgcatcggaaccggcgcgttctcaaccaacacctcagccacagcactgcctaatccgccgattacgttatgctcctcagctgtaacaatagccccggtctccgtagcagcctttataataatatccttatctataggtttaattgtagccatattgataaccctagcacttattccttctccggccagcatttctttagcctcagaacatgccggaaccaaaagtcctgttcctatcaaggttacatcggttccgccggataactctactcccttacctatttcaaatttatagctgtcatcaaatattgtaggcacagcaagtcttccaaatctcaaataaacaggaccatcatagtcaatagcggctttaactgctaaatttgactcaaccgcgtcagccggatttaaaataaccatacccggaatagtacgcatcaagccaatatcttcaagacattgatgtgaagcgccgtcctctccaacagaaattcctgcatgtgtggcgccaattttaacgtttaagtgcggatatccaatagagtttcttatctgctcaaaagcacgtccggcagcaaacatagcaaaagaacttgcaaatactattttgccgcaagtagaaataccggcagcagtagccatcatatttccttcagcaattccagtattaataaacctttcaggataagtctttttaaacccgtcagtttttgtggattttgataagtcagcgtccataacaactattctcgggtcggcgccgtattcaaccaaagcgtctccatacgcttgtctcgtagctattttatcaccaatattatatttcattatttgtcacctccaagattctcgatataagcgtcaagctccgaaatagcctgagcatactgttcgtcatttggagctgcgccatgccatgcggcctgaccttccataaatgaaactcctttgcccttaacagattttgccaatacaagagttggcattccttttgtctgcttagcttcttctaccgccgcttggatttgttcaaaatcatgagcgtctatatggataacgtgccaattaaaagcttcaaactttttatcaataggcaaagaattcataaccttagttatatcgccgtcaatctgcaaaccgttataatctaagaatgccgtaaggttatcaagcttgtaatgagcggcaaacatagcggcttcccaaacttcaccttcttctatctcgccgtcgcccatagccgcatagacgcgatatgacttgttgtccagctttccggcaagagccataccgcaggcacagctgataccctgacccaaagaaccggttgacatgtccacgccattaacatttttcatatcaggatgaccttggagataactatttatatttctaaatccttttatgtcctctttcgggataaaaccggcctcagcaagaataccatacaaagccggagaacaatgaccttttgacaagacaaatctatcccgctcaggattttttgcgtctttgggatttacattcatttccttaaaatataaatatgtaagaatatcagcaaccgaaagcgaacctcccgggtgaccggcgccagcgctgtgtacggcttctaaagccatctttctgacgtgagccgcatgaattttcaaatctttaagctctgttgaatccattaatatttcccccttgcaaattgtttgttttttcctataaattagtttaacacaacttcaataaattttcaactattttttatgacagttttgttggtttttcacttttttgcaaatataaaacacattaaaatttctatctggaaaacaccatttctgatattaaatcaacagagcgttcgataccaagcaaaccgctgttcacagtcagatgataattatggcaatcgtcccacgcatagcctgcatattttttatgatatgcgtttctgtttctatctatcgtcttaacggcatgctttgcctcagaatctttagaaaaaccgtattcttcctttgctcgtttgatacgaaaatccttgtcagcatggataaacactctataacatccggggtcatccttcaaaagataatccgcgcatcttccaacaataacacatgaaccttttttcgcaatatccctaatgattttactctgagcttcgaacattttctcctcatttgaatagtaattttgcactgcgagaccggcaaacgccatattagctctgggcataggtattccccaaataagaggactggagacatgttcttcaaatttgtctatataaccgctggcaaaaccgctctcttttgcaaccatgtctataagatttctattataatatggtatatccagtcttttagctacctcttcaccaatctgtctgcctccgctgccatactctctgcaaattgtgattataatcttaccgtttttattactattcattttaaagcctcctatgcataattataaacagatttcatttttttgaaataatatatagtcattagaactcctaaaacctctgcaaccggtattgacagccaaacaccgtctattcctatcacagcaggaagaagcaaagctgaaattacaataaacaccagcgtcctgaaaaatgaaagaatcgcagaaacaattccattattaagagcagtaaacattgctgaagcgaaaccgttaaatcccataagcaggaagcagattgaaaaaattctgaaacctctcacagccatatcataaacgtttgttccgctatgtgtaaatatattcacaagagggccggcaaataacaaactggccgaaaatgttacaattgaagcaactaaaattgttcttaagctaattttatatatcttctttaaacgctcactgtcctgttttccataattatagcttattataggcgatataccaaaagaataacccatatatgcagaagcaagaagaccctgggtataaagtattatcgttatggacgcaactccgtcggaaccagccaaacgcatcaatatattattgagcagaattgtcaccaccgcattcgatagactggtaaccatctcagaagctccgtttgaacagctttttaaaataacctgaatatcaaacttaggttttataatatatattgagccgtttcgcttgaataaaaagtatataaaccctacgaccgacggaacagaataaccaatacctgttgcaagagccgctcctcttatccccattcccaaaactgctataaacaaatagtctagaatgatattaactataccgcctataactgaaaaaatcaatccaaagtgagcttttccggctgtaataaatgacatatgaaatatcataccgaatatagaaactggggtaagtaccaaaataggtatagcataatctctgcaatattcaattatagaatcatctgcgcctagaaaatgaagcaaaggattcaaaaatatatagcatatcaccgcaatcaatgaacttattataaacgctacaactatcaacaatgagaaattttctttagcttctctattctttccctctccaagttttttagctatcagcgcatttccgcctgaaccaaacattgttccgatagccataatcatcaaaactatcggcataacgatgtttactgaagaaagtgcgttggttccgactaatctggaaacaaaaacaccatcaacagaagaatatatactcataaatatcattgaaattatagtaggcaatgaaaatttaataagcattttaaaagatatatttttatctagcgcctgattttgttccatattttctcctttgattaatttatctcgggacaacctcccggaaaagacagtataacagaataatgcggctttgtccagcaaaaaattggataatacggaaccaagcgaaagagccgaaacaatatgtttcggctctttcgcaatgaatggattatatgaaaaactttaattgcattaaagcaattaacaatatcaagctccgtactccgtcggagcaagcgccagggtaactgtcagattaccgtttctgcatctaacagcatcaataaagtctttctcattaacgtctttcttcattttaatactatacataacttcatacagcgaacctaaatcagttgtcctgactctgctcataacactggcggtcgtatattctttgaacaaatcatcaagcaaaccctgataatctaaatcctcaggaatagttacctttaatattttctgtgtctcaaaactacttgcaaagttaaatttattcagcagaatcataagtacacatagtaaaaccactccaagtgcaccatataaatagaatcctattccagccgcaagccctgccgccgcgcataaaagtatatacgcaatatctttcgggtctcccggtacgcttctatatcttatgagcgacacagttccggctaaactaaacactcttaccaaattgtttcccacaagcaaaattactaaccccataactgccggtataagaaccagcgacattacaaagtttctgtttggaactacctcgtttgtagtaatcatatatgtaaccgatataatgagaccaaatataatggcggaaaacaaggtagcacaagctgaaataaatgttattgatgttccgtcaataactgtttgattaaaaagatttgttaaagcttccatagattatttcctttcaaaaatttatatcaggcgtttgcagttttgtaacccttagaaaaattttgttcaaaatctgcagttataatatttcccgattccctgacggcactgtatttttcttttgcttcaacatagcttcctgcttttgcggtgatacgcttaagcataggagtataagcgccgactgactttttaaaaccatatccatattttgaaaaactgcaaggtattatattataatttgacaatatatcagtaagccaaacaggcatagttttgcttgtcttaacttccatcagccataaatcagcgctgtcaagcagaggttctccataatcgcctaactccagctcaaggtcatagcgcctggttcttaaatttgtatcaagagatatccttaaatcaggattatctttttcaaaataggcaaccctgtcatatgctacatatgcggcaggaaccagtttgtaacatttcaaaaaatattctatctctttaagaacttgtaaattcatatattccttataatcaggaacttttccggtttttataaaatcatatgcttcattaagatataatgtagttcgtcttttattaacaagaccgttaaattttttctttatctctaaataaaccttgccgttttcctcgggaactccataacctctcagcctcagtttctctttataaactggcttacttagagaccttcttacaagcaagtcatcacttgtatcataatatatattgctgattgtgtatccctttccaacctcgctgtatggatctaactccatatattttttgagttcttcagagactctgaaatatgtttttgaattcataaaaaactttttttcaaatctgttaaagacttcaattgccatgtatccacctccaatcacatcaacctgtttaaatttgatgtgattataataatcttattaccttaaatcaaccttaaaaaatcaattattttttaaaactttttcaaaattgaaatattaaaaacttctttcaataatatataatattttaagattaatttaagactgttctgctattattcttttattgataacagacgtacgttatgttattataaaaatataattgtgaatttatttattaaattccaaaacgaagggactaaaatatcatgagaatacttgttgtagaagacgaaatacatttagccgaagcccttgttcagcttttaaaaaagcagaactatactgttgatagtgtgtatgacggtgaagacggacttgactatgcaatgagcaatatatatgatgttgtcgttttagatctaatgctgcccaaaatggatggactgagtataataaagaatatgagggagaccggaaatgatacaccggtgattatgctgaccgcaaaaggtgaagttatggacaaagttaaagggctggacagcggcgccgacgactatcttgcaaaaccctttaacaccgatgaattactggctagaatacgagccttgggaagaagaaagggcgaagttacaactcccacagggttgacttttggtgatattgagcttgacacatcagctttaactttaagctgcgcttccaaagaaataaacttaacccttaaagagtcagaattattagaatatttaataacaaacaaatcaaccgtcctttcaaaagatatgataattgaaaaactttggggatttgactctgaggctgaagccaatcacgtagaagtttatatatcatttcttagaaaaaagttaaaatatttagggtcaaaaacttcaatagttacagttagaggcgttgggtactcattgaaagaggaataatattatgtttaaaaaacttagaaataaatttttaacgcttaatatgattatgatttccatattacttgtcagcgcgttctgcgttgtttttatgatgacttacaacaacatcaacactgccgtaaacatacaattggacagaggtatttctaatattcagcccaaaggccaaagattttttaatccatttcaatcagacccaaacatgaacagaaaagaaatttttcctcatattcccaataacgaaggtcctgcgccggatgagccgagctcgcttaaactggacttagacggcaatataatgcagacgcggtcaccgtatgaatatgatgatgaattctatacaacaataaaagacaacgcaatcaaaagaattaaaagtaatagttctaataacaacacaaaaacttctcatattataaaatatgatgattcctattggaaatacctaatcatatcatcatatgaaacagatacaagcggaaatgaaacagccgtttattatcttagcatctcaaatattaatactcaaatcggaatgctgcaaaaacttattattactttatctattgtccttttggctgctttaattttagtattcttaatatgcttattttttgcaaacagatcaataaaaccaatagaagacgcctggaacaaacaaaatcaatttattgccgacgcgtcacatgagcttaaaactccactaaccacaattaatactaacattgatcttctcatgacgcatggagacagcactattaatgaagaaaaaaagtggctgaattatattaaagacgaatcctcaagaatggcaaaactaaccaacgacctgctttatttagcaaaagttgaccacagttccgaaaataatataataaaatcaaatttttcattttcctctgctgctgaaaatgtcatccttacaaccgaagctgttatatatgagaaaagtttaaatttagttgaggatttggacgatgaaatatatatatcaggcgatgaaagtcaaataaaacaactagtgcttattctcttggataacgcgattaaatatactaatcaaggcggaacgatagaagtgacgttaaaaaaacttgataataaaacagccagatttataattaaaaacaccgggaatggaattccgccggaagatatatcaaagatttttgacaggttttatcgttcggacaaatctagagacagaaaaagcggaggctacggcctggggctatctattgcaaagtctattgttgtttcacataagggaactataaaactaaaaagcgaaccaaataaatttactgaatttattgtggaacttccaatcagtcaacagacataggtaatttatattgtgtaccacaagctgattgcaattgatataatatggaaacagttttaaccaaaagcatcaatacaaccgcccaatttccggcggttgtattgcattgttcaactttaatcaattttctgcgtctgaataagacgatcaagcacttgaaaattatgcagcaagttctccggtttcatgccatcaaatcccccaaaaactgattcatttgtaaggctgcttaatactacatatccttctttagttggaacacctatgcttagtgttgaacggtcataatccagtttaatgataaatttactataaagatatatctgccactcaaactcaggataaggtgagttgctgccttttatttcaccaaattcaatattttctccccagacttgtaaagctgttttctttattaaatcaatattttctactgcttcccagtctgttaagtaattatttaacataccaaaaacctccttcaaagaataaatttgagtctgtaagatttaacgttgactcaagaaattcccattcatctcttaaaaatccaccgccaagagcacatgaatcatgtaaaatcttattaatggatttttggatggattttgctttggtaagaaaactattgttacagtcatacaaaaacagttttagtaaaacaaattacaacactcaaaaaatctgagtgctgcgattctttaggcattaccctaaataaaatggcagtcgttcttgcacatcacaagcgtctatggaaagcaatgttactaaattccatatgtccttgatacttttaccataaaaaatattggcatttacaagttgctcaaatgaatcaaaatcataagcttgtgaaccgtcttccactaatccaaaccaatatatagatttgttagtttcctcatcaatcatttttcctagccatgatgattgatactcaaaacatccatcaacacaaaactctatttcaatgcaagggtcttgttttttagcaacatcgtatgacatgatacactcaaaatctttaaaactaatttttttcatatacatactctctttctatattatcttgatacatgttcatgcggccattcagagtgagttttcggattgccgtggttggtcatatttacatctcttatttggtcaccgttctctccaaaccatctgcgtgttttaatatttccagcatcatctaaaatatctacacttgagtttggctcgccttttaatcctggattctttgttgcggtgttatgattcttgtaaggtgtaatatcccatacacattctatttatttgacgttacagactcctccacacaacctcatactgagatataatgagtaaacaaattcgcccaaatgtacaacacaatacttaaagttgatagttatgttttctttatatttataaatcaaactactgtccacttaaacatatctttaaaatcattaaaacaattttcacaaatccaatgataattgtctattgtacagcactccatttttttatcatcgcaaattgtttcattgcaaaattcacaatgctcatgattccatgattctgaatgtttctggaaatatacatatttttgtttttcaaacaaatagttcatttgattagttaatctccagtcattttggtttatcattattatagttcctttcatctcttttacttcatatgttccaacttcaaaaatcctataccatgatcatttggcgctttttatttataaagtggttttattgggagttttacagtaaagaatgatatgagctgttctcaagtgtcaatgagcatcgcgtaattgtatttaaataaagtttctattgaaaacaaatttgttgctatttttataaaaatatatcatcctatatagaatcaattatgtttaaaatttatcgtccctaaaaagcttctctacctcactcattactcttttacacacatgaatattagttacactattataattttgttcaatgaatttaagtaaataaaaaatattctccattttttgtttataattaacttgtttatttttatccattattcgtgaaatccatccaacactaaaggactcgttttcctttataaactttactgatatatcacttgcttcttcataacgttcataaaaaatggaaaatttgacttttccattagaatatattaaacaataactgtcttcatcaattataataaaaccttttttaaatagaaattcagtattttttaatataagttttttttcataatcattaattaccggcatcattatttcctctattattatctatttttatcatcttatttagtttattatcaaccaaattgtcaagtatttgatatctttgaattaatgagtatcaaatcaaatatttatttactgattattaaattttgtagttctaatcctctgttcttctatatttgtttctttaataagaccttgggctacttctgaccctaattgaatatactcggatttagaattacaaaatattatctcttctaaacgattgacagcgttatgtaaaatattataatattgttttgaacaaacatcaggataaggtaatgtttcaattctgctttggaaatcttggattgtaatcttcccttgtgaaaacgcttgacaaagttcaataagttttttaaaagaattcatttatttcacctttattttaaaaataacgcaacagacacccctatataaaatgaggttgtttgtcttgcgtcttattacttattcatagcttaatctcactttagcttcctccagtaaacccaaaaaccaatccacaggaacttccaagttagagtctttcgcataccattggagaattaactggccatcaattttccgaatgattgccacatctttttcattgtagagtatctctacgattaagttgtaatcatcgtatggatcgtttccaaaatcagcactccaaacacctttttctttcatttctattcaatcctttagtttttattttgtatacttttccaagaaacctataaatgttttaccatcagcagaccatcgtactccagttccatcaggtaaccgaacatcaagtacatctccaaatacagcctcgtgattatgtgtttgtcatcctaaaataattacactatttgttccttcaatcccggaatggatttactttcaaaatattatcatactctaattcagccatttctgcatattccttacctatagcatttaaatactgtaactctttagaaaacattatacgccgaaaatcttgacctaaaatccgattttttgcttcataaatagcggccgcatcagaaattgcccccttgatagcccaataagttattttagacaaactttttgtgatgtcatcattatatagaatgtctctttctaaaactctataatgatatccatcttcatccgcaaaacaaaattcaccttgaatatcattaagtgtatttttgcgaaaaaaagtgtttagaggcattgatataccatcttcattcatcactggtactgctcttgtatataaagataaaacatggttttccaatgtttttgtatcaaatatttcactcatacttttatttcctcataactctattttttaattattttgatataaccatatctacgtaattctcgaattgacataggcaattgatattgtgttccaccacccggttgatcaaaccatggagcacttgtgcccgaatttacatcaaacgttccgtgaaacggagtgttcaaaccgtcgaagaacccacaaatgtgtaaggcaaaaaacagtttttcgacagtcatacacccgtccataatggacgaatgtatgactttgcttttctaaatgctctttacgattttttctgcaacttcttcacattcacttattggttttgtaaaagtatttaacccaaagctattcaaaaatacctgataaataacatgagctaattcttttgtacccattccatttttatactcgttacaaatttcttgactttcgtctaaatactcatcttttggggcaaaaggaaatagacctatcggatcccattcatcaattataacatttatttcttctaccattatattttcctcctattctccaaataattgctcgacagtgtttaccatatttgcatcaaagtcagcttttggatatgtagttacaagttcgccggcattattaagcacaacagcgccttctctggtaatgtaaatatgatttccgctgctttgtcttaaaaccttcccgttagcaacccaatcatcagccatattttacgtttttaatctttattataatatattttcaccgctcgattttgttgagttctgtgaatagctacattactgaatttagggtattgtattgtcttgaaaaacaagcaaaaagataatgcaaagcatcttacatgagttctgctacgacaacattaacccaaacgagcaaatctttacaagaaactcggagtacaataaaaccttcgtcttgtgtgcgccaatgaagaaaagttactgaaatgcttgaattcagaaaaaaagagttgtttgtaaatttctcaaaagcacaaggtgacttgcactgtatatccattgctgatggttttgtttacagattctgcttggatatgtggattgcagttgatataattggtaaacagttttaaccatgaggacaacacaacacctatatatttgtacgttgtgttgtggttaaataaactaaattgttaaagatatatcatccctgaatacaggtttaatccataaagctttaatttcaccctgactgtttaatgttgcaatagcattttcaatgaaattaacattaatagttcctttaaaatcaggatctccaacgcaaaaccaaccagagctagagtcaaagaacatttcccattcatcgtccctattatcaagcctcttagttccccaatcaaatacatctaatagacgtaatgcacatttatgagtaactttaggtatattcaattttatggctttccaagattgatatggtgcaagtccaaatatttgattagcacacatattatttacatagttagtatcatcagaatcacctgagacaaaaccagtttgaatgtatgtgcacagtagcgttatttcagaattcttctcaggataagtatccattccattttcacttaaattataaaacacatagccatcagccattggtttatttgtatcagcacaaagtctaatcattttatacatcctcctttttagtttgcaataaagttaaagtgcacaattgtattactgtttagatcgacaaccaattcctatgtaccgtttgcatctctaaaactgcctggtacatcccaacgtaatccattaggcaaatgtgcgtcttttataggtgtaccgccttgcattatttcatcaactaaggtatttgtaccattagtatcaatgtatggtcttgccggttcacctttgtatttaccatgtttaacataatcatccatgtgggattgaacagtaccactatttttcaaatcagatactttaggaatcttactccctgcgccttcgggctgagggacgtaaggttccggaacaaatgcgatttgaggttctacaaccgctatgtcgcccatcattgaacttgcgtatggcagactcataaatgcgttgagtgacccttctaatccttttattaagctgtcttcaaactcagcttctgttcttgcaaacatcgcatttatgtaatgatacagaggtatgtttccaaataattcatcaatgaagtcttctactgtatcatttgtgttcgggttattttcttcctcgtaataatcaattaacttgttgttcatttgttctgccaaagtgtaccttaaactcggcggcggcagtgtttcttccgctctgtgcatttcttctataaaatgcgatacggcagattttctcgctttatctcctaactcatcatagttcgaaaacattgcaaaagcgagggctgctcccttttcaacataatcattttctgcctgcatagaatacggcgctgacgacagtgtcagcatcttctcgaatatctcagaaatataaaacaagtcattctgtgattcaaaagaaaaatcagcgtatttttcaagcatagcgaaaattgctgataaatcaatgattaagcttccgccagcagctataatttccgcacaccgccagccgtatttggcgttcgggtccttgattggacgaccgcaccgatcacatcggttctgactcaatttatcatctcctttataatatcatatttttttaaaatattcaattcataccaataagtctgaattgatatttctatgatataccaaaggaagtgacacagcgtgaccttatttgcacattttgcaaaatgtgcaaagataaaaatgattatatatactgtagaattctataattactaaatccgtttacaaaattttaaataagtaaaaactcctaaaaataaaataccccggcttgtacaaacggtacaaaccggggcaatatataaaacgttatatcttttacataaatatataaactcaattaaatttcagctatatttttaatgcaaagcaccctgttctactacgacaatattaacctaaacgagcaaacctttcactcgcagcaccgaatacgatagaatcctacgcacgttatgtgacgatgagaaaaaacttctcgcttgcttaaatgcagaggaaaaaatttgtttgagaatttctcaaaagcacaaagtgacttgcgctgaatctccatagcggatagtattgttaacgggttatgcttgggcatgagaattgctgtcgaggtaatgcaaaaacagatttaacattacttaagcaagaagtcctgcaatgcagtacttcttgagattgcatattcaatccactacataaacattgaatggttttgctttacctccaacttgatattgctctacttggctttgccaccacggcaaaacatttttttcaaaagattctatgatgatttctttttttcgcaaatctcctgacataaagatatcaaaattgttgataatgagtgcatagccgtttgcgtttaaccaacttaaatcagttatccaatcaagatatccatcgatactcagtccatttacatgcatttctataatgttggcagggaatttaaaaacacgttcaatttcatctgcataatcttgccatgttgagatgttgtcaccatcaatctctgcaatccatgtattgcttttactattaagctgttgtttaattgaatttagttcatcttttgtaatttgatatattctattttccacattaaaacctcctctactttatttttataaatggtggcaatcccgttggacttacactctgaccataatgactatcagtatagtatattgacccatcactgccagtaacaaatcgcgatgcatctctaccaattccagaggtgggtgggttaacgtcgaattctttataggttatcgaattacctctgctatccatggttggcaatttaaaatcataattatcatatacttttcctgctcttgtacccgatgcttgccccgaataattcccttataatcattttctgcctgcatagaatacggcgctgacgacagtgtcagcatcttctcgaatatctcagaaatatcaaacaagtcattctgtgattcaaaagaaaagtcagcgtatttttcaagcatagcgaaaattgctgataaatcaatgattaagcttccgccaggcgctatgatttccgcacaccgccagccgtatttggcgttcagatccttaaatggacgaccgcaccgatcacatcgggtttgactcaatttattatttccattataatatcatactctttttaaatattcaattcataccaacaagtctgaattaacatttctatgatataccaaaggaagtgacacagcgtgaccttatcgtacattctgcaaaaagcgcagagataaaaacggtttttatatactgtagaattctataatcactaaatttgtttgcaaaatttaaataagtaaaaactcctaaaaataaaataccccggcttgcacaaaaagtacaaaccggggcaatatataaaacgctatatctttaacataaatatataaactcaattaaatttcagctatatttttattgtacaaaattgatattacactatacgtttggaattaacatattcacgccaatccaaatcaccattctcaattcccatgattaaaagctcagccgtagcaatatttgtagcaagcggcacattatgaacatcacacaaacgatacagtgaatcaatatttggttcatatttctgctgcgtcaacgggtcgcggaaaaacagcacggcgtcaatttcattatacgcaatacgcgcgccaatctgctggtctcctccgtcaatccccggaagaaaacactttaccggcaatcctgtagcgtccgcaacaacagcaccggtagtcccagtagcacaaatattatgcttctttaaaatagcactgtatgaaatacaaaaatcaaccattaaatccttcttcttatcatgagcaataagtgctatgttcatttcctatgcctcctatataaatttctaaacaatctttatctgcgtcatatactaaaatttgcaatatcttatacggcacactgcatctgtcttataaatattgattcaccacaaccaataaaaatgcaataccaacaaaaatatagtaccgataaaaaatcattacaaaaatacaaacagggcaattatctatacaaattcaaaaaaataactttcatcttttcaaatccctgcatttaaaactataccacaacattcacaaaaagtaaagtagttttttcataaaattattaattttattgaattattttcatataggcgtcaaatatgtcttttccaacctgcgccgcaaatgaactgctggcgccatgctctattaccacggcaaccactatctgaggatcgtcgtatggagcaaaacctgtaaacaagacattatcttttccgtcagacacctcagccgttccggttttacctccgacttttaactcgctgttaccaaacacttttgcggcagttccatctgcgacaacctgtctcataccttcttttaccgcttcaaatgttgaatcgcttatcggattatctgaaattacttccggctctttttgcattatgacttcaccggtatcataatccgcaacctctttaattaaatgcagtctataacgttttcctttatttaacactgtgcttatataacttgagatttgtgccggagtgaaaagattatcagactggccaatcgctgtctgaagaacatcaccgggatgccattctcctcctgcagcttctctttcctcagggcttgcaaccgtgccgctgctctcagccagctcgattcctgtcgtctttccaaggccaaatttatcacagtattcatcaagcgcttctatgcccattcttcgcccgatatcgtaaaagaaatagttacatgacacgcctatagcctccgaaacatttattgtgccatgtgtaactccctgagatgaatatgcaagacatgtcggctgataatctgaataataggtgtactttcccctgtcggttatataagtgtcagggtctattaaaccggtttccaaaccggcaacagacgtcaagattttaaatgtagaacccggagcgtaagttccattcaaagcgcggttaaaaagcggattagactttttattaaccagctcctcatattcttcattaaatttttcagggtcatagtcaggatacgaagctatagccaacacctctcctgtgtttggatccacagctatcgctgcacctgccccattatctccgaccgcttcatttatccgttttttcaacgatttttccgccgcctcctgaagctcggcgtcaatcgttagctctgcataatttccggctttggcaggtttaacatctaccacgtctccatatctgccgtcagatgtcattctaacctttttataaccgtcagtgcctttgagatatggttccaaaacagcttccaatccgtcttttccaattatgtcgttcatgccgtaaccgctgtcttttaacttttcatactcctccgcatatattatacctgttctgcctaaaatatgagccgccatatttccttttgcataatttctgatagtatcggctattatatcagcaaaaccggttggataatacgtctctttgattttctgaatgactatattgcttacatctgttgccaaaacaaacggattgctgccgctgaattttctttgctccatttcatatctgacagccataatatccagcttttcagtttcattgaaatcatcagaaatctcatatttttccgcatagtattttactatttctcttaaagtgttaaatgtatcgactttattttggctttcccactcagcaatattttttgccgtatcctcttggattttcttttctctatcctttttttcttcatctgattctttatttttgttaccatcagctgaggaaactgctgaatcggatttttcaaagttatattcagggatctcctcttcctcgttatattctatcgggaaagttgaggtatactcatctccattttcgtgaagcagttttactatatcgtttatatttttatttaactcctctgaagaaatatcagttttaaatatctgaatgctgtatccgcacctattttcaacaaccggaaccccattcctgtcaaaaatttctccgcgcggcgcttttgtagcgtatgttcgtattgtgcggttatcagcctgtatcctatactcttcgccattcactatttgcagattaaagagctttattatacagctaatcgctaaaacagcgacaatggcgccgataattatagtccgccttgtaatatcgtttattttcatctattatcaccaaaattttatcaatacttttttatcttaaaccaaacaagtgtcttttctataaaccacagcataggcaaaaccaaaacagcattcaaaactgtttctataaatataatcctcacagcagaaatccacacaaaggaaccttcgcaaaacatagaatatggtattagataaattatttctgcagctattgtggctcctgccgccattgcagaaaaaacataaatgttaggacgaccataaaatctgtcgcttacaacagcagaaaaatagcctataaacaaataaataagcatatcggttcctataaatctcccaacatatatatcataaaccaacccaaataatattccgcagagcatcccctgcattcttccgcaaaaaaatcctattaagacaataaataatagaaaaacatttccgtttaccccaaacacagacaaagcatttataagcgcgggctggaggattgcaattaatattaaccaaacaacatgatgtaacagtttcatatatatctccctacctgcttattaatcttcattttcttcatccaagtcttcaaaatcacctgacttttttgactttgaggaattattatttttacttgaacctcctgaatcttcatcttcttcatcaggctcaggatttggacttgcagacgatctgtcgtcaatttctttttgttcctgttccgctctctcccttgcggctttcatattagcattttcttcatcagcaacaacatccatattgtttgttacaacaaatacctgtctgatatcacgaaaatcaacgcaagcatttacaaccgcatatctggtcatcgtaaccgtatcgtccttaatttccgcgacttttcctaatctgaatcctgccggaaaaactccgccgaggcctgttgtggttacgtaatcatcaatttcaatatctgtgtcgcgcgacaaatatgacagcttaaactgtctgttatatctaagctcgctgtcaccttcaacaacccccaaatctttagagcgttccaccattgctccggcagaaaacccagggtcaattattgtttcaacatccgcccaattcgtaccaaccttagaaatctttcctatcaaaaaaccatcggaagatataacggtttgctccacttccaatccactgtttttccctttatctattgtaaacccggaaaaccagtttgaaggctcatcagctgtcacatttgcggcggccaaatctaaatcgggattattctgtcttagttcgagcattcgcttaagcctgtcattttcttctgccatttcagcattttcattattctgtttttcaagttcagtattcttttttgacagttcatccgtcttatttctcagttcttttaactcacctaaacaatgagtcacatcatataaaccactcccaatatttccaaaaaacttttgaacaggggacgtggttgtttttattgcatcttcaacagcagtagaattaccgctgttgaaacctaaaaatataagtaaagccactaccaaaagcgtacatcctgataggatgagcgccattttatgtttattaaaaaatttcaaattctgcaccacctgagttaataattctttcttctggtcgcctgcgtcagcatatttctaaatccgccttttcctgccatagctgttcccgccccttttgctacacagcacacagggtcttcagcttgataaacatttatgccagtagcgttttttataagctttcctaaaccgcgcatattactgcttccgcctgtcagcactattccggtttctattaaatcagaagccagttcgggaggagtttcttccaggacacagcgcacagcttccaatataaagtttatatcatcgcgcattgcagagtttatctcgttcgcactaatcgcaacgcctttaggcactccgctatacatatccttgccttttagctctacaacatcagtagtgagcccaaccattgcagcacccagctttatttttgccttttcggctgtagactttgcaatttcaacgttatattttttctttattaattgaataatatcattatcaagagcgtcacctgctgaccgtactgatttggaaacaactacgccgcccaatgatacaacagcaacttctgtcgttccggcgcccacatctactataacataccccttaggctcgtttatatcgactcctgcacctattgcgcctgcaagcggtgattcaataagatatacctcttttgcaccggctgatattacgacctcttctatagctctcttttccacgtctccaatacctgacggaacacttaccgccgcccttatttttgaaaatacattgtttaaattcttgtccagaaactttttaagcaggccaaccgcaacatcaaagtttgttattcctccgtctttaacgggatttaaaacagacaaactgtcggccgtttttccaagcatatctaaagcttcggttcctacggcaattacttcacggctctcacctctggtaaccgcaacagtaggttcgtcaactataattttttcttcattcgcattataaatttgagtactgcttgttccaaaatctatgcctaaatcaatcgccatatatatccctcctgaaagctatataaaatcaggtatttatatcaaatttataccaaactcttctgaaagtatttctcctaatctgcatagaggcagaccaacaacattaaaataatctccgtttatagactcaacaaacaatccgcctattttttgaataccatatgctccggctttatccattggttcaccggatcttatatagttttctatctctttttcgctcaagtttctgaattttacgcctgttgaaacaaaatcacttacctctttcccgctctgagtttcaattacagcaagaccggtatacacagtatttattctgcccgaaagagtcaaaagcatgtccttagcttctatttcatcgtttggtttgcccaatatctttccatcaattgaaacgactgtgtccgctccgataactatggtgttttcaccggattcaattcctgcggctatattttttgccttttgcatcgccagccgctttacggtgtcgtatggtttttcgccttcgatcattatttcctcagattcatcggcaattatttcaaaatcaagtgaaatgttttctaaaatctctcttcttctcggagaagcggatgctaatataaatctcatattcaacctcttaaaactaaattattatatttaatgtgaacctaaaatattcctttataaaagtgcattcttgtaaactcttccggtctataattttcaccgcaaagataggctttgcaaattcttttaatttcattcggtgattccacagtaaagtttaaattatacattttaatattataacatttcagctcttccatcttgtctgccataaatgtagggcagctgttcagcagcacacttctgcaatttttcccatcttttataaccggaaacttttttcccaatctgtcagtaatacagccaatactattacacttacaagagttgctgtccaaatttttaagaatacaattctcagtcagcattaacggctgataaccatagacgcatacttctgtcggtatatctacgccctttgctatatcccttatctgagggatactgagttcaggtgacagcataaccgagctaaaccccattataacagaacacaattttactgaattactgtttgtaatattcattctgtaagatccaaaaattttaaaaccatcaaaaattctgcggtattcagatatattgtgtactctgatcttattaaatcccaagttaaacagcctcattataaaatcaatatatttttcatactcagaatcatgtattattgaaggaggctctataactatcctgtctttatcagagataaaccgtttataatcttcctctaataagcgaaccggcacatatataaatctaaaaattttccctgtcgattcttcaaactccttaacagcagtgaactgttcatatgaaaatattgaagctgtcataccgctcaaactgctgtcgcatccagcagaatgatttaaagatatagattcatttctattttgtatatcaatgctgtcagacaatatttcatcttcaatcattttcagcgcttcgcggcggatgtagtttaaatctttaatttgaacatacgctctgccggtgacttcaaccgatattgaatcaaatatgaagacgctgcctccggtctttgaaatctgctgaataaccctttccttttcagttggatttgaagatgccgcttcaacagtattattcgacctcaccgtaattgtcttatttttatataatacaataagtttaatcttttcacctacagcaatatttactttggctgtcagatgaattttaaatttatcttccctatccttgatttcatctaaaatttttgtttctaaactgctcgtttcttttttataaggattgtccggtttattaaaagcaaacattgctctgccttttttattatcaaaatatccggaactcagacctcctctaaaaaatatcctgtttaaatcgtttatctctgatttagatggctgcctgccttcttccagacactttttataaatcttcgttacgcatccaacataagtcggacctttcattcttccttcaatttttaaagaagtaactccggattcttttatatcgtccaatcgttcaatcaaagccatatcttttagacttaaaaaatatttttctttattctcacccgacttatataactgtctgcacggctgggcgcatcgtcccctgttcccgctcctgcccccaagagcgctgctcataaggcactgcccggaatacgacatacacatagcgccgtgaataaacatctctgtctctataccgcaattttccgatatatattttatctctttaaaagaaagttccctggatagaaccacacggtcaaaacctaattccttagccgccaaagcaccgcttaagttatgaacagtaagctgagtgctggcgtgaaactgcatacaaagacctaagttttttgcaagacttaatactcctaaatcctgaattattaaagcgtcaacatgcaaggaatttaaaaactttaaatattcttcaagttcagcaaattctttatcacctataagagtatttacagtgatatgtaccttaactccccgaagatgtgaatatcttacagcattttcaagctggccattgtcaaagttatcggcgtaacttctggctccgaaatttttacccgacaaatataccgcgtccgctcccatgttaactgccgccgcaagagattcaaaacttccggccggagacaaaagttcaggtaaaatatttttttcttttttcatactgctggctgctgaagcactgttaccagtaagagacataaaatcctccagataaaatattaattacaaaagtaaatcgtcagtctttctttataccatcaccgcgtcctattacgttaccataaggatatccagtttttttagtccgctcatcttccacagttcttttgactaagttttctgccgctcctgcgcttctcattccaggctgaacagatgtgcttctcggctgtcttgagacactgctttgggttacagaaccggctcccctagtcatcgaatgagatgaacgcagattttctaactctgtttcacgtttagcaagttcaatttccaacttatgcatatcttctttaaggttttctacttcaagttttttctcgtcaagctcggctttttctgacctggattccaccatatactcgcctatttcagtacgcagtttgcttgccgaatcttcactttttaaaagctcgtcagctagattcatagcggccataacggcaagcattgcagtgcttaaatggctgttctgagacttaacctcagatattttcttattcaccaacagcgcaacgcgctggacatactcctcggactcattgctgacgatggtatattccatattattaatttttacttccatctttgtgttatcttccatagtacaacctctttcatctctcagagtaaattatttccctaaaacttcaagcgctttaaatactccaaacacagtttttgcatcgttaatttcattatccataatcatttttttaacatcgtctataggaataaattcaacatcgagatattcgtcagggtcaagatgattttctcccttagtcaaacctgtagcaagatacaaatgtgtaacctcgtcagcaaatcccggggatggatacataaatccaagataatcaaaattttcagcactgtaaccggtctcttcgctaagctcacgaattccgcatgctctatggtcctcattattatccagcttccctgcaggcacctcatatattgccttttctacaggttttctaaactgtttaaccaatataatctcatcttcatctgtcacagcaacgattccaactccgcccggatgttccactatttcacgaacagcaagatttccgcccggcatttcaacttgttcaaccctgagttttaaaatcttaccgtcaaatatttcttctgttgataccgtcttttcctcgtatatcattaaaacactccttcaaatacaatagtactatattaaaatcactataaatcctaaaaattaattcatacgattactttatctattacctaaaaatcaatataatttttaggcataatccaccataataatctatctttatatttaaccacaatttgtaaaaaaaatcaagtaatttggcgattaacttttatctttcttattatttgtaagtttttaataagtaatcataaaaattataaaatataatatcaaatatattttgtaaatatatattcgagcgttaaagataaaatacaaactataatataaaattaaactaagtatatggtatgctacaaacttatatttgatttgaacgccttttataacaaatgtaactatccgcaaaccattactcacctgagatttctattataaattgacttcttgatctgacagtttacattttcaaagtcaagtaattataaaaaactttaattattctgatatcatcttctatttcataagagtaaagttcatttgttattttttatatatttattttttatatatttattttttattgaaattcttaattattgtaatatagttaaaatgattaagaatcaagttatacgaaatggaatagtatggagaattatgttaaaactaaatataatctgataattattttttcagtatggctatagacggaacaataagaaaacctctggtccgcaatgctgcttctgcttcgtttccgccgaacatcaccgtttgtgtttttacctttgcactaccgtcattaattgtttcaacgcctgaattttttaaaaggaaataattataaaaatttttacataacaacataatttatatttagaccgcaggtgatttcaatgaatttaaaagcacaaaataattatgaattactttttaaatcactgtcacaatgtactgatgacattattttcgttgttgattttgaggcggatgaaattatttggtcagaacaaattaaaaacataactgatatatccaacgtaagaaaaatatcgcaggcacaaaattattggctgaaaataatacaccctgacgacataaaaatgtatactgatgaaattaataatatccataacggaaaaagtaataatcttagatgtgattttagaataaaaaatcttaacggtctatacacttggatacaaagccgcggatttgtgaaccgaacaggagatggcagaccggaaataatgacaggtgtaattaaaaatctcattgctgattacggttctgacaatattaccggtcttttagatatttttgcttttaaacgggatatgtgccaatatatagaattagatatgctaacaggcgcaataatggatttttcaatcgccgatattaaaaagatgaatataaaatattcttatagttttgtaaacgggatattttctatttttgcacgcgaacttactcttttatgccctacaaaaggtaaactataccgcggtcaaggaaatcatatactgttatattatcccgaagctgataaaaatgatgttttaactttatttaaaaacataaaaagcacagttcaagaacaaataaaaaatgagcacaaatatgataagcttgagattaatttatcctgcgctgcagttatagtcaaagatttttcaccgccggaattaagcaatatttataaaggattaaattactgttctgatttggcaaaaaagaacaaaatgtatgacgttccgctgtttttttcacaaaatgattttaaacaggctattgaaaaaattgacttttatgacgagttaatatgttcagtaaaaaatctcgactcattttgcttattttttcagccgataataaaccctaaaacagatacgatccgctctgctgaggctcttttaagatgggaaaatccggcttcatataagtatggtcttgaaaatattataaaagttttagaatccacaggtcttattcttcctctcggaaagtggataatttccacagctttgaaacatcttagagaatggaaaaaatgcaagcctgacatgcacattaatataaatattgcggtgcctcagataggagattatgatttgccgctttttatcgctgatgagataaaaaagaacggtcttaatggctctgatataacctttgaaattaccgaaacatatcagattaaagatataaagtctattcaaaactttgtacatgctatccaccgtttgggcgccgaaattgctctggatgattttggaaccggatattcgtctcttgatatattaaaagctcttcctgcggactggataaaaatagaccaaagtttcgttatgcaggtttcagagaacaaaatagaccgggatattttaaaacacttgtcagacctatgtcactcactcaaaatcaaaatctgtgttgaaggcgttgaaaacgaagagtctttaaatataattgaaaaatatcttcctgatacggttcagggttatcattacagcactcctttgcctgaaacagatttttttgaatcctttattacagataaatcttattgatttttaaaatttaaaattaattataaaattactgttgacaaaattctaaaatatgctataatgggtacgaaattatttgaagagtaagaatgcgtgcgttaagtgttgcttggacggggagttgccaggcaaacgaaaagtctttgacttgcggttcgtgttctgcatcccgcttcatacagcaaagttttgaatctgtttttcacagtcttctttccttgctatatgagtgaggtgaaaggaggctgttatttttatgcaaatttctaaaaacgaaagttacaaatctctgggcggaatccgcctattcggaaatttaaaagtcttgcttatttccggattgttcattgctttaagcattgtgctgggcaaacaattatcattcactatgggtccgatacgaatcagctttgaaaacctgaccattttaatggcaggaataatgtttggtccgctggttggtatgacggtcggaatatgcgccgatgttatcggctgtattatcgtcgggtatgctataaatccattagttacgctcggcgcggcttctataggcttgatttcaggttcaatttatttttatatgtttaaagacaaccctaaattaaagcttattgccgctgtgggtcttgctcatataataggttctatgattataaagtctataggcttatatatctatttcagctatccaatgccgttaatattaatgagaattcctctctatatagtaattggcaccgttgaaggatatataatttatcttcttatgaaaaacaaaaccttcgcaaatcagctggaaagagtgcaaatgagatgaattataatgaatcgctggattacttaaaaagtatatcaaacagaggcagccgccccgggctgtctcgcattcttgaaattctaaaacttttgggcgaaccccaaaaatcattaaaaattatacatgtagccggaacaaacggcaaaggttctgtatgcagaatgttagaaagcgttctgacagaagcaggatataaaacaggactgtttacctctccgtgtattgattccgaaaccgagtgttttagaattaataaaaagaatatatctgaatccgatttttctgaaactgtttctcatataaaaactgttgaggaaaatatggatgataagcccactagctttgagtttgaaacggctatggctgtttggtatttttatcaaaaaaaatgtgacgttgtaattttagaggttggtatgggcggaagacttgacgcaaccaatatctcagatacgcctgttctttctgtaataactgacgtcgccctcgaccatatggattacctgggaaatacgatttcagaaatttcttctgaaaaagccggaataataaaaccaagctgtcccacagtattcggcggaaataacccggaagcgcttaatgttatccaaaccgcagctaataaactttcctcatctcttttattgactaaaagagaaaacgctgaaattatctcatcaggtttaaaagggtctgttttcaattataatgaatacacaaacttaaaaataaaattagccggactgtatcaacccggcaatgctgcggtcgctattgattcaatcaaaattttaaacaagtcaggctttaatatttccaaaaattctatatataacggattagcggtcactgaatggaccggtagatttgaaatattctcggacaatccgccaataatttatgacggctctcacaatcctcagggaatgactgcaactgttaatagtataaaagaatatttctccggcatgaaagtgaatttaatcatgggggttatggcggataaggactataaaaaaatggtaaatattataagtccatatataaatcaagtctataccgttaccccaaataatcaaagagctttaaacggcgcagaattatcagatttgtttaaaaagaacaacgtcaattcggaatatcaaaccgatatatccaaagctgtaagttcagctgtttcattttccaataaatcaaatacaccactgataatattgggaacactatatatgtataacgatattaaaaaatcaattatttcatgtatccaataatgttgcaatacattattggatacatgatgtttctaaaaactatatttcctctttataactaaataattaattttttaaactttaattgtcttcttattttaccggttatcaaatttaaacctatagctcttcgtcgcctataacaggtgttgttatattatcgagcttctaatatatttgttagcttaatacatgttattttcttatattttaattcttatctttgtaggttatcgctttaaatatacacgaaattaaattcttcatataatgactgtccctgcatattaattattattttctaataaatttataacctgtttttaattcctcaaataaaatatatttagttaatactgcttgccatgaatcataaaaaatttatatcaaaacatacgctatttgctttatactttttgagttaatttttatattttttgactagtaaattttccagcctagcagtataattatatttaagtataaaatataaggaggagaaaaatattataatggaaagtgaaaatattcttgcaagcaaaccgataggaaaactgatgctaaaactcgcgattcctacagttttggcgcagttggtaaacttattatataatattgtagaccgtatttttgtcggacacataaatgaaataggctcacttgctcttgcaggattgggtgtaacatttccgataataatatttataggagcgttttcagcgctgcttggcacaggaggcgcaccaagagccgccatagcaatgggatgcaatgataatgagcgtgcggaaaaaattcttggaaactgtactatgatgcttattattagttctataatcttatccgtcttttttatgattactaaagataaaattctaatcatgttcggcgccagtgaaaacacactgccatatgcgtcttcgtatatcactatttatctcatcgggacaatgtttttacagctgactctagggcttaacgcgtttatcactaaccagggatttactaaaaccagtatgataacaatttgtatcggcgcagttttaaatataattcttgacccgatttttatttttgtttttcatttgggtgtgcaaggtgctgcgcttgcaacaataatatctcagggaatttcttgtatatgggttttaaaatttctgacagggaataagacgcatataaaaatacgcattaaaaatcttcgtctttcaaaacaaattgtatttttggttatttcattagggatttcaccttttgttatgcagtccacagactgctttattcaattagtctttaataacggaatgcttaagtatggcaatgattcatatgtcgcattaatgtcaatattgtttagtgttatgcagttggtatggatgcctatgcagggatttgcccaaggagttcagccgataattagttttaattacggcgctggaaataatgagcgcgttttttcagcattcaaaaaattgtttattttatgtctcgtattttcaatgtcgataattgtaattttggaattattcccacaattttttatcggtatgtttacatcggacgcacaaataattgaaataggtaaaaacgcaattcgggtctttatgttatcaatgtcattaatgggtatgcagaccgcttgtcagcagactttccttgctctagggcaggcaaaagaatcagtgtttttggctatagaaagaaagctaatattgttgcttccgttagcactaatattaccaaaaataggcgccctgggagtttggggtctgtttctggcggagccgataagtgattttatcgcagtattaacaaccgtatcactattctctgtaaaaagcagaaaattactcacaaggtaagaaatatataaattaaaacattaaaaatatactgtaaaaggagtttattatggaaaagcagataatatataaaaatcctctgtcatgtcctgaagatgtcaaagattttataatggaaggcaaggcagatgtttattttgtaaatcaaaaaatgcgtatgaagaatagactttctgaaaatgaaggacaaaaatcaaattttgtatattggtgcccggaagagtttccgtcagatatagaaatatcgtggaagtttcgtcctattaaagagccggggctctgcataatgtttttatctgcgaaaggaattaacggagaagatttattcgactattcgctttctccccgagacggacaatatgggcaatatacacatggagatataaatacatatcatatatcatattttaggcgcaaatgggacagagagcgctgtttccacacatgtaatttacgtaagagcaacggatttcatcttgtgtgtcaaggagcagacccgcttccgaactgcgaagacgcaaaagaattttatgaattaaaaattataaaatataaaggcagaattgagttcttcatagatgagcttaatatattttcctggcaggatgatgggaatgaatatggaaaagttttagacggaggtaaaatcggttttaggcaaatggctcctcttataggtgaatactctgatttaaaagtatattctcttaataaaaaattataagattaaaatattatgaaaaataaatggaatgttattgactagtttttgagactgatacaaatttttgattaaatataataaaagcggctgattttttgtgtacgaccacctactgttagatttcatgtctaactatagaggtcgccgctttttagccgctttcattatatattatattttttaaatcaaatttataaacttatatttatattaaactataccatgagccatcattgcttcagcaactttttggaatccggcaatattagcgcccatcacatagtttccttctttgccatattcctttgaagcgctgtcgcacttttcaaaaataccttccatgatacctttaagtttagcgtcaacctcatcaaatgtccatgaatatctcatgctgttctggctcatttccaaagcagatgtagcaacaccgccggcattagcagccttagcagggccaaagagtattccattgctttggaatacagctatagcttcaggtgttgacggcatatttgcgccttcagcaactgcgaaacagttattagcaacaagagcccttgctgattcttcatcaagctcattctgtgtagcgcatggaagtgcaatatcacatggaacagtccaaattcccttgcagccttcatgatattcagcctcaggatgagtatttaaatactccttaattctctttctctcaacctctttgatttgtttaacacaatcaaggtcaataccgttcttatcatatatatatccgttggaatcagacagagcaactaccttaccgccgagttcagtagctttctttgtagcataaatagcaacatttcctgaacctgagataacaacagtcttgccgtcaaacgacttaccgttagcttttaacattgcctctgtaaagtagcaaagtccaaagcctgttgcttcagtacgagccaatgaaccgccgtaagtaagacccttacctgtcaacactccggtgaattcatttctaagtctcttatactgtccatacataaatccgatttcacgcgcacctactccgatatctccagcaggaacatcagtgtcagctccgatatgcttagaaagctctgtcataaagctctggcaaaatctcattacttcaccatcagatttacccttaggatcaaagtcgcttccgcccttaccgccgccgataggaagacctgtaagagagtttttaaatacctgctcaaatcctaagaacttgatgataccctgatatacggacgggtgaaatctcagtccgcccttataaggacctatagcgctgttaaactgaactctgaaacctctgtttacctgagtttttccattgtcgtctacccaaggcactctgaaataaattactctttcaggctcaacaagtctttcaataagtccagcagcttcatactcaggatgcgcttctacaacaggctccaaagattctaaaacttcctcaactgcctgaagaaactcaggttcgtttgcgtttctcttttgaacctgctcaaaaacattctttaaataaccgtttgaaattgccatgttcataattctccttttcattataatatatataattaattattttttacgctgtgataaatactcgtcaattgacgcagcagcagtttttccggctcccatagctaaaattacagtagccgctcctgtaacaacatcaccgccggcatatactccggttttacttgtctctccggtctcttccttagcaacaatacatccatatcggttagtctcaaggtcaggagtagtattctttataagcggattaggagtttgaccgattgctactactacaacatcagcatccaaatcaaattcactgccttcaaccggtacaggtctgcgccttccggacttgtcaggctctccaagctccatctttatacaagttacactatcaacccagccgttctcgtcgccgtttatcttaaccggattgttaagaagtttaaactctattccctcttctttcgcatgatgaacttcttcaagacgcgcaggcatctcttcttcgcttcttctgtaaactatgtaaacattctctgccccaagtctttttgcagaacgcgccgcgtccatggcaacgtttccgccgcccacaacaacaacattcttaccaacataaacaggcgtgtcatactcagggaatttataagccttcatcaaatttattcttgttaaaaactcgtttgcagaatatactccatttaaagattcaccctctattttcataaagctcggaagccctgccccggttcctataaatactgcgtcgtaaccttcttcattaagaagctcctcaacggaaagcaccttgcctatgaccatattagtcataacttcaacgcctaactcctttaatttattaacttcagcagcaacaatatctttaggaagtctaaattcaggaataccatacaccaatactccgcccggtgtgtgaaaagcttcaaatacagtaaccttatagccaagctttgcaaggtctccggcacatgtcaagcctgacggtcctgcccctacaacagctaccttttttccattgctctcaggcttttcagaaactgatttacaattttccatataccaatctgcaacaaatctttctaaacggcctatagctaccggctcgcccttaatacctctgacgcagaacttttcgcactgattttcctgcggacaaaccctgccgcaaaccgccggaagagaactggtttcctggatttttttatatgcttcctcaaacttgccttctgcaacaagcgcaataaattcaggaattttaaccattacaggacacccctgcatacaaggtttatgcttacagttaagacatctctgagcttcttctacagccatttcctcagtatatcccaaagtaacttctttaaaattcttatttctcacatttggttcctgctcgggcattggcaccttttcaagtgacatattaggcattgttcattccctccaatctacatttatgcgcgcgttctctcgactctgcctcctgatttttaaacattctcgagcgtgcaatagcgctgtcgaagtcaaccaaatgaccatcaaagtcaggtccgtctacacatgcaaatttagtttctccgcccacagttattctgcagcctccgcacataccggttccgtctatcataatcgggttcatgctcactattgtctttatatcatatttgcgagttaggtcacaaaccgctttcatcataacgagcggacctattgcaactactaaatcatatttttcaccggaatttataagttcctcaagttttgctgtaacaaatccttgattcccgtttgatccgtcgtctgtcattgtatataaatttgtacaggcagctttgcacagatcttctattattattaaatccttatttctgaatccattaatcatatctacagaaacgcccatagaatgaagcttttttgcctgcggatacgcaatggcggtacctaaaccgccgccgataacagcaactttttttacaccctcaaaatttgaagcgactcctaaaggccctaccatatcctgaagactgtcaccttcaccgagttcgttcaaactttccgtgctctttcctactatttggaaaataacagtaaccgtccccttgtcacggtcataatcagctattgtgaaaggaatacgctcgcctttctcatccactcttaaaattatgaactgacccggctctgcctttctggctatgtacggtgcctctacttcaatgagtgaaacagatggattaagcacttcttttctaacaattttatacattactacacctccataaatatctgcacatctcagtctatttaatttccaatatagacatttcgttacattatatcataatccgctgcttcatatcaacagaaattttgcataaggattttatactcatacgcctagatttaacaaaaaactataaacttcctctaactgcacaaaaaaagagtgcagctaataaagccacaccccattgtgcgtcatagaacataataaaatttcaaattatcgtatcaaaaatctatatattatatctcaacagcgccattgctgtcaaaatacagaatttacaatttgaataaagatttttattaaaaaatctctcaaataattgtcttactgcaaactatatagaagttcacaaaactttattaagtatataataaccaaattattttgtcaaggactaatttaaaatttttttaagatttatattttattttttgaaaatgatgatagtcgtaatatcttccctgccaaatttcacctccccagtcccagccatatgatttaaatatatcataaactttatctcctttatgtatcatagctttttcctcaacctctgaaatatcaggataagttaaacctctgtctgaaaactttagaccgttctcaggcagtaccgttcccgtctcagagatataaggatttatttttggatttatatctatcgcccgtcctaacgaatgattagaaatccgttccgtgccgctcacctttctgcagcagaatgctgatgtgttattatgcctcattgattctaaatccaaatcctccgcttttccattataaaaatagtcaattaactcaattctttcaatcggatattttaaatcatataattttaaaaatatctccaacacctcgtttttaagttcttttgaaataatcaaatgacctaaacaaattttaaaactgaaatcataatatggaacgcttaaataactcaggtcatcataactgactatcgagttttccggcattgattttcctttcataagtttcattatttccttgggaatcatttcatactttccgctttttcgagttatatttacaaaattctggtcacacatattttcaccttatctttataataatttatattaaaatattatgcagtttttgaatttattcttgacagaagctaataatagtcttaaatgacaatcattccgggagggattattatgataagaataaataacagtctcattataaacgctgaatctccaaatgaaattaaaaacgttattatcgatgatttggatatcataacctgcggactttcattaaagtccagtgttacagcctccagcattgatgattccggttttttatattgtatacaaagggggttttcaacatgcggcagtgacgaaataatccttcctcaagaattcaaaattggatgggacaaaaaggcggaaaatatatatccctgtcttgaacttgtaaccctcatgcttgtatcaggaaaaactcctgatgaaatctctgaaaacatatatttttacaattaaaaaacatttatataaaaaccttacttttatactattatattcaaaatttattgactgtttcttcctgatatgttaaaatattaccaataatagattttcaaaatattatataatttaagggaggtattagaaatgaaagtattgtctattgttatgggcataatttatttaatcttaggtattttatgttttataactccggtttttacagcaaatgtctttacatatataattgctgcatcaattttgcttgcggggatatggatgattgtttcatatttcgtaagccagggtgaagacagttttataaagaaaagcggatggtcattggcttttggtatattaacagtcatattggctttaatactcatgtttaagcctgatttcgctaatgttgttatggcgtcaattttcggagcatgggttattattgcaggtatagccagaatatttgaggctttcgccttaaaagatattggaagctcctggggttttgttttagcactggggattctaacgcttattcttgggatattcttagtttgtcatccgcttataacatttgtagctataggtatatttattgctctttcactgctgtttgaaggtataaacttcattattatgggatgttctttataaatttcatatagtctgacaaaattgaataaatatataataaccatattgatagagcacgtgataacacgtgctctattaatactattgttcttaaacacggagggaagttaaaatcatgaaattcaatctatttggaaatcaggaatataagaaaaatagatttatgcttggtctgtatattattctgatacttattgttataagttctataatttttcaaataaaatatcaaagatacgaaaatgttttcacttgcgtgctcactctaatattatttttgatacctagatttatcgattacagatttaaaatcgacttgcccagaacccttgaggtaattatagtcctttttatttttgcagcggattttttaggggaagtaaacggtttttatcaaaggtttccctggtgggactcaatgcttcacatgtctaacggattcttaatggcaggcgtaggcttctcattgatagatatacttaatcaaagtcaccgcgttcagttccacctatctcctgcatttgttgttatggtcgccttttgcttttctatgactatcggagtactctgggaattttttgaattctttgccgatcaaatccttagaacagatatgcagaaggacgctatagtgaacagtatttcttctataacaatgaatgatatttctatcaacaaatcaatcttggtttcaggaattgacgatgtaattttaaaaggcaatcatctattgatagatggagcgcttgcaaaaaacggaatgattgccatgtcggattatggaattaacggataccttgatattggccttattgatacgatgaaggatatgatgataaactttttaggcgctgtaatattctcaataataggctatttatatctaatcggcagagccaaagggaagtttatagaatgtatagttcctaaatttaccgaactatcaaaaaataactcaaatggaaaatcacttactaatataaagaaaaccggcggttcaattctaaaaataaataaagacagaaaaaatgatgatgaataatttatgcacatattattattgacggtttttctgttttagtgtataatgttttaaatacactaacggaaaggcggtagatttatggataacaatattaatggttttgactatgaaaatattgataaatatattgagcttataagaagccaaaattccagatggaacatgattccttcacattattataccaaatacaatgttaagcgcggtcttagaaatgcggacggaaccggagttcttgccgggcttacatcaatcggcgaagttcatggttatgttattgacgaaggcactaagtcaccaatagaaggtaaactcagatacagaggtattgacgttgaagatatagttgcaaactgcagagctgaaaaaagatttggttttgaagaagtggcttttctgcttatgtttggcttcctgccaagccagtctttgcttgaccagtttaaaaggtctctatcaagttacagagttcttccgcctgaattcacagaagatatgattctgaaggctccgagtaaaaacatcatgaataaattggcaagaagcgtgctggctctctattcttatgatgataatccggacgaaatctctatacctaatctgctcaggcaaagtttttcacttatcgctcgtttccctgtgcttattgctaattcatacgcgtcaaaacgccactattttgataatcaaagtctgattctgcacaaccctgtgcctgaatattcaacagctcaaaacttccttcatctcattagggcagataataagttcactgagcttgaggctgagattctagatttggcattaatgctgcaagccgagcacggaggcggaaataactcagctttcactgtgcatgtgctttcatcaaccggaacggatacatactcggctatttccgctgctgtcggttcactgaaaggaccaaagcacggcggagcaaatgacaaaatgatgtcccaaatgaatgaaattaaagccaatgttaggaattgggaagataaagatgaaatatatgaatacttaaaaaagattctgcgcaaagaagccggggacggaaacggacttatatacggtattggtcatgcggtttacactatttcagacccaagagccataatactaaaagaaagagccggatatttagcagaacaaaccggtcactctgatgaatttgctctttattctgcaattgaagaacttgcaccgatcgcttttagagaaataaagggaattgataaacctatgtgtgcaaatatagatttttattccggtttcgtttatcaaatgcttggtatacctcaagaactgtttacacctatatttgcaatggcaagaatagtaggctggtgcgctcatagaattgaagaagtaaccaccagcaacaaaattattcgccccgcctacaaaagtgcggttaaacgtcttgaatatacgccgatagatgaaaggaaaacacctactaaagccgatatagaaaagaacactattaaagaccaaaccgcgccgtcaatcgattcggaaaccggagactaattttataattgacttttgttgtcttaagcccgtcatacgtaaagtgacgggcttttattttataataatataataattcacaggcgtacattcttatctttatatgctaatcaaaaaattttttaacaaaaatgaacctttttaatttcaaatgtatctaattagtgtaaagcaaaaacaacagcgctgttgaactgctttggaaaggcagaaagtataacatggataattacacatttacgcaaaaggttttagacgctgaacaaaccttatataacatagcaaagtctattcttataatagacaccgactgcgaggatgcggttcaaaacgcaattctaaacgcgtatacaaagctatcctctctaaagaacgaagagtattttaaaacatggctggtccgcatactcatcaacgaatgctataagctaaaaaagcgaaactccaaatttgtcccgtatgaagaacaaataacagctgatattcaaacgctcgacaattctgaggtgagagaattatatcaggctataatggaacttaaacctaaaatacgtgttgcagttgttttattttacatagaaggatattcagtaaatgagattaaggatattttaaaaattcctgccggcactgtaaaaagccgattggcaaaaggccgaaaagctctaaaatcaaatttgtcgtgttttgattaaccatgaaaaggagaaaaataatgaatatagataataataaaattaaaaattcctttccaaaatctacaagcaaattccattcaaaaattcagcttacattagatgagctgcctgaaaaaaaggagatttatattatgaatagaagaaaaacatttaaaagaggattggcaatctgcgctgccgctgttttgttaataggaaccactgcatttgcagcaggcaagctggtcccgatgatatattcaagttcatcatctatacctgattattactctattccaactgaacaagaactggataaaaagctgggatacagcgctaatattattgaaaactttaacaatggatttgaatttacaggcggaaatatagttgacaacaagagtaaggatgaaaacggtgatattaccgaagagtttaaaagcttcagcgctaaatataaaaatggtgacaaacgaattacgctaagtattgataagtcggataactttgaggttggtgaaggcacccatactattcttgccgacaaatatcagaatatagatatttactatacaaactatataaataaaatcgtacctcctgattataaacttactgagcaggataagatagacgaagaaaacggcagtttagttttcagttatggttctgatgatattgaaactcaagaacttcaaagcgtctcatgggttcaggaaggaataacttacaacattatgggatttgaaaccggtatgagccaggaagactttgtaaacatggctaaagaagttatagactataaataatagaacagcagatggtaacagactggagccgtcggatattttaagttactttgattaacacaataacgttaaatcaatatcttaaaaaatatctgacggctccaaattctttattaaatcttaagttatttaaatctatttttccattcttcctttgtcattctgtttacatattctgtttttatttcttttgtaataggccaaaatttatctttttcaacatgatgaaatttaaatccacacttttcctgaacctttttagacttgttattgccttcaaaatacccgcaccatatagttttaaggtttaagtcctcaaaagcgtgacgaagcaaagcgtcaacagcctcgcctactaatcctctgccccaataaggaaccgctatccaaaatccgagttctccctcatcagaaccaatatccaaataactcttatcccctatcatcaaatctataccgccaaccggtttatcctcatcttttaagataattgcatatgtttcatcatttgataaaacacctcgaatagcattcagactatattcaacactggtatgtgcataccagccggcctcaggaccaactctagggtcttttgcatactcataaaggttttcagcgtcttcatctttccatggacgcaatactagtctttccgtctttagtggcattttcataacctgccttttcatgtttaattttaaaacctattttttagtattttcccattcttctttggttatccttgaaatatgctcagttctggtatcattcatcaaaacccataccttatcattttcggtatgatgataagtaaaaccacatttttcctgaactctgcgcgatttgtcatttccatcaaaatatccgcaccatattgttttaagattcaaatcttcaaatccacggcgcagcaattccctgactgcttccggaataagacccataccccaatacggaacccctatccaatatccaatctcgccctcatcatcctcaatatcaaaattgcttttttcacctatcattaatccaatagatccaaccggctcatttgtctcttttaaaacaaccgcataagtttcaggggctgataaaactccctttataacccccgcactgtcctcaatactggtatgcaccggccaacctgcaataggaccaactttcggatcgctcgcatatttatataaagattcagcgtcttcatctttccatggacgcagtattagtctctccgtctcaatcattgcttatcaccgtcatttctccaattttttataaaacttataaactcttctgccggcaatggttttgaaaatacaaatccctgaatcaaatcacagccgatttcttttaaatattcaacctgttcagtattttcaacgccctcagacacagttttcatatcaagagcctttgccatttctataatacttttccacaactttttatcccgcagactattgttactttcccgaaaaaacaacatatctaactttaaagtatctatcggtatatttttcagaacattcagcgaagactgtccggcgccgaaatcatccagcgaacacgaaaatccggctttatgaagctgagatacagaactaataaaaagcttataatcttcaaacacaaaactttctgtaaactctaattcaatacctccgtcaggaatattatatctttctttcgtcccggtataaaattcaacaaagtcgggctgccacagcccttttcttgatacatttaccgaaattggcccgggcacatcgccgctttccaaacatcttttgtaaaaccgacatgcttcctccagcataaaacggtctatactaacaataaaaccgtttctttcaaacaaagatatgaattccgatggagggattatacctttattggggtctttccaccttacaagagcctcagcacccgcgactttatatgtcctgcaatctattttgggctgtagatacattttaaactcgccgttatcaagagcggtttccatacgggattccatttcaatttctcttaaatgttcttccctcatcttatcattataatataccattcggctttcaccggaattttttatcgcttttaccgcaacatttgctctgttaagcatgtcccttagtgatatattgtcattttgatttatcaaatatatccccatatacatctcaattttaaatttatatttttgaatatccggatatgtacacaaacgttttttagctgtctcaaaaaaaccttttaactcatctttaactttatactttcttatggaaaccaaattgtcaacattgaatcttgcaaatacttctccgtctctaattgttttattaatcccgtctgcccaatattttaacagcttatcgccgacatcataaccgaaaattccattcacatatttaaaattttttatatccgcatataaaatagcataattttcttcactatttttcctaatagcctcttcggcgtctatcataaacttttgttcatttctataacctgtcagcgaatcaacaaacgccagcttttccaattcccttctgctgcgctctcccattcttctaatgcgtatcagcagaaataaaaacagtaaagcagatcctaaaattatccctactattccaataatcatattagagtagtatctgctgatgtctgctgacggaacaacacaaaacacaaaccaatcattaacacctataggcgtgtatgctgcccagcgcttttctccattgtaataatattcaatatttccggcttgtccatttcttaaatctgattttaacttttcttttgaactatcatcataattataaggagttatgatatcaggtgaattttgatccacagttggacgttttgaccttataacataattcccctgactatctactatatgcgcaaatccatttcccgcataaactgagttattcaatatattatgaagcgattcggcagcacgaacagcgcaaagggcgcttatcaccctgcctccgcgaattatgggaacagcatagaaattcacgtataaatcgcctatttcagccttctgagtattagttataactctttctcctgcatagactttctctacaaatcctttgtctgaaatatctatatctttatattgggttccatcaatatccactcccatagttataccatttttatcaacaaatcccatacgtataaaagcattatcatcatttatagttttaagtacaggcaaaatagtatcataattaatctcttcaagtccgccaatcattttagcgacgccgtctaaggtttgaaagtcatcctctatctgcttattaacggttgtcttgctgttttccgcaatttctttaatatatttttggctttctaactcattctgaattttacaatagttcaaaaataatatacataaacctataaatataacacaaaatacggccgcaacaactgtcagccgatctttcataatattattttttttatttttaatattgctgtaaaacgatttaaacacaccaacctaccccattaaaaaccgctcttatgaccatctgtttggaagcaaataatcaagagtaacaattttatctttcaacattacttcacagtttatattttcgttatttatttgatatataaattcacggcatcggccgcaaggcggaattatatcatcccatgcgctcacagcaaccatttttataattctgctttcgccggcagtaatcatagccgctattgctgcatgttccgcacaaaaccccatagagcacggagcgtcaatacaaacgcctttataaacatttcctttatccgttaagatagctgccgcaacagaaccagccgatgtataatcggacaattttctttcattcacagtttcagcggctatcttatataattcatcaaagttcataattatctaactccatcatttttataaagccgcagcgctgtataaaaagcaaactgcggcttatcagtttaattaatttctattgtctgagcttcatcatactgttttgaaacactctctggacacttagtaaactggctcacaacaaatatcaccaaacatgaaattataaacgccggaactaactcataaacattaaatataccaccctttaagaagtaccatataatatcaacaatacctcctgtaagcacaccggctatagcagcaggagctgtggtctttctataatagagtgagaataagatacatggtccgaacgcggctccaaatcctccccaagccatagataccaactcgaatactgaactgtttctgtttagagaaataaatattgcaataagtgcaataaccacaacggcatatctgcttattctaaccaatgaatcactgctgggtttcttctttgaaaacagtctgtaaaggtcctctccgaatgttgatgcagtaaccaaaagctgagagtcagccgtactcattatagcggctaaaatagctgtaaggaatactccgctgaggattatcataaagatgtttttagagcccccgaatatggtctgtattaaaaccataaatattttttcactgtcgccgtttaccatttcaacatagttttgggcaaccataccattttcaacatatacttttcctaatacaccaataagaactgcagcacctaaagttaaaattacccataccattgcaattattctggcgggtcttacttctttagggcttctgatagccataaatctggataaaatatgcggctgaccaaaatatccgagcccccagcctaagcttgagaccaaaagcagtatattaatcgttccgccggcgcttttcggaagccatgaaaacacttcattctttgcggcttccagtcctttaaattctattgctgtcccttcaaatccgcccatctgacaaacgataataatcggaatagctataatcgcaaaaaacataattattccctgaatcaaatctgtccatgcgacagctttaaatccgcctgtgaacgtatatccggtaataattacgccgccgataatcaaaccgacaacataaggcacgcccagcgttgcttcaagcagcttagcccctgcagtgaactgagaagcggtataaatcaaaaagaaaaacataataaaaagcgaagaagcaactctgagtatatgagttttatcttcaaacctgttttcaaaatacaccgggattgtaatagagttattggaaacctcagtctgctttctaaggcgtttagcaacaaacagccagtttaaatatgtacctataagcaatccaatagctgtccaaagtgcttctgttgttcccccaaacaccaaaaatgccgtgccgggcaatcccaagagcagccagccgctcatatcagatgcctgagctgacattgccgcaacccatttgtttaaacctcttccgcccaaaaagtagtcgttaagagtattatttgtattataaaatccaaatccaatcagaagcataaacaaaagatatactgcaaaaacgactacctgaataacaatagttaacacaatttttacctccgcccttataagttttgattataaaaatattaatataaaatatgttgttattttaccataaatttctacataaatcaactagttttttggaaataattttcggttaactactgtatcatataattcaattttttattttactgagtataatgctctaagtgaatttattatacataggaatgcaactcccgtatcagcaaaaacagccagccacatattggaataaatacctgttagtccaagaaacattactataattttaattgctagtgcaaacactacattttgttttgcaattgcagtggctttctttgaaattgctattgatttagggacagcatccatatttgaattcataaacacaacgtcagcagcttctatggccgcgtctgcgccgcttcccattgccgctccaacatctgcgccggctaaaaccggtgcgtcatttattccatctccgacaaacataacacttccatactcatgtcttatcttttttagttcactgaccttattttcaggcaaaagttttgcactgtaattatcaacgcctgtatattcggcaacctgtttagcagtttcttctgaatcgcccgtcaatatagcagtcacagcgccctgagattttatcttttttatagccggagccgcttcgctctttattgcatccgcaatcaaaatatatccctgcaaaactccgtctatcgctaataatacttctgaacctcctcccgagggattatatttagaaatatcaatactgtttgcttccataagttttctatttcccaaaattaatgacttatcttcgatatcagccttaattcccattcctgaaagttcatgtacattatttggtcttactatatcaagtcctctgcgtttggcttctgcaacgatactttcgcctataggatgagttgaattcaactcgcaggaagcagataatttcaacacttcatcttcattaaggctgccaaccgtatgaatattttgtacttcaaaattcccctctgtcactgttcctgtcttatccataacaacagcttttattttggacagagattccataaccactccgcccttaaacaaaattccaaattttgaaccggcgcctattccgcaaaaataagcaagaggcacgctcagcaccagggcgcacggacagctcataaccaagaagctaagcgcggtatatatccaaggataaaaatcctgattcagtattaaaggcatacaaatcgccgtgaaagccgctatagcaacaacaatcggagtataaattctggcaaaacgcgttataaagttttcaattctaggcttgcttgcagccgcttcctcaacagattttaatatcctggaaaccattgaatctccaagaactttacttactttcacttttaacagcccggatgtattaacgcatcctgacactatttcatcaccgggtttaactttcaccggaacaggttcgccggttacagccgatgtatcaagccggctctcaccctcaaccactattccgtcaagcggaaccctgtcaccgggccgtaccagcaccaaatcgccgggaactgcaccctctgcaggtataatcttcacttctttatctgcaacaagattaacagtctcgggtcttaaatcaaccgcgtccataatttgacttctgcttctgcttacagcaatcttttcaaacagctctccgacacggaaaaacagcattactcctaccgcttcaggatactcgccaatcacaaaagctccaagcgtggcaacagacatcaaaaaattctcatcaaacactttaccctttgtaatatttttcacggctgttaaaagtaccccgccgccaagtattaaatatgatatgataagaatcgaaaccgttacaatattgtaatcctcaactcctagtatggctttgaatattaacgttcctaaaaacagcactgcaccggtaacaatagaaataatatctttgcggttttcttttatatgtcctctgctttttgtatttccgccgtcttcttttataactactccgctctcaattttctgagccgcccgtataatttcaggaagcagtttatccggattttccgccgtaaccgtaatctgttttaaaggaaacgatatattgaccccgacgactcccggaatgttaccggacatcctctcaattttagcggcacaattagcgcaatccaaattatctatagtatattttttagttattaaatttttataattgttctcagccttatcgccttttaaatctttatctaaagaataatcttcattatggatattacttgtattatcgtcatacatatgatgttcatgtatatgaccgccgccttcctgcactgaacagccgcaatcacactcatataattttttatcttccggcaaatttgcttttttcatattggtcacctcttctatatacatcttattcaacatatgaacaattgttcatatgtttataatgttataataacaccccttactatatttgtcaatagctttttaaaatatttaaaaaatataatgtcctatattttacaaaaacgggaacaaatagtataataaaacagtcaaatatatatcttgataaaactagagaacaattaaaaaattatattataaaggtgggttatttatgaaaaaactattatgttttgctttatcaatttttatggctttatctattgctgtgattccggcttacgctgaaaatattgacgggctggaatctgctattctaaccgtaaaatcaagggttgagataccacaggagtattcagagtttgaaagtgataccttgatgtctgacagaggcgtcacgagctatgatttaaaatggtcgacactgaaagatgaaaacgatgaaaccaaatatattaacatcactatcgaccaatatggaaatataacaaaatattctacaagcgaaagaaataactactattataacggagacgccaaactgccaaattatactgaagaacagctgatacaaattggatacgactttttacaaaagctaaaccccgatttgatatctcagttcagtttcgaaagcggcaaaacctcaggtataagtataagttatcctgaaacgactgtaatatttcatcgttacataaacggtttaccattctgcggagatacagcttcgttatataccaacacatcaaccggtgaaatatccagtatgcgtatttctttaacatattgtgacgaagttccaatgcctgataatttaatttcagaatcagacgctatcggacattttaacaatctgtctccaatgacggctaaatatatcagcagcggtgaaaataaagcaatccttgtttatgagcccaaaaatcaatatttagaaattgacgcaaaaaacggcggggaatataaagaatacactgactcaaatagcaaagtaatgtccggaggtagcggaggcggttcaaatatggctgctgaaagcgccagtgacagcggcttgacagagaaggagcttgaggggattaaacagatgaataatctaatgtcaaccgaacagcttcgcggtattgcagagggaatgacagagcttaatcttgaaagtgataattatgcgtcatgcagttatagaagagtatacaaatcttataaagagtctgaatttgattattatgccgacttaacatatattaaatatgacgagaataacaaacaaagcaggaagcgcatatcttttaatgccgctaccggtgaatttttaaattattattctgattccagcaattatggtgataaagttccaaaatatactgaggctcaggctcttgatattgccaaaagcttcgcagataagtattctaacaaagagtatattaataccgacagcgaccttgaagcttcagataagattgacgaatcattggattattataacaactattattttacatttgaaagaaaggttaacggatttaattactcacctgaatatattagtgtaaaagtcgataagctgacaaacgaaataatttcttttaataaacaatggagtgacaaaactgagtttgaatcaactgagaatatgatttctgctgaagaggccgcagaagctttaatgaatactgttggcattgaactctgttatgtttcgaatctgtcagcaggcaaaacttgcacagctgatttagtttataaacttaaaggttcaggcaattattatatttcagctaaaacaggcaaacgtgtaaattataatggagacgagtacaaagaaacacaaaactccaatactgctgatgatataagcggccactatgctgaaaaacaaatcacagctttgcttgcatataatgcaattattcttcctgaaggtgaaacctctttcagacccgatgaagcaatcactcaaggtgaaatgattacttttgcttcaatccttaaaggtcaaagattcccaagacctttaaattatgaaacaatttatcgttttgcaaagaataacaatattgtagactataaagatattgctgacgcagaaacaatatgcacaagagagaatggaacaatgttcataatcagagcactcggataccaaaacattgctgaactgcccgacatttttgactgcaaatttgcagataaagatttaatatctccgggaatagaaggatatgtagcgcttagcagaggatttggtttgataggaggaaaccctgataatacatttaatcctcaaggagagcttacccgcgcagacgctgcaataatgatatataatttcatgacaaaataaaaaacaagttaagatacaaaaagacggtcagctgcttttacagcagctgaccgtcttttattttatgttcaacatgggataaagtcttgttgattatatcaaccacatggtcgtcatctatagaataataaatacttttgccctcacgtctcgtcttaacttgtccgcccaatttcaattgcttaagctgatgtgatatagctgactgcgacatatcaagcatagcggaaatatccgatacacacatttcgttttgagacagcgcatacaaaattttaacacgtgtttcgtctcccaaaactttaaaaaatgatgatatatttgaaatcagtttatcatttaataacttttgtgaatgtttcgtctgcttctcatcaagttttccttctgtttcaaactcatcctccataaatacatctccctaaatatattattgttcaggaacaaccgcaaaaaacactaagttacttttactgtcattaattaagctatgactgtgacctttgggacaataatgacataatccctcagatacactctcatattcaccgtcatacaaaacttttcctgtgccatttaaaatatatataatttcactgcttgtatcatgggtatgtaatccaatagacgctccgggttccaaacatccgtacataattttattgtttttgtcaacaaacatatgtgatgcaacacttttttctccgccattaaaattaggaataacagtttcttctatttcattaaaattaataatcattatatcatccccaaacactgatttctaacccgaaaaatttgaaaacgcttcataaattgtcacagcattattatgagaagctcgtttcttaaaatccccggattctctttcatacaaagatttaaccagcaaatataaatcaccgctgtaacctatcttctccataataacaggattggtatttaaatccagctcataatcaaagcagtctgcattattgccgctcatcaaataatccctatatggtttgtcaacaataaaaatcatattatcgccggaatcaagctcgctcataagtctggtttgaaccgcaacaaactcgtcgctctcctcttccctgctggcaatcataggcgtcaaagatattgtcacaactccgtcatcatttacatcattggcaaaatccaacatggtttccttaatgcggtttacagtttcatcggagacagctgtctctgaataatagccaacatataaatcatattgcggagtattcacaatctcaaatacagtaattgcaacaactattaatgccgccgcaattccgattatccaccatttcttataataccaaaagtttgccattctatctttaaccggcagttcctttgtcatagctttagcctcacgggcatctctgtccataataccacctctgtatgtgatttaactccgcaaatatccctttttacactaataaataaaataactgctaatcaagcggcttcattgtcgggaacaataagacgtcacgtattgaactgctgtcggtcagcagcataacaagcctgtcaatacctatacccagaccgccagttggaggaagtccgtattcaagcgcattaacgtaatcctcatccatcatgtttgcctcatcatcaccctgctctctcttctcgacctgactcataaaacgttccttttggtcgattgggtcattaagctctgaaaacgcgtttccaaactctctgcgggtaataaatatttcaaaacgctcagtaaattcagggttgtccgcaaatcttttagcaagaggagaaatctcaacaggatactcataaataaacgtaggctgaacaagttcctcttctaccttttcctcaaacactaggctgataatttcaccgcgggaaagcttaggcgcgtcagcgtcacattcaacgccgatagattttgcaagttcttccgcctcttccgccgtcttagtctgtgaaaaatcaacacctgtatatttttttattgactcaagcattgtcattcttgcccacggctgacctaaatctatttcttcatcctgataagtaatttttgttgtgcccaaaacttcctgtgctacagttttaataagatcttcagtaagctccatcattcccaaataatcggtgtatgcttcatatagttcaattgttgtgaattcaggattatgcttaacatccattccttcatttctgaaaagtcttcccatttcgtatactttttcaaaaccgccgactatgagacgcttcaaatataactcaggcgcaattctgagatacatatcaatatccaaagtattgtggtgagtaataaatggacgcgctgctgctcctcccggtattgtattgagaataggagtttcaacttccatataacctctgctgtccaaatagtttctgatagctctgattatacggcttctgagttcaaacgttctcttaacatccggattcatgataaggtcaacatatctctgcctatatctcaaatctgtatttgtaagaccatgatatttttcaggcagcggccgcaaagatttagaaagaagcactatcttagatgctcttacagatatctcgcccttttgagtggtaaacacctctcctgtcactccgacaatatcacctatatcatatttcttatataccttatattcgtcgtctcccaattcatcacgcttaacacaaagctgaatccttccgcttctatctgccaaatctgcaaacgacatttttcccattacacgcttagacataagacggccggctattgagacaactttgccttcaaaatcagcataattttcctttatgtctcctgccatatctgttcgttcatatgaagtgatttcaaaaggattagcaccgctttcttgcagcactgcaagtttttcacgtctaatctttaaaacctcgttcaaatcactttcagtattattcttttgttgattattctcgctcatttttccctccaactattattctgatacgctcagaaaattaagaaatctttaaaatcttatattgaataactccggcaggcgcgtccacatcaatcatttcgccttcagcctttcccataagtgacttgccaagaggagactcgtctgagagccttccctcatcagggtcagcttctgtagaaccaacaattttatatgttatatcttcatcaaattcaatatcgtgaatagtaacggttacgccaagttcaacttttgacgtatcgcgttcgctctcatcaatcactatagcgtttttcagcatattctcaacagagacaatgcgggcctcaacctgagcttgttcattttttgcctcatcgtattccgagttctcggaaagatctccaaatccaagagcaacttttattttttcagaaacttcttttctttttttagtctttaaatattcaagttcttcctcaagctgcttaagaccgtcctcagtcaactttacctgtttattgtccattcttattacctccgatatttttatatatcaactaaaccttctatgattaacttataaattatactttaataactataaaatgtcaatacacattaattatatttatgtctttttatactgtcaccaaacgctcacccaaatataatcccacggtatcaccattcttatcctttgcggtcccggtaacgcataaatctcttccgcatcttagcttaccgttattgaaatcaattattacctgatatctgcacttttgtgattcagaaacatccagcaccataatcggaagaccaaattttgaataaacataatctgcagtcttattgccggctgaaatattcttggtatatatcgttacatatttaaactctctgcaaaccaaattcattactgtgttaagccctcttaaatcatcgacatcgtcaacgattatacctgctcctgctttaaacccgggagtattcaaaagactcaaaacatatttaattgatatttcaatattatcgcagccaatcggcactttaaccggatactctgcagtctgtttttccgtaagcttatttcggtcttgctgttcaatcagtatttttttattataaaacagtttttttataaaataatataaatcttttatcttttgtgagatgaacttaaaaaatgacatagttcactccaccaatcttagtattatttctttctaaaagctattttgaaacagaattcaaataattcactgccgcagataattgttcatcctcctcaagagttaagttatcaagattagcgtacttatttaattccataggcaccgtctcatcaggttctataccaagtttatggatacaagttccgttcggagtataatatctcgcaattgttacagaaacaattccgtcacctaaaccgaaaacagactgaacaattcccttaccataagatttttctcctatcacatgagctaatccataatctttcaaagccccggttactatttcgcttgcggatgcggaaccttgatttataagaaccgtaacgggtatataatactgctttccatttgatttataatcttccctgtttcctttcttatcaagagtgtataccacatcttcaccgctcttaacaaaattggatgcgacatccacagcagcttcaatatatccgcctggattatttcttaaatccaaaaccaaagatttagctccgtcagaagttaatttgctcaaagccttattaaaatcatcaccggtactttcaataaactgtgatattgatatatagcctatattagttccgtcaattatttttgactttactgttttaacgttaatatgctgacgctctaccgtaaggcttaccgtttcacctgactcggccttcaagacctcaatatcaacagtcgttccggtttgtcctttcatatttctgaccgcctcattgatttgctctccggtataacttactcccgctacttttaaaattttatcaccgcttaccaaaccaactttttcagccggagtgtccgatatagctgatacaacggttattgtattgtcttcgatattattttctatatacacgccaataccatcaaagcttccgctgacatcttccatatattcatcagcctcttcgccgtaaatgtaattagtatacgcgtcttctgtcccctgagcaaatccctcaatggagctgtttacataatccgacatgggaacgtcttcataatacatattttttattgtgtttgtaactgttgaaaactttataaagtcaagataatttgtaaatccaaaaggatttacaagacctacggtaagcacagcagtcacaacaattaataaaaccgaacaaacaatcaatacccgtttttttatatacatattctgctccttaaaaatatattaccaaactaaaatcaaagaaccttactgcaaaatttatccgcattcataaagcggatcataaaagtattcttaaatcataagaataacattatcatccgctttagtataaataatcccaatacaaatttatgccattaaaacaaaaatgacgcggctatgcccgaacaaataccaattaaaaatattgccgctataactatagcagtaaccttcacagcctttttactcatcgtaattcctccaatcaaaataataaaccacaagggcggaaagcgacaaaaaactcgcttaaaaccgcccccactaattaatcatattatccacggcctaaatttattcagccgcacaaattacatactaaagcctagttggctgagatgacaaatatttatttaccatcatcgctaccttaaatataatagcgtcgtcgaattctctcaaatcaagaccggtaagcttctttattttatcaagcctatatactaatgtatttctgtgtacaaacagttttcttgaagtctctgaaacgttaagattattttcaaagaatttctgaatagtatatatagtctcgctgtcaagcacattaatagattctttcttaaatacctcgtccaggaacaattcacacaaagttgtaggcagctggtatatcagacggcctattcctaaattatcatagctgattatatccttctcggtatcaaacactttgccaacttcaagcgcaattcttgactccctatacgcctgggacaaatcctgaaccctttcaacaagagttgaaataccaatgagcggagtaatcatagcttcagcgcccaaagtgtcaaaaatattctgagcgataaccataatttcttccttagtaggttctgttctaaattccttaacaacaacagcgtcccgctcgtcaacacggataacataatcgtttgctttatcagggaaaagattgtttaatatctcaaggtatccctggtcggtctcctcaacaaccctgattaaataaacaaccctggggcactcaacattaatatgaagttccttagttctataaagaacatctcccggcagaacattatcaacgataatatttttaacaaagcttgccttgtcatatttttcgtcataatactgcttaatggtcaaaaagttcacagcaaggaatgaacacgcatttctggcaatatcgtcgtctccctcgcagaaaacaacaaactcacacttactgaatgtttctatttttttatagcaggctcccgccaccgtctttacttcacctgtagcagaaaaaactgtaaaaatattatcaacagtatttccgattttatcctcatcactgcacgcgatgattgtgtcgctgtcatcaataactcccagcgtcctttgaacttctcttttcaattgtacaagcgtattttgaaatactctgccctgcacattcgacaccccctgcaaatatatttgtacagataattttacctaattgttattataacttaaaatttcaaataatgcaacacaaattgtacaaaattaataaaaatgtcacaaaatacaaacatccccgtaaaaacgttatttctaaagtctcattttattatttacaccaatttgacaccgttctgcttttcatcaccaattttctaataatgctacccctttatctacttgagtttttaaaatgtgattatagtcttgtgttatttcaacatttttatgacctacccagtttgaaactacatttagaggcactccagcatccgcagataatgttacgaatgtatgccttaacccatgagatactatctccttttccgattgtatacttttcagcaaatcattaattctatatataaatgatcttgaagaaacatatgtatcatttaatgtagcacttattctattacttgttatacccaatttttgctgtatttatattatcttttctattacttctattgcctttgatttaaatggaattgttcgcaatctttcagaaaatgtagtaacaacaactttatttttatacacactatttaaccagtctaaacagtaatcttgaaataacatatacgaatcttgtgtttcaaaattgccttttgcaacctcttttttatactctctaagttttctttttactgcggattctgttttatcatagccataatgaggcttgaccatttcttcattttgatatttaaatacccatctaccatcctttctttgatatatgctccttgctgttactaatataccgaggtttgatattaaagatatttcttattcagacattaataaaaacaatttgcataccaaaccaccgataagatcttacaactatgaattaataaatggagacaatgatgtaaagtttcgccctgacaataagtatcaaaattaggatcttaattgttaaactctatataataacattcatctaatattctaccgttattaccattatctgaagttaaaatcagtaaaataataattgttaacttatcccaatatgttttttctactcttatcgtgttgctgtctaaatttgttgttacatacgttccgatgtcattgtttttattaccattagaattagagtcccaacttttcactaaatccctgtattcattataatccgaaatcgttgtattttaatactattttgttcattatcgcatattatgtttcttactgtttccaaatttgttctttttttaacatcttaccatatctccgcttacttggatagctgaaaaacaaggctcatgtgcaatatatctcatatggttagaaatatatatttgatagaatattcacatattttatagattgggagtgaaatgatgaatatcttaaaaaagtgctttagtaaaacactatactttagaagaatggaactaaaattaaatcaagagaaaatggcggaaaaatgctgtctatcgccacgtcaatacacagatttagaaaatgggaaaagactcccgtcttttaagagtttaattaatatcataataaatggtggtatagacctaaatttatttattgaagaaattatcaaagctggatacgtacctgaagattcagtaggtaaataaattttaggtttataaacaaaaagaaataggcttcttaaaaaattataagaagcctatttgtcattatttattcatttaaatcctataactaaaaattttatacaatttattaatttatatcaattcgatactgttcgccgttccatgttacgttcggtgttattgacatctctatcgctgtcagcggaacatatgctacatcatctatcattgtcattggataacctaagtcgtatatttctccatttatcattattcctttgttatctcttaacatatagatgtagtttccatccttttctattgtgacggcctgtgttgcttcatcccaatttacttttgctcctaatttctcaaatgtctctttcaccggtaacattactattccgtcttttattgttgcctggtcactcatttctgcttttgtcccatttgtatatacttctatttcttttcctgtcattatatacggctcttccgctgttccgcttcccgataatattactgcattatcttcatctaagtaaaatgccggtcttattccgccataaaaataacatgaatactgcccatattctccatcttcatccaaagaagtgcaacccaattcatcttctgatgcagtacgcaaaaaataatcattatattcactcgactttgtaaataatggatcacaatcttctcctaataccgctttaacttcacctaagtttttccacatattatatatttgtatttcgtccattaaaaacacagcatccgtcacttcgtacgctgctccatgatatgcctccggcaattcttcgacactatagaatttaaaatatgaaggctctatcgaacttccctgcctatattcctttagcgctgtatatacctttgtctccccatttgttgctaaatcaagatgatttaacggcagcatagtccattgcgttaccggtttaaatacttttctttctttttttgaaaaattactttcatttagaaatcctttctcgttagtaggaatttgggcactatctataacaagattattgtaattgactgcccaactccattctttttcgccttccgcaacatctgaatttaaccaggctcttggaaaagattcttcccaaaaattattttctccaaatggttttaaacacaatattttatcacttactatgagtttaccattctcatcatccgccacatatctccatactattggctcatcattatattttcctaaaataaagtattctcccatttgcatacaatcaatttttaaattttcagattcaattatattagaattactttttgcgattaccgacacaaataatatacttcctgttgctattgttaaactcaaaaaaataattattaaccttttcattttttgctcctccttatttaattatcatttgtcaggttttgtcaaccaaatagatgttgataattcatctttccatttgtccacgccgttatatatgtaattgtttacatcatatattaaatttccgcctgtataagcatcagggaaatcactgtaccgcataccggatggtgactggtcatatggtatatggttaccattgttatgcgtattattatttccatatatattgtcatatccttgttcatttggaccgccggaatatacacttatgggaactccattagctttaagtgtttttaccttttttaaatatgcattaagaaattgtctcttttgtaaagaagttgctgtattgcttgcatcattacgccctgtcacaagtcccatatcaaattctatctgcattccgaccttggtatgctctttatcattatttttattagcaacattatattctaatacagcattataaacagtttcaagcatattataattttcggatttaccagaagaataatataaacttggctgtataaatatataatcgaataatggccgccctctattatccttatactttgtataatccagaatactattaacgtctttattaattttcgaaatatatggcttccatatcaactgcttattcttatcatgtatatagtcagatatcatacgcatctcatcaacatcgttaccttcctcattaccgtaatatattccgcctattatactgtcatcaatccaccattctcccgtaatactttcatatatctgttttgtatcttcaacatagttttcagttggatattccgttgtacctatgtataattgcggcgttactgtattatcaattattccagcggaacgaagaaagtttcttgcgtccataaacttaccaactattattttcattgcgtctgccgctacattcggatcatctgtagttcttgtctgcaatgcaaagttaccgcttccccctgtttggattaaccagtttagagcatcaaatatcgtaaactgatagttgtcatacatgtctttttctgaatttatccacccactgggattacttcctacagtcatatcacgtgatctgcccggtgcgcttgcgtatataacctgaaatacactgtcatttccctgctgcaaacctccctgagcatatacatacgcattgattatatatcctagattttcgcgcccttcttctgtttcatttaatttatacagcatttcttctacttcctgaggattctcaatagtcgccgcatataattcttcaaaagaatcatactttgtcccgtagtatgaatgtccgcttgtgtcgacatatgtcattggattattcgcacaatatgtatacaagttcaaactaagcgggtcactcgcatctcctctatatgtatcttcctgtataaaccgtgctgtttctgcatcatagaatctggatttcaaataatataactctgtctcgttatcatattcgtatccgctgtatctgtatggattctctatatctccggtctctcctgtgatatttccaaacgggtcgtattcatatgctgccgcaatgtttccgctcttttctgttagcgctgtaacgtctccatgtccattataatgatacgtatactttttatcattagactctcttgttatcaaatttgttccatatacgttccttgctgtttggtttccgtctccgtctgtctctaacactattttatcatactcatagagatatttgcaagtatttccatttactgttttagataccctgtttccttctccgttatatacattggaaattacgttgcttccctgatatgtttttactagacggttgaacacgtcatattcatataccgcacctatttctgagtcatcatctagtcccagcagctttatttccagttctgtttcctctccgtcgtctgatttttccactccttggaacttgctgtgtatatttccgttattatcataattatatgataccgtctttttggtatttccaacagtctgaacagtgtctgtcagacgctcctgttcgttataattatacgttgttaatgatattattccggattctgtaaccgtttcagtctttctgtttccggctttgtcatatgtataggacgtctgcttatttgacggttcggttaccgtctttaatctgtttgcttcatcataggtgtattttgttgcacccttgtctgcacctgactcagtttcttctttatatatcagattttttgccttatcatacgcatatgaatatgaacttattatagtatcagcagaagttttgttcacaatgcttgataaagttccgtcgtcattatactcaaattcggctttggaaccgtctgcatttgttattttattttgagcgccgtttaaataatattcatatgttgttggctccgcattttctgcatccttgacagtgtgcagtctgttgtttttatcataagtctttatcgttacgtttttctttggatcaacagtcttttctgatacttctccgttatttatcaatggcgttatatcatattggtaagtcgttgttccaataccgggaacatccttggtcaaaactctgcccaatttgtcgtatgttctagttgttgttccgctttcgtcctgcattgtcagtttattgttggctccatcgtacgtattatgtattaagacattatcgccgagtttagtatctgtaagcctgtcgtgcacatcgtaaacaaaagataatgttacaccatttctatcggttttctctgtcacatttccacgctcatcatacttatagctttctgtctttgaagctatacctatgccgccatggtcaattttagcggtcatttcatttcggatattgtattggaatgtagtcgtatgtccttcgccattggtttgcgtctcaagatttccaaataagtcgtaagcatatctgttggtttctaaaactccttcaacattctggcttgtagttattagtcttcccagttcatcatattcataatatgtggtatttccttttgtttatcccctgtgttgccatccatttcaaatcttacatttccgcggctgtcatacaaattttgagttgtaatagcttctgtaccgtcctgtttgcttacagttgcagaaatattgtttcctaatttatcatatcaatatatttcgagacgttccgttccaattgtttttcttgccatatttcccaattggtaaatagaaattatgtctttatataaacaaatagaaataggcttcttataaatttttaagaagcctatttgttgttatttattaatttctatcctataaataaaaagatacgcaataatattaaatagttataaactttttcatatttttctcctcctccgctaaaaagggtatgatattctcataccctttacacttttcgttaaaacggctcatagtcggggaatatgctctcgaaatctttacgctgccaattttccatcggtatttccagtctttctccaaaatccattggcagtttcggctggtctaccactactcgatttaagttttctatatagtctaccttcgcttcaaacgcttccgatactgctctcagcggcaccattgttctctctccaaccaacctcggcggcacctctaatgttaccacttctctgctgtttcccatctccggattatctatctgcattaccactgttgtatcttctttttttgctgtgattatttgtgtttcctcctcccattcaacctctgctccaagctcttcaaatattgcccttaccggcaccagcaatctttcgctttcctccaccggttcttcatcaaattgcattctctctccgttgcagtatacttctgcatttgtttgaggctgtccgtctattatatatggttcttctatacttccgcttcctgatataatctcggcttttgttgtgtctaaataaaatgccggtctcactccataactatacgcacatattcccgaactataatcatcgtcaccaaatataaattgtgcgcttctgttggatgtccttaacatatattcctcttcaaatccttcataataatctttatcatttttaacactgtcgaatgccctttgagttggatatgcccttactgtccccaaatttgtccataacttatatatctgtgcttcatcaatcagaaacattgtatcacttaatctatacattgctccttctatatgactaaaatttctaatggatgagtcaaacattttatatggaccatatggactaataaaaggataatagtttgtttgaaagcacttttttaatccgttagttgataactccgcatcctttggtcctaatatctgccattgacttactgttttaataactgacagttcgctactgctaaaatttctttcagacaaaaatccatcttcatctacatatggcatgaatggtgataatggtacttttgtattgggaggattattacccggccatataatattacctgcattttctattgcatttaaccacgctcttatcgttgtgttttcccatatatctgagccatacatatcctgacttaaaaaatcatcaacatttgtacctgcgttatatgctttatagcacaatattttatcactcaacaaaagcattccattttcgtcatcatcacttatacatctccatattattggatcatcttcgtatgttccaagctgaaaatatgtacctatattgttctcctcttcttcaactctctgtgcttttaccggatttatacttaaacacattaataataagacaactattgttataaattttttcatacatttctcctcctacatttttttagtaaagcgtaactctgctctcttcaaataattcattatatacacgatgtatattatccctgacttgcgacgaccatccattaaataacaaccctgctgttatatcatatgtaattttggtattatacgccatattataattacttgctatatctgttaaatctttataagttttataatgaccatcattttcataaagagttatatgattacggttactgtgtaagtttacattatcagatattttattcatattgtaaccctgttcattaggcccgccagcataaattccaaatgaatattcaggcgttgttaataaatatttgaaaatatcaagagtcttagcaaaacgataggatttgttatttggatttgatgacatatctttataaattcttccggtaaaaatagatgaatcatattccatttggaaacacaaatccgttcctgaattcttatcattattaaacactatatcccttatatactgcataaactcaggatattcactatcgcttctgccgtcattgctgacctcatagtaaaaatatccgggctggattactattacatcacatagttttttcccgtcataattgtatgtattggcaatatcacatacgttgtttacactagttatacttccgccggtatatggcatccaaatcatccttttgccctctccgtgaatcattgaggaagtattccgcattatttttgtatattcaaaagatgtattatacggttccggatcctctttgccgtaatataaaccagctatatcattgtcgcttcctgatttagcaataacatgtgaccgtacgccctcataaatatttctgactatttcatcatattttaaaacataattatctatatttgtaccgtcccaatttctaatctgccagcctgtatagtgcggagttccaatatatattttaggcattgttttcggcttttgataattcgggagacttctgtatgctgctatcatattatcatatacattattaaccctgtcaatagttaagtttttaacaagctcaagctgtccgctgcctgaaagattgtcataattatcaaaaataaatggatcatttcttaaatctcctatgttgttaacaggcagaaataccctgtcaaaatccaggtctctgattgaaactgaaaaatacacatccttattaaccagcagcggaagatattttttaaagaattcaaccgagtattcgaacttatttcctgaactgtcatagtaccttggaatttgaccatcatagaaaccatttcctccgtaacccgaatcataaagaactatatgcacgtcctgtttttctttcgagtcatctattaccgaaagtatataatctgccgcttgattttgaccatatgtttcatcttcagcgtatactcctatatagtaatcagaagttttaaaattaactgtatcaccattttcaagttccctggttgaaccattttcataaagcgctagtttcaaattatcagcttcagtggttaacacaacacggttaggagtattaacagtgccttcataatggaaccaatccacgtcgagctgactgtctatcacaccggtgccggatacttgctgagtaagcttgcccgctgaatttttattatttttaaaattaataaaatcattacggcgggtaattggtgtaaccgcagatgtttctgcatctccgtttaatgctttcttgccggaaggagtatatgtactgttttcatttacatcttttttcatttcttcaggagatactcttgttattatcaaatgataacctacttcgcttcctatatccatcgattttttatttttctgtaccacgatatatgctgtgtttgatactaaattattaggaacaatccatgaagcaaatgccgaattattatatgcctttacattatacggatttgtacaatcagtcctttcatatgttatgttaaagtcctttgaaacaccatctggattatcacgataattaaaatctttaaaattagtctgaaaacttatcgtatatgagcctacatattcagatttgtctacttcaagtgagacagatattttttcaccctgcgaaacctcaattggatatgtatctatatcagaagttgtagaaaattttgcgtctataccagaagtaggcttatttgttgttccaattgcttgttcaattttattaaaattaacagctgatttgtctccgtattccttatcatttgcccccatctgccactgatttgattcaaatttttctggatcggtggttacaaacgctttaattttaaactctcccccttgagggtcatactcaccattgctacacacgactctgatagaataactaccatcactcttagctaaaaaggacgatgatgctatattattagtattattgtacggatctaaacagcctaccgaagagtcaagattgttcgaaataaaatatggaacatatgcatatcctgacggcggttctacaactgcaattatcagtgaccccctttttacattttttattgtaaacaccttactcaaaacatttttatttaaaactccagttcctgaataaacggttgttgtattgtttgttccaaactcacctgaattatcttcttccatttctattgacatactgttatccggaagtgttccgtcatcaataattgtataatttgtatttgaaaccgacatatcaaccgagtttaacatattttgagatacccttgtcggaagattaccggtttcttcagtataatattctgaaacctcaagtgtataatttaaatctgaaccatctgaaggcacgttatagactctgataatataatcgcctgttgtcatcagcctattttcaatcataatattcccgttttttgagtaaccgcttgctatatgcaaaccatattcatctaatatttcaaaaccaccatcaaaattttgaggtataccgaatagtttaatatcaatatttgttaaactatctatttcaaacttataatattttgaattttcatttgattttaatatatctgaaacaggcacattcaaagttaattttattgcatcatttatgttagttcccaaaggatagagttttctttctgaactccatacgctaacgcctccgtttttaattgcacgaaccttaaaattttcatcatttggttcagatattaaataattaacttttgtttcagcagtgaatataggctctctgtctccaatctgtatctcatacgaatctgctcctgttacaggctgccatgacaacattgttgactgcatatctatgcttaaagcggacttcacatttttaggggcttcactgccccaatagtattctacagaatcaagatattctccattccatccgcccataagtatagttttatttttataaaacacagctgagtgaccaactcttgccgcgtccatgtccgcaatacgcgtccatatatttgtgtttggatcgtatacttcaacaatattattgggtacatctgaaataataccattattttcggttataggatcatgtccgtctttggtatactgatttgttccgccaaaaacatatatctttccatcaataacagcagatgcagcattattatgataataatttgttggcgcacattcttttattgaattttctgatatatcatacttatatgtgctggttaaacatccgttttcatttgcacctccaaaaagataaatatctccatttagatattcagcacaggcatacccgcgactttccggcattaagcatcgaaaatcactactgcttgttggcttagcagataaaacatcattagcatatctgccatcagatgttcctccaaaaaagtaaaccttaccctctgctcctactcctgcagcggcactgcggttagcataaatataataagaacctgtattagttttaatagtattattaaaatagctatgtatattatatgtccatgttgtatcaagatctttttttaatatacttcttccaccgcataaccggatagtactgtcaataaaaacaggcgctgcaaatattctgccttcacgcaaataagtaacatcgctccatactcctagatcaggtttataaacagcaatattgttcataaaaccggattcatcgcagcctgccaatctatatatactattgtcatggtttattattttaccgccatattcttttattccggcgactaatgtaccctcatcaggattcaaaggagaattctcgtacgctcccaaaatatccaatttaccatgaaaaagccccgtctccgaagtcttactaccgttatttaatgcgtcttttaattgctttgaatctaaactcggattgattattttaagcaatgccgccgcacctgctacaaacggtgtagacatagaagttccatccatatacatatagttattttcaggtgctaagctgtatattgctttacctggagctgcaatataatcatgtccataattactaaaagatgttaaatctccttcttgatttaacgcacatacagaaattacattatcaaggtctgcgaaacctgccggatattcttttagctgagtcccatgatttccggcagcacatacaaataacattttacttcttctcataacatcttttagtgttaaaaattcattattacttgcaaaactgcaattaacaatagatgcacccattttctctgcgtattttattccttttatagcgtctgaaagatctccgccctcttttcccgcaataaatttcacaggcaaaatttttacattttcatatgctaccccttgcattccaactccatttttagcggcagcaataatacctgcaacatgtgttccgtgactatctgttttttcaccagttgaatctgttgtattgtcataaacagtattatcattatttaaaaaatcccatccagcaatatcatcaacaaatccgttattatcgtcatctttttcagtgttcccatatatttcttcttgatttttaaatatattatcttttaaatcttcatgatatatatcaacaccagtatctaaaactgcgactatagtttctgtttttgatatattatcattatacaccttttcccatacattttcaacatttatattatacaccggattattatatgcccattgttttgtaaaattcgggtcgtaatcagtatttgcaacatataatttataatttggctccacatactcaacacctggaatttgtctcatttcatttattgtcttttccaaatcctcggtttcgacatgtaattgttttaatatgcttccgtcctccttatcaacacttaacgtatctataagttccacacttgatacactttcaagattttctgacatcattaattcaggactaacatcagattcatctgcaaacattccaacaggcgaatactgtattaaaacctcattttcagcatattttgcatcctgcggcattgaaaacatttctatattttcattctgcacgtttccttcggcaaaaatatttatatgtactattccaagcaaaatgattattgctatgaatagtgaaattatttttctcaaaataataccctcactttattctataatatttgttattttaatttcagtattcccgtctttagctgctttgaattttaaacagttaatataaccattaaaattgtttgttgctgaatacctaaaagtaattacacctttatcaacactttcaattttaattgttccgttttgacagccaggaagaatatcttgctcatctgtaatcccaattaaatcaacaatttcaaaaatatcagaatcaaatgttatagtatataacatgttgttattctcatcatttgaaataacaattgatgatatatcaccctttttcgcacttatataaacatcagtactgagtgaagaatctttttctattatataactaaaacaagtgctaaataattcagtgttattgcttatttcagcagacaaatttatttctatatcatcactgcaacgatctggccgcttaataaaagttccatcatccaatatataatctgtattgctgcttttccaaactattttgcttccattgggtgcgctgcttggcaaaaccatacttactgcgatcggagataaatattgagccatataaccatttaaccattttgtatcatttatcatatttgatgtaacttttaccggtatagaagaatatatccccaattgcccggaattatttctaccgaaagaatataattttccatctctgcttattgctactgaaaaggctcttccgcatgatgtctgttttatgttttttccgtttaatgtcgttatttcttttgggtttaatgttgaacctgttacaaaaaatcccaattgtccatctgaaccatatccccagccatatactgttccgtcattttttacggctaatgaactgctatcaccagcagaaatattttttattcctgttataccaactatttttgttggtatatttctgttatttttatctcccaatcctaaccttccgcttccgttatttccccatgaatagacgttgccaaagttagttaaaccaaggcagaagtttgttcctgctgatatatcagtaaaatattctccgttttccagttctgcattcagttttacaggtatatattcatcatccgttgttccgtttccaatctgtccgtctgtgtttgctccccatgaatacagtccgtcctcggctaaagctacaacaaatgattctcctgcgctcacctttttaaaagtcttcattgccgttatttgtgtcggtgttaaataatcatctgtattcccttgtcctatttgacctttatcgtttttgcctactccccaaagagttccgtcattctttataaatatgctgaactctgttccggctgctatttgttttacattagaaattccggtcattttagacgctttctttacctttcctcccaacgttcccattgggttattcgtattgcttccccagcaccatacatcaccgtttttatccagcaccaaattatgatttttaccgcggctcacctgaattggattttctattccctcaatcacagtcgggtatgtttttgtttccattttatccgaaccgtttgcataatagccttctccccaggcgattacttgtccgagttcatttattgccaaggtctgcgtgcggtatgaatctacttgttttactgcatatggataatctacttctacaggacttactgttatatcatttttcaaagatttaccggcagccatatttccccaacggtataactcaccgtctgcatttgctgccaaacatgtttctcctatatcaacttcagttatgtcgcttaaaccttctacagcctgatatgatttattctgtgtatcagcaacactaccgcattgatacacttttccatcagccatatatgcagtggaattggctccggcaaatatctctcctgcaaagagcattgtatctgttggactgctggtatatgttgcactgtttggcaatgttatacctaactgatcatatgtattatctccgcacacaaaaagctttccgctgttagtcaaaatagcagtatgattatttccgcatgacacatcttttacattattcataacaaacgcaggctgacttttattttcagtatccgaagttccaagctgtcccttgtcattttttcctaatgcatataaattggaattttcatcaattatatacgattgataatcccctgcggctatctttttagcatttgagaaaagtcgtgtataactgctgcctgatatagtgtctaaaataatttgtccataagtattttctccccacgccataacctcgccattttttgaaagtgcaattacgtgttctaatcctgccgctacatcaattactgcgattgcaatcaatataggaacatttttatcaatattagtattgtcatgtaattgatatttgtcatttctaccccatccgtataccttattatcttctgtcagaacaaatgaagtatccgcacatgtttcagctttcactatttttttacttccccaaggcccatggacttcagcaaaatcttcacgcgatacattatcactcgttcccaattgtccgtatgtattatcgccttttgtaaataacttaccatctttatcaacatataatatatgattagaaccactgcttatatttttatgctccaaatcaccgtaataattatttataggactgtttgatgatactgtagaaccgtttccaaactgtccatatgaattatctccccaacgccatacattaccgtttgcatccaatgctacagtatgattatttcctgctgctatctgtgttatattagtcataccttttacggcgtaaggctcgtaccttttattgtgagttccgtctccgatttgaccgcggagattatatccccaggtcataacagttccgtcttctaaaagaactatactatgttctttgccgcatttaacatcttttgcattatatatatctatatatcctttgccgtctatccctttaccacattgtccccaatcattcgttccccatgctgtaatcatacctgtctcatctattgcaactgcatggttatatccagtatctatatctatacttattgatacaggttcaggtgtaagtgtagtgccagcatatgataatcccaaaacattgtggtcatttgctccgcaggcaaatacagttacaacattaatgaaaaatgtatgtttattatatgatttaacaatatcagctccattagaattttccatatgtgttaatatagctaatgtatcttttgtaccatttcccagctgtccatatgagttatctccctgggcatatataccattaaacccctgaaccacaaaactagttaatgagccggcttcaacataagttatatttgatagtgtgtgcataacaggcaatgatatttttctattatctgaaaacgatactgcattatatccgttatacccccataaatacgcataacctctgctgtttagtgctatacaatgcctttcaccaactgcgacctgtacaatatctgtcaagcctattacctgaacaggaacagctgaattctcatatgttccattacccaactgtccatatgtgttatctcctgccatccataaagaaccgtcgctctttataaatgctgtgttgtttcctccggcttctacttgtactgttttaagtgagctaaacagttcccaattttcttccggtgttctttgatatccgttgacatcaaaatcgtctttcggcgatatttctattatctcatctgaaattatattgtttcctaaattactataactcagctttcgctgactatttactttatctttcaaattagataatttaaccgctgtattcagcagcgtttcttttatattttgaactccgtttgattctgccattgcagccccggctgtgacatatgctgctgacattgatgttccgctctgctcaccatattctcctcccggaagcgtgcttcttacatttcttccatacatcgctatatcaacattgtttccgtagtttgaatagtagctaaatcccatatcttcatttaatgatgtaacgcttatcacgttttctatatcaaaacttgctggatatatcggtgtttcgtctacatttgtcctactgtttcccgctgcgcaaacaaataacagtccgctgttttccattgcttctctcaatgcctgattattatctgcacttccccagctgcagtttacaatcgtcgctccctgttcttttgcatattctatcgcttttattaaatcacttgtatacgcttgtccattctcaaatgccgctattggtataatttccgcttcgggcacagttgacgatattattcccgtaacatgcgttccatgataatactgtcctatttggttttcttcatatgtaagttcagtattgtttactatattaaatccgtttactacatgtgaacttaaatcctgatgagtaatgtctactttactatcaattactgcaatcttaactcccgtgcctttggttactcgccatcctgactgtatatcattctgtaaatcatcatatgattccgtatcaatttcttcattctcttcagtttcagattctatattttcagtctcagattctacattctcaggttcggaagtctcagttgtttcaggtacagggctttctgtttcactggtctcagcctgattttcaataacttctaagtccacacttatatcttctgtttctttattttccttttgaatatcttccttatttcgctcatcttccaaaagagttttatcactatcatttgaatctatatttttatcctcttctgctttgtctttacttccttcatctatatccgacaattcaagtttataatccggctgtatatactctatccttccgcttgccttttcgtatattttttcagtgaatatttccgggtctacttttttagatagttttattacacttttctcttgatcaatctcatatacaggctcatctgaaaaggttgatatatcaccggtattctctttagatattaaatcacgaacacttttagataccacaatctcttcatcattttccgatatttttaaaaactcttcttcattactaccttttattgtctctaattcctgttgttttactttatttgattcatcgcacgcatatcctacagcttcttcaatatccccattatattttataataaatctgtcagtatactcttctgccagctgttctaattgttcagaaaccgatgtttgttcccctgataatccttgatttgtcgcattttcactatcttcatctgcattaattaaaatagtagatgtagaaacagaaaatacaactgcaataaccaaaaatagacttaataatttcttcatattctccctccaacttatacttatactaaattttaaacttaacttctatcctccttttcattttaatattattttttatatatttttttattatcatttttatatatgcaatttaatattctaaataaaatattttttaacatttttttcaaaatattactatggtataatctaccatagcgcatttattttgtcaacaagattttgcatattttttgatttttcaggaaattaattacatatatttatttgtaatataaattcataaaacaaaaaaaaggctaaaaatagccttttatattaaactttatttatttttatttatatcataaaatacaatcaaaaatttatcttatttatacataactatttcaaaaataatatatagataagagcagaatattatcttcctataccattttagacataaatattttatatctaaaatagtattgtaatatataagcaagttaccctttataatactcatataatccaaattaaagataacaaatataataattaatatcgttacaatcaagttattataaataaaaactatttttatattaagtcataaaaatcttttatatataggtcggccgatttcattaaatcagatttatcgccttccgctgacctgtcttcaacaatgacaacatccaaaggtatcatttttgccgtcttatacgcctgaagtatatcttcaaaaagcacagactcatcaggtacgccattaactcttaataaagtttcagtataaatcaaaggacttgacttgccctctccaacttcatcggcaaatgtcaaaacatcgaaatattccattattccgttatttttgagacatgcttcggtcaattctttcgagtttgctgttgccagcgccaccgtctttccttcacgctttaaattttcaagatattccgcggctcccggctttgtttttatctctttagcataaccgtcgtatatcatctcagtccattctctgtttacatccttaggagacataggcaattcaaaaagctcacatacgcgcttagagctttgctctaacgacatatatgcaacttcttttaaaagttccggcggagtttcataattatgacgattcagaaaatcaacaagcaggttatcccaaacccacatagagtctatcagcgtcccgtccaaatcaaatataaaatttttcttctttgataaaaactctttgccatttctatttgattcatttctcataatatttacaactccttaaccatttgagacagctgttttgagacagcataagggttctcgcttcccattatgcaggatacgacagccactccttctattccggagccatacagctgactgatattttcaggattgataccgccgatacccacaataggtatatcaacagattttctgacctgttttaacatgtcaattcccacatttgaagcgtcctttttggttgacgttgggaaaaccgcaccaactccaagataatcggctccatcattaagcgcctcaacagcttgattaacgtttcctgctgataatcctatgattttatttgaacctaaaattctccttgatacctttaaaggcatatcactctgccctatatgtattccgtctgcatccacagcaagcgcaatatcgattctgtcatttatcagcaatggtacatcataatgcttgcacagctttttaagttcagaagcctcagcaaaaaattccctggttgatatatctttttcacgaagctgaaccaaagttactccgccttttattgccgattcagtaacagaaagcagtttttctctgggacatatattagtatcggttactaaatacagtccataatttactttatccataattatctcccaatttataaattattagttataaatctctccgcgcttaatataatcctcatctgataaactataaatataatcgaatagtttaactctgaaagttccaataccctgttcggtctctttaacatattcataggcatactctccggcaatacccatcataaccaccgcggctattgctgccgcaagaggctcaccggctgcagctgctgcgcccgtcatagcgctgcacatacagccggttcctgtaacatcacatagcatatcatgtccattttttaaataaaatacctgaacaccgtcagagacaatatctacagctccggtagcacaaacaacgcttccggttttctctgcataccctcttaccagttccccaagctctaaacggttggtttcattaacagcgtcatcatctgacgcgtctacacctttgctgcttatattgccgccggtcagcgcgcgtatttctgacatatttcctcttattatatccggttttgtcagttctatcatctctctgcaggtttcatcccgaagctttgatgcccccgctccaaccgggtctaaaactattggctttccaagcctttttgcggcttcggcagccgttttcatagcagacaaatatgtaccgtcaagcaatcctagatttattaccagcgcgctggatatattcatgatttcttccatctcacactcaatttctgccataataggagaagctcccatagctagcagcatatttgcacagtcatttatagtcacacggtttgtcaagcactcaaccaaaggacgagtgcttttcattctatttattaaatctattacttccttaagcattttgtcatttttattcatagctaaattatgtatcctttccgtctatgctgtcgttattatataataagttttaatttttaaaattaattagttcacatctgaggttaccaacatataaatcatttttatatctgctcaccggttaacaatctctcaaacaataaatcttcataaatttaaaaagtggtattttatattaaccaaaaataaacatattgttttaaatatgttcacgctccgcgtgatatgtcagctcacctaacgaggcgtgcttgcacgcccttccgatgttcactaaaaacactgtatattagataaatctaaaatagaaaattaagtaaaaatgtggctttgcaggcatcggatgtgaccccaccttttaggtgggtgtgttactaagtgacttgttttgattaaccttcaatgtctgtgaccccaccttttaggtgggtgtgatgcaaagtgaattgtttttattaaccttcaatgagcttttttcaaaaatatagccctacctgccacaatacagttattatctactaataatcaagcttcttaataacatcttatattatataaaataatgattcacattactgataaaaatatcggtcttaacattttgttatttaattaaaaacttttatattttcttttaaaaaaatttctaaaactattccttttctatacatttaaattcaatttctacattcgggtctgacgttttccataaatcataaaaatgatgaatcggcccatttccttttcctatgcttaaaccgttttcaattccggttttcacatacttcttggcttcaccaaccgccaataccgcgtccattccctttgccatatttatacatatcgcagacgaaatcgaacagcctgttccatgagtgttttgtgtatgtattctgccgccttcaaatattgtcattgttcttccgttatacaataaatcattagcgttttctttgaggtgtccgccttttataagcacatatccgggacccatatcaccaataatctgagctgcctgccccatctcatgaatatttttaatctcctgcccgcacatatattcagcctcgggaatattcggtgtaaccatagttgcaagcggcaaaagacggttttttataacttcaacagcttcatcgctcagcagctttgaaccgcttgttgataccataacagggtctacaatcaatatcctgggcttatatacttccattgcgtctgccaccgcattggcaatatctgctgtagacaacatccctatctttactccatccacatttatatcgttaaatacagcgtctatttgcgctcttacaatttcaggcggaatattgtgcactgctgaaactcctgtcgtattttgggctgtcacagctgttatcacgctcattccatatccgccgttggcagcaaacgtttttaaatccgcctgtatgccggcaccgccgctcgaatccgaacctgctatagttaatagatttttcaaacccaaacacctctttcttaaattatccttatatgcctatatcttctccgccaagaatcttattcatatttttaactgcacactgttcaccgcacatggtacaagtattttcttcacgcggaaccgaacttgctctatacgcttttggtttctcggggtcaagtgcaagctcaaacattttatcccaatcaatctcacggcgggcgtcagacattttattatcccactccctggcgcctttcactccttttgcaatatctgccgcatgagcagctatctttgaagctataattccttctctcatatcatcaaggtcaggcagtctgaggtgttctgccggtgtaacatagcataggaaatccgctccgttggctgccgcaacagctccgccgatagcggaagtgatatggtcatatccgggcgcaacatccgttaccaaaggccccaaaacataaaacggagcgccgctgcaaatgcgtttttcagcaatcatgtttgcggctatctcgttcaatgccatatgacccggaccttcaaccataacctgcacgtccttcttccaggctcttcttgtcagttctcccaaaactataagctcagatatttgagcaggatctgtagcgtcatcaatacatccgggacggcaggcgtctcctaaactgatagttacatcatattcacggaatatatccaaaacttcatcataatactcataaaacggattttcatttcctgtcatttccatccaggcaaataaaagcgctccgcctcttgaaacaatattcattcgtcttctgttgtccttaactttctgagctgtagcgcggttgattcctgcatgtattgtcatgaagtcaaccccatcctcagcgtgctgacggacaactcttaaaaaatcatccttagttatatctttcagcttcttttcgcaatatcctattgtatcgtaaacaggaactgttccaagcatagcggttgaaatctctaatatcttttttctcatctcatgagtttttccgtaattagaaaggtccattatagcttcagctttcatatttatagcagttctaaccttttcgagttccaaatccatatccgcagcgtcgcgtgatattcccagattaacatttattttagtgcgcagcccctgacctattccttcaggtgacaatgtcttatgattcttatttgccggaatagcgacaactcccttagccaccaattccattaactcttcggtagacatattctccttttcagcaaccgtttttatttccggcgttaaaatgccgcgttttgccgcatccatttgtgtagtgtaatttctttccataataaaaaactccttttaaaatatttgcgcacaaaaaagtgcttacctacaacaaaggcaagcactaaaaaataaattctatctcttagattttgtgctttcctacgtcggtattaaccgccaggttcaaagggtcaagcatattgcttatctcaaccgccataaccgcggtccccccagcgctaactattataaacctaactgatataaattgcaagtctttttttaacaaacttacattatttacaaataaaaggttaaagcactctatcctataccgtaaagaatttttacagcttcggcacgcgtcacattattattaggtctgacagaaccgtctgtataaccgctcattatactctgagtcagcaaaagctcaatgctgcttctcgcccagtccggtatatcttctgcgtccaccgctgaaaccggagccgcataaagacctgaaggcattaaccttgccgatgcaactgaatattccgaccttttaatattagatgaaggcgagaagaaaaccctgtccccatcctgctgacctgtcattatacctaatgagtacatcgcctgaacctgcataaaggcccaatcaggtatttcatctttatcagcgtaaggaagctcaactccacggtaattataaacgtttaatcccaagtaattgcttatcatacaagcaaattccgctcttgtcatatttttgtccggtctgaaaacaaacccgttatccgtctcatatcctgaaacaaccttgcgtttagtcatatatgagatataatcccttgcccagtgttcattcgtatcctcaaaaatattggttaatgcagaaatatctccgacgcttaaggttttataagcgctgtatccctcatcatccgttacggatacagatatcaaatgaggattatttaaaaaatcctcagggtaaacatattcgacagtcatagtttcaggagaaaaactaaacttggttttaactccgtcgacagtcattttaatattgtcctcgtctataatcccatgtgttccgaatattttagccacaaaagcatttccggtatttgaacttgttatcgtcggataatcagtttccaaaggacgaggtgtggaggtcggtatctgttccggtccggctgaaaccgtaagatttacagaagccgagaccgaacccgcactaacatttatagttcccgttccgcttacattgccgggaataaaggttccgtcagctgaaattgttcccaaattctcatcactgacgctccagctatacgcttcgtctgaatctgtcaagttaatattctgatataccgagtcagctgttaaataaactgtctgccctgatgaaactgacaaagacgacacttcactgccatctgattcatttttaataacaatactgtcagggtttgaaactgaatgaagcatagtactgccatacgcctctcctgtaactgctgaaaaataaacatccccatcgccgtacaatgttgcataaccgtcattgtttataacggcctgccccacagttgtattatccgactcaacagaataataaattggctcggttatttcagcttttccgtaagatttgtcaatcgccgctacccaaactcctacactgctgcccgacaatacatattctccatatggatatgtcagcagtttataaggtataccgtccggcggattcatcttctttaaaaatataaagttagcgcatctccgtaatccttcagacggggaatttaaaatcttaaactcagtggtttcaggcaaagtccctccaagctgagtgcttcctccgccgtccaaatttactgcgtcaacacatccaagttccaaaagtctgcgtgccaaagtttcttttctgactccatagctataccccggctgcctgccgtctatagtataaaatattatcgagccatccgcctttattcctacagcgcttctcggcgccgcgctgtcgtcctcataatccagctgtccgttccgaagcaatgttcctcccagacagcctgtgccgtatactgcgctgttccaacgtgcgtcgcctgtcacttcatttgcggcaacagtaatggtctgacctatatatagctgatttaaacggtcttttacctcatccgcgaccctgtcatctacacttattaccaattttccgtcaggtattgccactgaaccgttatccgaagtgatggactcaacagttgccgtaaaaggctgtcccagcgaaaaaccgccgctcacatttcccaagacaacattggtaccgctgccttccgcattggtgtaatctccgaattcatctgtataaatatacataacatacggctgacggtatttatttaaacattctatatcaaacagcgtgccttccggtgtttcaacagatatataaatttgcagaggcgaaataaagcctgtgccgtccgcattaaaacccactcctgtcagcttttcctggtcagacgtcagaacctttccgtccacaattgtatcactcataggcacgccggtttggaaagagaaaaaatcagcgttcatacccatagccgcaaaaattccctgctcatttaaatattcattagcttcaacagaagtacgttttccaaaaacctggtctccattagaaactataggcagaacatcgctgtttggtatgtattcaaaataattttcagtctgctgtccaacactgtcgctctgaaaggtattcctattataagtggttccctgggcgtactcagtttcagtatgagttgtttgctctcccagcacagacgcaaaagcagacattgaagaaaaaatcaacattccagcagttatacaggacatcaacttaaccgcaaacctgtttttctttatatgtaaaccgggtttttgtaaataattccccatttattatcaatcctttatatttattattgttcacgcagggctaattatagcataacaccgcattgttttcaaggtgcaatttaaataattcagaaagcaaatcccagcaatatactaggtcttttttcttttaaatactaacaataaacattttttgttcatgtaatgtatattttaatccctatagcacaaacttaaattagaataagaaaggagtgttaaaaatgtttaaacatgaaaaaatacttttccatccggtcagcgttgagaaaccaaatccgcagtatgcagcgcttttgcaggaacagctgggcggagcaaacggcgagctcaaagccgctttgcagtatatgtctcaaagtttcagaataaaagacccggaaatcaaagatttgtttcttgatatagcagctgaagaactggggcatatggaaatggtagcgaccacaataaacatgcttaacggacatgacgtagattatgaaaaagtagaggcaggagaaatacagtcacacgttcttttgggtctcaatcccggacttataaacgcctccggatattcatggacaggcgattatgtaacagtaaccggcgacctgtgtgctgacttactatcaaatatagcgtcagaacagcgtgcaaaagtcgtttatgaatatctttaccgtcagatagatgacaaatgcgttaaagagaccatagactttcttctaaaccgtgaggaagctcacaacacaatgtttaaaaaggcatttaacaaagtgcaaaacaccggttcaaaccgtgactttggaactactaaggcggctaaaatgtatttcagcatgtctgagccgtctccggaagacaaccaattcaccaatgtaggtgagcctcttaactcattcagttaataaaatctaaaaaataaaagagtcctttcggactctttttatatatgtctgtctaaaacgccaagtttgctttgcctgtattcggaaaactttccattatccagagcagaacggatttctgccatcagattattataaaaataaaggttatgaataaccgccagtctcatggcaagcatttcatttgccttgaaaagatgcctgaaatatgctcttgaaaaattcctgcatgtgtgacagccgcagttagggtcaacgggtctgtcgtctctctcatatttagcatttcttatgttcaggattccctcagatgtaaatatagtgccgtgacgggcgtttctgctcggcataacgcagtcaaagaagtcaacgccccggtaaaccgcctcaattatatttatgggagttcctacccccataagatatctaggcttatcctcgggcataaatggttcaaccgcttcaataatattatacatgtcctctgtggattccccgactgccagtccgccgattgcgtagccgtttaaatccaaatcaactatttgtttcatatgctcaattcttatatcgcggtaggtactgccctggttgataccaaacagcatttggtttttatttatagtgttatccaaactgtttaaccttgccaactcatctttacaccttttcagccagcgaactgtcatatcagcagaatcctgagcatactgcctttcgcacggattttcaacgcattcatcaaaagccatcgctatagttgacgccaggttggactgtatacgcatactctcctcggggcccataaaaattttatgtccgtcaatatgagatgaaaaataaacgccctcttcttttatattcctgagttttgctaaagagaaaacttgaaatccgccgctgtcggtaagtatcggtctgtcccaattcataaacttatgaagcccgcccatgtcgcgtataacttcgtcgcccggacgaagatgcagatggtaagtgtttgaaagctctacctgacagccaatatcctttaaatcaaaagtatcaagcgcgccttttattgccgcagcagtgccaacattcataaacacaggggtctgaatagttccgtgaacagtcttgaattccccccgtctcgctcttccatgctttgatatcaatctatacatatatctactttctcccggttaaaattttacttgagcagcattgcgtcgccaaaactgaagaatctatacttttctttaacagcctgctcgtatgcctcaaatatattttctttccctgcaaacgccgataccagcattaacaatgttgattccggcaaatgaaaattagttattatagaatcagtcaccttaaacttatatcccggatatataaaaatgctggtgtctcctatctcagctttcattgttccgttatcttcggcaacagtctcaagagttctcacagacgttgttccaacagcgataattctgccgccgctctttcttgtttcatttattatatctgccgcttcctgcgaaacctcataatgttcagtgtgcataacgtgttcctcaacattttcaaccgaaaccggtctgaaagttcccaaaccaacgtgcagggttaaataagcggttttaacgcccttatcttttatatcttcaagaagttcgttggtaaaatgcaaacccgcagtaggagcggcggcagaaccttcaattttagaataaacagtctgataccgttctttatcttctagcttttcttttatatacggcggcagcggcatttctcccagcttatccaagagttcttcccaaactccgtcgtattcaaaccttacaattctatttccgtcaggtcttacctcaatcacttcagcctttaacaacccgtctccaaacacgaatcttgctccggttcttgccctttttccgggttttaaaataacgttccaagtgtttaaatctatcctctttagaagaagaaactctattttaccgccggtatcttctttcacgccgtacagtcttgccggtataactcttgtgttattcataacaagacagtcgcccggattcaaatactcgattatattcctaaaatttttatgttctatttttcctgtttctttgtctaagacaagcagcctggaacctgccctatccttcagcggatgctgagcaataagctcaggcggcaaatcgtaataaaaatccttagttgtcatatttaactcaacttactccaatcctatattaatatactgttgtaacttcagcgccgctgaaataatgggtcagtatctcatcatatgtatacccggcttcagccataccttttgctccatactggctcataccgacaccatgtccccagcctgagcctttaaacgtaaatgaagtattagcgcttgattcttcataagaatcagcatataccttttgatactgtccgttagttgtataaagagattcgcccgaaaactcactcctgccggaacttgtaagcagttcaagctgtgtcggacgtcttctgataagtgttgaaccgtctgtcacagaaacataagcctgcccctgagcgtctccgtcacccaccacagtaaacatttggctcttggttacagtgccgaacactgtgcggcactcttccaattccaatgtttttattgcagtattgccggtaactctcatcttaatcacccggccttcaggtgaatattcaagcacctctattttctgcacatcgcccacatcatatcctctgttacgcattatagtagatacttcagcaactgtcaatacgccggaccaaataccattcggaatattttcagtatcttcataactattgtcaacgcttataagatatggaacctcgttgccccaaacatacttaacattttcggtggtagaacccattgacgccgcatagtagcactcgcaaagctctccgttatatgtcataacctgtcctgccgtagcgtccacagcgtcatatatagactgcgcttctcttgacataccggtatacatttggcaatgcgtgttcgcacaaatatcaaacccatatgaagaatgcttgcctaaattctgagcagcgtaattcctggagcaaaccgcctgggcttttaaagcctcaagaggccatgattcgctcatttcccttgatacaacaccatataaatactgatccatattgaccacattaatcacagctattcctgaaccgtccttaataaaattcaggcttccgcgatatcccgaaccatcaatttccagtctctcttcccaaaaatcggtataaatcgggcatatacctataccattattaccggattcagaatataatacattaccatccaaatcagataacacaacctgattttcagcaatgctgactataacatcggtatcctctataattttctcctcagaaaaatctctgtcattaaatactcctgcataatatccccgttcacttgtgattttcacagacgttttagccgacgagccgtaaaacagcccgactttaatatttgacggcacataaacatcagcagacacaaaagtcttatatcctgcaagtgtgcaaaaaaacacagccaaaacagtgaaaacagagaacaatctaaaaccttgccgcttaaaaaacatgaaattatccacaatgtgtcaccccgcttaaaaatatctctgtcagtacagctaaacgcaaacaaatttgaacgtttgccgcatgcctgatattataacacataattctacaaaaagccatatatatctttattatcttttgttaaatttaatttacgtataatacaaaaaagcatttgacataattgtaatattgtcatataattatgtataccaatgaattcaaggaggatttaaaattgaaacagtataatgttggaattatcggagccacgggcatggttgggcagagatttataacgctgcttgataagcatccctggtttaatataaagcttttagcggcttcaccgagaagcgcagggaaaaaatattctgaagcggtaggcggccgctgggtcatgaaaactgacattcctgactatgtgtctgaaatgattgtttatgatgctgctaacgacatagaaaaaataaccggtcaggttgattttgtcttctgtgcagtcgatatgaaaaaagacgaaataaaagctttggaagaagcctatgctaaggctgaatgcccggtagtttctaacaactctgctaacagacatacgccggacgtacctatgattgttccggaaatcaaccctgagcacgctgaaatcatagaagctcaaagaaaacgtctcggaaccaaaagaggctttatttctgtaaagtcaaactgctcgcttcaaagctatgttccggcgcttcaccctcttatgaaatatggaatagaatctgttcttgcctgcacatatcaggctatttcaggcgctgggaaaacgttcgaaagatggccggaaatggtagataacgttataccgtatataggcggtgaagaagaaaaaagcgaagttgaaccgcttaagatttggggaaagatagacggagacaaaattgttgaagccagctctccggctattacaacgcaatgtctcagagttgcagcaagcgacggccatatggcagctgtttttgtaaagtttaaaaataaaccaactatagagcaaatcaaagaggaatggaaaaacttctcaggcgtgccccaggaacttgagcttccttcagcgccgaaacagtttttaaactattttgaagaacctgaccgtccgcagacaaagctcgacagaaacttagagggcggaatggctgtttctatgggaagactccgcgaagatactcagtatgattataaatttgtttgcctgtcacataatacattaagaggagctgcaggcggcgctgtattaatggcggaactgctggcctcaaaaggatattttgattaattaattttttgaaagaaaggaacttctgttatgaaagagcctatttttaccggaagcgctgttgccatagtcacaccgtttactgaaaccggagttgattttgacaagcttgaagaacttatagaatttcatatcgcaaatcagaccgattgtattgttatttgcggaacaaccggcgaatcttcaactgtgccggacgaagaacataagtctgtaataaaattcactgctgaaaaagttaacaaaaggattccggtaatcgccggaaccggcagcaacgatacagcccatgcaatagaactgagcaagtatgctgaaagcgtaggggcagacggactgcttatagttaccccgtattataataaaacaactcaaaaaggtttataccttcacaccaaagcaattgcggacagcgttaatatcccgatagtgctttataatatcccgggcagaaccggcggactttcattctccctggacacattaaaagaacttgcaaaaattccaaatataaacgctataaaagaagccacaggcaatctttcatttgtagcaaatattgcggcggaaactgacctaaatatatattcaggaaatgacgatattattgttcctgttatgtctttgggcggtaaaggagttatttcagtcgttgccaatatattgccgaaagaaacgcatgatatttgcaaactttacgaaaccggagagactgaaaaatcaaaggaactgtttttgagtttaataaagcttattaatacactatttattgaagttaaccctatacctgtcaaaactgctatgaattgtttaggatataaggttggtcctctaagaatgccgctctgtgatatgtcggataagaatttagagactcttaaaaatgttttaaaagaaaataatgtaaagtgtttgctttaatatactaaaacagaaagacagtgatacaaatgacaaatatactactaagcggcgctaacggaaacatgggacgcgctgttaccagaacagtggaaaataatgacaaagtcaaaatcacagcaggatacgacataaacacggttaaaaactctgactttcctgtctacgataatttagatgaagtcaaagaaccctttgacgttataattgacttttctcatccgtctgtatttgacagcatacttgaattctcggttaagacaaaaactcctgctgttatttgcacaacgggactttcaggagagcagatttcaaaaatgaaggcggcttctaaaaaagcgcctatctttttctcagcaaatatgtctctcggcgtaaatcttttaattgacttggtatgcaaagcggcgaagctgcttgacggaagctttgatattgaaataattgaaaagcaccataaccaaaagcttgacgcgccaagcggaaccgcgctcgcaattgctgacgctatttctgacgcagtaagttttgacaccgagtatatttatgacagacataatgtacgtaaaaagcgtgataaatctgaaataggtatacacgctgtccgcggcggcaccattgttggcgaacatgatgttatatttgccggcaatgatgaaataatagaaataaaacacagcgcttcatcaaaagaagtttttgctgtcggcgctgtaaaagccgcagttttcatgaaaggaaagccctgcggtatgtatgatatgaaagatttgattgagcagtcttagtttgaatgtataaaccacattttatatattggaggttatcacatgattaaaaccatcaccgatattgagttttttccggaggttgccattgttacattaaataatattccaaacactccgagcagtattgcaaacattctcagcgttattgcagagaacggcataagcatagatatgattagtcaaaccgaaccatacaaagataagataaacttatcatttacactttctcaggatgatttgagcgaggttatcgggcttacaggaaagttcaagtctcttgccccgtctattaaagccgacataaacggaaacaacactaaaatcctgctgagcggtgatggtatgaggtctgagtcaggcgtagcagctgaactgttttcgctgtttgccaaagaaaatatccgcgttaagcttataacaacagctgagacggaaatctcatgtcttatagatataaaagatgttgaagctgctaaaaagattcttttataataacttaaatatttaaagaatcagtatttgaagtgacttttaaagattaaacaaaaacaatattaaataaaaagagttcggaattataccggactctttttatttaattaattaagtatatctttaaattattaactgctctattaatagaatttatgaaaatacaatttataaagccgttcatgttttccacaccaaaataatatatcaattatattggataggaaacaaaaaactgggcaaaaaagttaaggtcatgtaaaatagaaagtataatatgtaagagcaggaaacaggtaggattatatatgtgtgctagtcgacctgtttaattaggaaatcataggttacagcgcaggaaagaacaaagatgctgcattggtagtcaaggcgtttagcagaataaatataaatccggagaaaatacagatatttcacacagatagaggaaacgagtttaaaaacagaacactggataaaacgcttgagacattccacatagaccgctcactgagcaagaaaaggctgtccctatgacaatgcgcagcggaaaccacatttaaaatcataaagactgaatttgtaaaaggtcaagaatatgaaacattggaacaatgcgatatgaattatcggattatgtaaactggtttaacaatcacagaattcactcatcactggactatatgaccccgaaagaatatcggcttactaaccttaaataagttgtctaaattagtgttgactatccacattgtaggtttatcaaaacaagccaatttatatcacacccacctttcaggtagggacacacttgccgagacttgctatatcacattttattatataattttttatacagaaacttaatttgtctgtctattttaatgtaaccttccgtcgttttattttaaatataaaatctttaaatagagttcatttaaacatattgcccataacagagtatccataaaaagactgattatgataacacaacaatatacgcatctcaagaattatttatattagccgtttattacttccaaataattttcaacatcaaactttgtcaattccgcaggcgtcggctttcttgccaatggatgcctgggatttcccagttttgtttttcccaagcagtatgtcggaactttgctcctatttataagttcagaaatatccataaagcactgttttaaataatctctttcgtatatcaagtttccccacgcacaaagcaccgctgaagaactgattagtgcctgttcaatttctttcatgttccgtctgtgtatattcatgtctatctgcataggcagactgtcgggctctgtagctcttaaaggataaatattcatcattttaaagctgtcaaacccatacctgtttaaatatgtatttattcttgaaatcgttgggtcaggctttttatcagtggccgtacttgggttaattccaaacacgcataaagttctgtttccctttgttcctaaaacatacctaacattttcgttatctttaatatatatatcaaacattttaactttcatcccatttgcatatttttaaacacaaattatatataaaattaaccttaaataaaaagtataattattggaaacaaagcaccggcaaaacgtaatcgcaataccggcaaaaatatttacatacaacaaaactatactctctaaattctctaaaactttccaaaatgtaatttatatctatggtaacaaaaacgcgaatataaagtaaaatcatttaaaatatcgcagccactccgtttaaagtataatatagctcttttactaagattttttaaagtagtacaaataaaatcactaaatgtaacctataaaattttaattactgataaatttatacttttaaataagtaatacctacaatttttaccgataactactaaatccaaacacaaacaactttccacattttcacaagttatctgaattcacgccctcggaatggtgtaacagtctaggtatataaattatacgattatgacaatcattttaacccattcccccttgtggggtgcgaccagcatatgggaattgtaacaaaagaccaaactcctatttcaatccacgcacccttgtagggtgcgacgattttcgcgaaacagatatgattctgctgcttataaagtatttcaatccacgagccctggtgggatgcgactttatcactgataatgccgtattgggctttccaaatttcaatccacgcaccctagcgaggtgcgacaatgactatttgccgattagcattacattattatgaatttcaatccacacaccctggtgaggtgcgacttctatttctgagaatgtaacgtggggatttcgatttcaatccacgcaccttggtggggtgcgactttgcaaaagatacgttcaatttaacagaacagggaatttcaatccacgcaccctggtggggtgcgacgtgatatggaacttgtatttgctaaagcacacgtaatttcaatccacgcaccctggtgggatgcgactcgaataaaattgtattacgacaacgggaacacaggtatttcaatccacgcaccctggtgaggtgcgaccttcatacataacgtcttcatattttggtaaattcatttcaatccacgcaccctggtgaggtgcgacgggaccattgaatatttaattgacaatggatttttaatttcaatccacgcgccctggtggggtgcgacgcttttaaactctctttgtaattacttggctttaaaatttcaatccacgcaccctggtgaggtgcgacatggatagtttattgtcacttttaccgtcgtattatagatttcaatccacgcaccctggtggggtgcgacaaaaataaaaaataaatccaacttgaatataacataaatttcaatccacgcaccctggtggggtgcgactgcaaaaatatataaaaaataatatttgcgttgctttaatctggcatatttagcttatcatacaaaatatgtaatataagattaattattacttacaatttttattatatatctttgtttttaatggtgcgaacctcccggcaattttatgtgagcttacaattcgcacctaatgttttatctttattttaaaagaattactgaattatttatattatatcattaatatattgttatgtaaagtaattactctgaattttgttagcttcatattattatttttccatattttttattgtatttataacttaaataatagctcatttcagacgtctgttatttattcttatataaatactattataaaaaaatacagatacttaattttttgaattttaccaaatatataatgatatttattactctaaaatatcccatactgataccaatctatttataaactttcgaattcgtgtcctttgaaccacatctttcttctcattttttaatatatctatttccattacctgttttgaaattaattatactttactaattttatttataagtattatcttaatcggcttcctattttgggaagccgatcttgcccgggctcggcgggcgaaactggggctggcgcagcaaagtaagcaattacagaataattaaatagatatttgctagaacaatatttatatattttatatcaccgtgaccgcgccctaacgcggcatactacgtttgcacatcacaattaagtttgattattatataacaactaagttaattattggcatttatagtttatatcacactatacggtttatataacatacacttttaaataaaagtgtagccacaattgaccttgcaggataatcaaaacaagtcacttttaatcacacccagtcatgcctgcaatggttcaataaaacactgtatataataacacaaaataaaaaatttttaattatatgtatttaccgtttttattataacaactttgttatctgaaccaaattatttaaatatccaaactatagtcaggagctcatagttttattatattttttcaacttcttaaaatataaaatatttttatttcatttataccggaaaaactacttataaatttataatataaaacaatttaaacgcagtattcagttttatttataaataaaaagcacagcaaaatgcattaagcattttgctgtgctgctttatcgtcaaaaaaataaattgattatattattattcttatgtttatatataacaattgccttaataatatatctcaacagcctcggtattatatattccgagcgtgccgtttaaagaatttccaaaagaatatatctttccgtcattgctaagcgcaatagaaaaatctactccggcggcaactttagttatggacttattatttaacgcgcttattaaggtagcaaaccgaactgtaccggtattgcttatagcaagctgatatgcagttccgcttccaaatccatacaccttgttatcagcagttactgcgaagctttgcctatatccggcagatatacttttaacgtttttcagaatcgaatttgaggatatctttactaactcaggtgattttctgcctgttttgtcgccaagacccagctgaccttggctgttatcgccccaactgtatacatatcctttatcagtcagagccaaacaatgatcttgccccatagatatatctgtaatttttgtgctcgaaccatcggtaaatgtaaagtccaattcagcaaagccggaacttcctcctatggtataaacatttccctgcgaatcaagcgccaggcttttcgtgtctccggcaacaaccttaacaaaatctgatttgtcagatattcttacaggttttggataatttgcttcagcgctgctgcttatctgatgcaagtcgttctttcctactccccacaacgttccatcatttttaaggaatatactaaattccgtgcctgcagcaatctgttttacattggatatagaagttatttttgtagctactctggcttttcctcctacgctgttgctcataggataatttgtattgcttccccagccccaaacattgccgctcgaatccaaaactaagttatggtttttacctcttgaaacctgaaccgcattacttataccacctatctgttttggataataatatacggccattttatcggtgccgtcagcataatatccttctccccatgcccatactttcaaattcttatctatggcaaggttttgataccgcctggtgacaacatctgtaaagctattgtcagatataattttttggggcacaagcatattctgagcgctcattatttcattagtttcagacatcagcccccattgcattacttcgccgttatttgttaaagcataacattttttatttaatgttacactatctaaaccgtaaatttccgatatctgagagaaataactgctaagatttataccggcgccgcattggtacaacttattatcctgccagtacgccgttgagttcaatcctgcccatatatcacttgccgcgccggcttttgcaaaagtatttgaatatgaagccgccgctgttgaacgccccagctgacgcatactgttatcaccacaggtaaaaaattcaccgtcaaaagtcaaaataaccgaatgattcattcctccggcagctttgctgacattgttgattacatattcaaatgtgtttttgtttgcagtgtttccaagtcccagctgtcccttatcatttttacctgcagcatatagattattgttttggtctataacataagaatggtaacctccggcagctatagaacaagcgccgctaaataccttaaccggagtactgtaataacttcctgtcgaacctattcctaactgaccataggtattacttccccatgcccatactgttccgtcttttttcactgcaatagcatgattgattcctgcgcttatatccactatatcatcaagtataagagcaggtgaggtttgggcggagccgcttcctcctccggcttgtccttttgaattatcgccccaagcgtaaagtttaccgtctgatgttaatgcatatgatgaatctcctccggctgctacctttatacagttatctatattaggtatggttataaatgtatccgatgacgttgttgtagagtttccgagctgaccgtataaattgtcgcctttggcttcaatgtatccgtttttagctatcaaaacgtgattatttcctgcagctgctttctggttttgtaactttacatattcttctgcatattgtcccaaataaagtgttctcagagaagaataaccattatatgtatcaggcaaaagatacatcaaaccattgtatgcaactccgcgcagaggacgcggtctataagaatcatctaacagcggatcataaaaaccaatacttacccattcatctgttttcgggaaatacaaatacgtacacgtatctcgatactcttcctcctcgccctcatcgtcatcatcccattttggaacatgagtgttaacagctgtaggacctgaatatacatatacgtctcctaaatttaaaaatgttccgccgcttgaaggttcgttgcttagaagcgcattaggcctgtccgtaagatatgaccacgtgtttgttaaaggatgatatatcttagtctcctgaccggtatatctgtcttcaacgcctatgtagattatttgcccattatatactgccgatgcatatccgccgccgtcaatttcatcacaatacattgactgccaggtatttgaatctacggtgtatatatccatccttctcacgactgacggataattataactatttgttgccatctcataaaatccgccggcacagtatatttttccgttcacaatttcaggattaaacgaatatcttgaattaggcatagatatacctgtgctccagctgcctgttttaatatctaatacttcaaccgtagatactgcttttctgtcaatacagccgcccattacatagagcttatcacccgcttttacaacgccgaaatattctctttgggtaggaataggcggataaaatgaccacgaatcgttagcaacatcatactcatatgttcttacatcgttaaaacaatatattttaccgtcagccactaacgaaggcgttgcaacatcgcagtccgcggactctgttactccataaccttcaaaatcatctgccgacggaaacttggataaaattttctgaacataatccgaataatcagataaacttccgacagggtcgattgataaagctgaaacagaatttaatgtttcatcgctcttctcaaataatgaaacatttaaaactacagattcaccacttgagctctgaacacaaatatcaacagcttttgacatatagttatcagcggatatatataatttataagttccaaaagtaacatccttaaaatatgccgttccattttcatcagtatatgcgtctttatcttctatttttaccaaagcattttcaatagcttcaccactggtatttctaactttaatttctacctgacaaactgaatcacaaccatctgtattttcggtcacagatgaagtattagactcgtttgcgctttcatgttcttccacatactcttttaaaccatcaatatttgtaccatccttatcgtcattattaaaaacaggtattgaggttggtacttcggttgcttccactggttcaaaattttcttccgccgatagtaaatcctggttttcagtgattggagtctctgaatttgcatacgcaagtccaaaattaaatacaaaaatgaataccgataatgttaaaacacaactaattaatcttttagacatattaaatcctccatataaattaattactgctgtctttatatataagaacgcattccacctcctatttataaatttgcatagtctcatacaataaaccaactatggcatttataaagacaacaattttatttcaaatttattcagagacattaaacaccttttgaaacattatatcattatattatataaatttcaattataaatattttttcgtcactattacacacaaaatgcacacaatattatacattattaataaaatattttcccgaaatacatttcatgttaacaattaaaacaataaacatattcattaaattttatttgtaatatataattaaagatataattaaattatacacagatataaaaataatatataccgtccgcttaaacccacaataccgcatattaattaatcaggtatatatattaataatgtctaatcatttcaatttataatatttatcagagactaaaaaatttaataatatttgaacagaaaacaaaaaccgtatgatacagaatactactgccggattatcgaagcaaaacgtattatcctaagatttaccatttaaaatatcatacttaacttcacaataatttattaattaaataataaaataaaaaccaccttatatataacaacataaaataaccgctaaaaagactagaacagtatgacttaaacacttatttaataaaacattaagaattttaaaaataatttattaaaatcaaatttttataatattaacttaaaaagttagtattttgcgcttaatgcaattacactttaaatcttattttataaattcccacacctattttgcataaaaaaacactatactctctatagcgtttaattgatataatattccttacaaaaacttatttatcatttttatatcaaccggtttaaaatttataattgttttaaattattatattatcaatcagcaagatacatagccgctgctgctttattgtttttcacatgatttaaatataattctatagagattataatttcttttttattcttcattgacagcgtaaaacaattctttgcaaaacttctgagcaaccaaataatatatataaatcttcagccggaacataaagcagttcaaaatttttattaaccctatttaaaacgatgtaaaaaaacataatactgacatcattatatttttatcccacataaacaattaacccttacaacacccgcgtatccgagaaagctaagatactgtttagttataatattcagcataatgtaataaatacaatatattttccgatatatacaaatcggtttttataagtattttaatataacattataatataacattataatatagcattataatatcgactgttaattcaaaatattgcaattacactagttaaagtattatacagctttactattgaaattttgaattctagtccaaaaaagtaaaagtgtatgctccttaccgatatatacaaaaataattaataaaaaaattttagttatttaaattttgtcaaaataaccgagagaaacacattaccaacacacctcattcccggcacacgcactttgtttcatcaattttaacatcatttgaattcacgcacccttgtggggtgcgaccatacttatatcacggtatattaattttgagacatgatttcaattcacgcacccttgtggggtgcgacccaatagtgttacacatattggtactggtgcgtttatttcaatccacgcacccttgcggggtgcgacggcaaaaatatataatatataataattatagcgctctatattaagctgttttactataaaatatacttatttcttataaaacgctagcttatttttaatacatatatttgcttaaaatcggtgcgaatcccccggttattttatgtgagcttactgttcgcacctgtataatatttattctatactataaaaaaccttaatatgttttttatagtatatcattaacaacatattatgtaaagaaatttttcaaaaatttacaagattttgttgtcatctgttttatttgtattattcagtttccaacacctccggtaaaatttatcaatacattattaaatatataatttaactaattatatacagaaacatactttggacttattttgcttaaaaaattaatatcattctttcttgctgtatcgaatttttattttaattttatttttctaaaatcactcacgattattcgtcccttgtcttcatactgctaaccggaggttttgttgctttaccgctttattttacatatacagaaatctttatatcgctaaattttaataataacaaaccgtatgactgggttttgacaatgagttacattgccattctctcaattatgtcacggcctatcaaaatctttaattttcagccgtcttacactcttaatctttgtttttctgtattagcaagtctctgtttttatcactttaactattgccatacatatcggcaagtattttcttttcaatacttgcataatcggttttgttggtgtctttataattattaaatttactgtttctcatatcatcctttttctgtccgcttctctcctcccactggagtatggctaaataatggttattatacttatatcccttaagctccaggccttccgaaaatgtctctatccacttttcccagtctttaggcagcttttctcttagctgtttaatctcttcgtctgttaataacacattcttgtattttccatacttgtgttttaactccttgcactcttccgcttccggcacatcatttactttacttttatttactttactttcttttctttcctttactttactttgtgtaaaaatgtatacattttcttcagaaatgttaacattttcgccctttatgtatacattttcaaagccgtcgggtacactaattaaaaggtatttcttctcgacttcaaaacgcttccttcttgagcacattttcatacatctttcctgtattcctttggatgttagaattttgtacttctcatacagcgtcttgtcaaaaatacctcttttaaatgctgcgttcaatatttcagaaacggcattgacaccaacccctgttttgtgggaaaacatcaatgcaacctcttcatcaaattcacagtaataacctctgctgccgtatattctcatccacagcttaacgattaccgcaaaccctattaacccgaattctgcttctataagctccatcttatcactaagatgcacgtctaaaggaaagaaatcaaatgcttcttttcccataagaattctcctttggaacaacgctgcaacccgatttatacgaacggcagtgatgtcaggaactacagaattgttgccggaaagctcagcaggctcaaacggaaacttgacactaaaagtgccgtatgaaaccgaggcggcagtaacaaatccttcaaaagtatcagtagtgtatataaatgacgccggagaaaaatcaggagtagcgtcggcatatgacacagcaagtaaaaaggtaataacaaagttaaagcatttgagcacatatgcaataactgacagtttgggatatgagttggttacagaattagtaacgccgtcaaacgagaactttaaccccggtgacgagatagcggtagcggtaaaagttaagtccagtgaaccgactaatttcggaagctttaatatagctcttgactatgacagcacaaaaatgacattgacatcagtagaagcgtcagacgctataaaaacaaacggatataatttggtgcagggagaaggagcggagcaaaataagattgcgtatacgtcaggaagcagctcggttgatgtatcaagcgaagctgtaactataatgacagtaaagtatacagtaaatagaggaatagaaacagcggctaatgtatcagtaggaacgaaggacggatattttgcaccaacaggagctgatactgatatagcagcagtatcaacagctgaaaccgttaatctgtataacctaaaagtaacactctcaagcggagatggaaacactgtttcaggttcaccggcagcatattatacaaagtataatacagcaggactatacacagacgacagttatactacggcagtgacagatacgcaaataaagggactggtaactgcaaacgagaactaccgtttggcaaaagatacaacagaggaaccgctgtggaaaacaagcggaggaacagggtatacaagcacagatttgacaacaggaacatatacggaagatacaagtctgacagctcaggcagtgcgccaatacaagataacatttgagccgggaacacacggaagttttgcagcgggagcagtgacagagatagcaaaggatgtaaactcaaaattgctgcagtcagacctgccgacaatagaagcagaagcaggatataatccggatggctggatgagcggagatgtaaagatagacctgagtacatatgaagtgacaggagacgcaacattgacagcggcatatacagaagcccagtatagcgtaacatttaatactgtgacaaatggagcgtatacaggagagacaggagtaacagacggaaaagcgacatatggaacagatataacgttcagtgtagagccggcaaacagcggtgatatagtaggatatgtatattacacagtaaacggaggaaacaaaggatacttaacaggaagcaacggagtatatacaatcccatatcagatgtttggagagaatatccagatatatgcaggagtaataacaggaacggtaaagattgtagcgcacgacagttacaatgcggcgccgagcggaaaagatttggtagtagtaacgacagcaaagaatgaaaatgccaaatatgtattgcagtcagccggaacagcagcaatagaaatgtattactcagaaggcctgggaggatatgcggcatttgtatcgaacaacggaacaacaattacggagcaggaagttaaggacagactgtcagtaatggagggagagacagccaatacagtgatagcgcatacggcggacataaacggagacggatatgtaagatcagtagacgcaatgatagtaaacgacctgtattacaacaaccgaataggggacacatcagacgaaatgagaataaaagcaaactattataacagtgacgacgcggtagacacaagtgatatagctgcagttctttatactgttgtaggacgttcttttactaaataagacttacattatagaaaattattatggattataaaatattttggaggaagaaaaatgagtattaaaaagaatcttggttgtttgttgttggcgttggtgatgttgttcagtttatctccgacttttgtatttgctgataataatttgtctgatgcaaatatttctgacagtgttgatgaaataaaaactgaagaaaacaatgaagaaattatagacggtagcagtgaagcagagctggctgacgtgacagtgccggaagttgcactcaattggcaggaagcaggagttagggaatctgataataaacaaatatataagatagtatgtaatttatcagcaccggcaaatttacagatggtagagacagtattaaattacgacgattctaagatacagccggtatatgcgattggtgatttatcaaatgatcaatacagcgatttattatatacagaaccggatcaagataatagaataactgtgtcaggtgcgctggaagtagcatcaaaagcaggcgcagcagtagcaaatgaattatatcatgctgatatagaaggaagaaaagcagtaagaatgacagcaggatggacaacgccagtgtcgaaagctgttaactctttggacttaatgagtttttattttaggttaaaagatggagtaacattagaagattttgataaagagacaataacattacatccggtacagacatatacagaagaacagttatcaacaggagaagattttggagtagaagtacgtatatttgaaaaaagcccagctattgcatataaatattctgacgtacgtgaaagcggatattttaaatcgttgggggacagcaatatacttgatttagcagtaacatttgcatatccaaattctgataaggagccggcaggcgaggctaaaacccccggtacagtaaagtgtgaaacaaaacttgattttacttcaagtaatcctttgacagagcagcagcaaaaggattatggaatatattttgaagataacacagatggaagccatactttgacactttataacgcaaatattgaaacttctttatccagcggaaagatgattatgctccctgataatacaaatatagttttgatgggaacgaataatgtgaaaaatacaaatacagctaaaaattcagttcgcggcattgatatgaaaagcggaataatttccagtgataaagtaacttccggcgtactcaatataagcggctgcggctatggaatatatttcacagcaacaacagaatcagaactgggatttaagaatgcaaatgtaaatatagtttcattagaagaaaattctagtctaaatgcggctataaatatcaagagcaccaatatggttcctgtatttgaaaattctgaaattgttattacaaacttgttttcatatggtattagtgtaacaaataacaatgtatcttttaataatacaaaaattactgttacaggaaattcgggaaacagtgcggcagtaaaaattaaaggaaatattaatgctgagaattctgaatttaacattacaggaagaaaatatggaatatcagcatcaggtgatataaactttaataattgtactgcagcaataaaagacggaaatcaaataatttctaatggaattagttcagacacaggaaatgttaatattataggcggcacaactttgattcaaaatgtatcaaaagcgattgagactactcaggccgacaagaatatcgctataagcggaaatattacgctgagtaacataagatttcaagcttttacaaaattgccggttgtttcaagtgaatcaggaaacataaagtttgaatctgatacatatctatatggaatcaataaaataccggctggtacatacaatattgaatccggaagctggaattttagcggagtatctgaagacagcgaatactatactgtccaaagcggaaatggaaaaatatataccgattgtttggatatgtatacggtaggttcagtattaaatacaatgagtgaatctgaccttgcatcatatggtataaagtggctgccgtatgaagatgttttgattctgaataacgtaacaattgaaactgaaaaggttacagttgcagacagtcaggcagcgaaagttaataattcaataatattgtctaataatgataatgttaaaataatgctttgtggaaataattctataaagtatacaggtacaaatgcttctgctcatgctatcggaacaggtgtttcaactattgaaggtgttagtgccggaaacagcggttcaccgtctcttgttattgatatgaataacactggtgagtctgcaattgttacccgttacaagacagatagaatgagcgagtttaagaacgttaatttaaaaattaaaaacatttcagacggtgtatatttaaacggagcaaccaatggtactgctatgggatttagttttgagaacatgaattgttcttttgaaaatgttacaaatgcgtttgatattaagaactttgtttttaaagattttaagagcgtaaattcaacatttgattttggaaattcatcaaaattatttgccagcgatagtacagcaaatataaccggaagcgttgattcagataaaaaatccagatatattgttggaaatgctgatggcgcgtcatggcttgatacaaaacttgatgccggaacatattattataacggaatagcattttcttcaatttcaaaaggcgtgaccattgattcgggtattaccggaggaacagtcagcattgaaaatccaaatgctaatattggtgatactgtagtcgttactgttactcctgatgtgggatataatctcgcagacggcagtttgacatatactgaatccattgacggagctcagccggtaattattccgtttaatgatggtgtatacagttttgtaatgcctgaaaacggagttttaatcactgcggttttcactcagactgtagttgttgatgatagtaaagtaacagggatagatacaggaaatcctgtaataaatgcgtcaacaaccgatgagccaagcagtgaagttaaaaacagtgatgtaagtattccaaaggatttggttgacagcataagcagtgcggctcctgatagtgtaactatcaatacggatgtagcagaagttgaattagataaggttgcctttgaaaaagtttctaatacagctggaagcgagggagttagcctaaaaattgatttgcttgaagccagcagcaatgaaacagtaaataatatgataatgtccggagcaaaagttatagacgtaaaattgatgtcaggaactacagaattgttgccggaaagctcagcaggctcaaacggaaacttgacactaaaagtgccgtatgaaaccgaggcggcagtaacaaatccttcaaaagtatcagtagtgtatataaatgacgccggagaaaaatcaggagtagcgtcggcatatgacacagcaagtaaaaaggtaataacaaagttaaagcatttgagcacatatgcaataactgacagtttgggatatgagttggttacagaattagtaacgccgtcaaacgagaactttaaccccggtgacgagatagcggtagcggtaaaagttaagtccagtgaaccgactaatttcggaagctttaatatagctcttgactatgacagcacaaaaatgacattgacatcagtagaagcgtcagacgctataaaaacaaacggatataatttggtgcagggagaaggagcggagcaaaataagattgcgtatacgtcaggaagcagctcggttgatgtatcaagcgaagctgtaactataatgacagtaaagtatacagtaaatagaggaatagaaacagcggctaatgtatcagtaggaacgaaggacggatattttgcaccaacaggagctgatactgatatagcagcagtatcaacagctgaaaccgttaatctgtataacctaaaagtaacactctcaagcggagatggaaacactgtttcaggttcaccggcagcatattatacaaagtataatacagcaggactatacacagacgacagttatactacggcagtgacagatacgcaaataaagggactggtaactgcaaacgagaactaccgtttggcaaaagatacaacagaggaaccgctgtggaaaacaagcggaggaacagggtatacaagcacagatttgacaacaggaacatatacggaagatacaagtctgacagctcaggcagtgcgccaatacaagataacatttgagccgggaacacacggaagttttgcagcgggagcagtgacagagatagcaaaggatgtaaactcaaaattgctgcagtcagacctgccgacaatagaagcagaagcaggatataatccggatggctggatgagcggagatgtaaagatagacctgagtacatatgaagtgacaggagacgcaacattgacagcggcatatacagaagcccagtatagcgtaacatttaatactgtgacaaatggagcgtatacaggagagacaggagtaacagacggaaaagcgacatatggaacagatataacgttcagtgtagagccggcaaacagcggtgatatagtaggatatgtatattacacagtaaacggaggaaacaaaggatacttaacaggaagcaacggagtatatacaatcccatatcagatgtttggagagaatatccagatatatgcaggagtaataacaggaacggtaaagattgtagcgcacgacagttacaatgcggcgccgagcggaaaagatttggtagtagtaacgacagcaaagaatgaaaatgccaaatatgtattgcagtcagccggaacagcagcaatagaaatgtattactcagaaggcctgggaggatatgcggcatttgtatcgaacaacggaacaacaattacggagcaggaagttaaggacagactgtcagtaatggagggagagacagccaatacagtgatagcgcatacggcggacataaacggagacggatatgtaagatcagtagacgctgatgtcaggaactacagaattgttgccggaaagctcagcaggctcaaacggaaacttgacactaaaagtgccgtatgaaaccgaggcggcagtaacaaatccttcaaaagtatcagtagtgtatataaatgacgccggagaaaaatcaggagtagcgtcggcatatgacacagcaagtaaaaaggtaataacaaagttaaagcatttgagcacatatgcaataactgacagtttgggatatgagttggttacagaattagtaacgccgtcaaacgagaactttaaccccggtgacgagatagcggtagcggtaaaagttaagtccagtgaaccgactaatttcggaagctttaatatagctcttgactatgacagcacaaaaatgacattgacatcagtagaagcgtcagacgctataaaaacaaacggatataatttggtgcagggagaaggagcggagcaaaataagattgcgtatacgtcaggaagcagctcggttgatgtatcaagcgaagctgtaactataatgacagtaaagtatacagtaaatagaggaatagaaacagcggctaatgtatcagtaggaacgaaggacggatattttgcaccaacaggagctgatactgatatagcagcagtatcaacagctgaaaccgttaatctgtataacctaaaagtaacactctcaagcggagatggaaacactgtttcaggttcaccggcagcatattatacaaagtataatacagcaggactatacacagacgacagttatactacggcagtgacagatacgcaaataaagggactggtaactgcaaacgagaactaccgtttggcaaaagatacaacagaggaaccgctgtggaaaacaagcggaggaacagggtatacaagcacagatttgacaacaggaacatatacggaagatacaagtctgacagctcaggcagtgcgccaatacaagataacatttgagccgggaacacacggaagttttgcagcgggagcagtgacagagatagcaaaggatgtaaactcaaaattgctgcagtcagacctgccgacaatagaagcagaagcaggatataatccggatggctggatgagcggagatgtaaagatagacctgagtacatatgaagtgacaggagacgcaacattgacagcggcatatacagaagcccagtatagcgtaacatttaatactgtgacaaatggagcgtatacaggagagacaggagtaacagacggaaaagcgacatatggaacagatataacgttcagtgtagagccggcaaacagcggtgatatagtaggatatgtatattacacagtaaacggaggaaacaaaggatacttaacaggaagcaacggagtatatacaatcccatatcagatgtttggagagaatatccagatatatgcaggagtaataacaggaacggtaaagattgtagcgcacgacagttacaatgcggcgccgagcggaaaagatttggtagtagtaacgacagcaaagaatgaaaatgccaaatatgtattgcagtcagccggaacagcagcaatagaaatgtattactcagaaggcctgggaggatatgcggcatttgtatcgaacaacggaacaacaattacggagcaggaagttaaggacagactgtcagtaatggagggagagacagccaatacagtgatagcgcatacggcggacataaacggagacggatatgtaagatcagtagacgcgatgatagtaaacgacctgtattacaacaaccgaatcggagacacatcagacgaaatgagaataaaagcaaactactataacagtgacgacgcggtagacacaagtgatatagctgcagttctttatactgttgtaggacgttcttttactaaataagactggaggattagattgaaaaaatatatttcgctatttataatatgttgtatgtttttatctttaatgccgggaacagcagtatttgcggctgctgattttgattttattttaaaatcaggcggtcaaagcacggtaactattggtgttggggatgaaattacagttgaatttgaattggtaaaaaatgatggagcttcatattcaatgtattcaatgcagaatgaaatattgtatgatactgaatattttgattatgtgcaaggcagtataaatgttgaaaacggatttaagtatggatttagaaaacttgagtcttcaagcggagcaaaaattttaattggttttgttgattcgagtgaaaacggaaccgaacgcagcggcagaacattagtcggcagttttaaactaaaggcaaaaaagacaggaaacagcagtataaaaaatgattctgcttatgtgacaaaaagcgatttaagcagatattcatcatcatattcagatattgacgcggaaatagtagaaggttcaatatccactccaacacctgttccgtcattgcagccgacttcgggacctactgctaagccaaagccaacctcaaagcctgatacaaacggaaacggtggaaatggaggcggcggtggcggcaatgatacaaataccgccacaccaaagccaactgctgctccttcagcttcagaaggaccgacatctgaaccaataataacaccggttccaacaagtggaatttctgttcaggtctttgatgatgttgaaactggttattgggcatatgatgatattatggagctttattatgcaggtatagttaacggagacagtcctaatacatttttgccggaaaataatattactagagcagagtttacgaaattagttgcattgctttttgagtttgaggtagatgaaaccgcagagacaaactttgtggatgttcctgcaggtgaatggtatactccatatattgcagctgcatacaatgaaggtattgtgacaggatattctgaaactaattttgagcctgataaaaatgtatcaagacaagaaatgtgtgcaataattggcagaaaacttaatattgtatcagataaagaaactgtatttactgattctgatgaaatagaggattatgctaaaccttatgtgcaatctatgacggaagcgggatttataaagggatatgacgacaacacgttcagaccgtttgaaaatgctacaagagcagaatcggcagctgtcattaaccgagtaaaaaaatctaaatagacgaacaaacatgaaatgcgtttcatgtttagttgggcaacagagctattttgaagctctgttgcctttttagttataagctgaagattaaaatctgttattttaataaattataaaaatataatgtgtataatgtgtataattgacaaaatataactaataaataacaaaataaatgtagcaatcataagaaatgtgtgctaaactaagtttagttgttagtatttactgtaatgttgtgaaatatataaaaatataaaataaatttattattaggaggtacattatgttatcaaaggcagacagggcaggtaaatttttaacgcgtatttttctttgtgcggcaattattcttggaactatggttcagttcgtttcggcggcaacccaggatttgagctatccggctcaattggtgaaaatttcagtctatggcggtgaacgaaatttaaatatttccgggtatggtgaaggttctgctcttaatacatggaattcaaacggttcaacaaacgagcagtggagaattgattatgtaagcagcggagtttttaaaattgttaacgtaactacagacaagctggtatcagctgaaaataattctgctgtaagcaacgcaaaatgtgtacttcttaatgataacggaagttcttctcaaatgtggaatattgttggtgttcagcaagattttttgggaaacgatttatattacaaaatttctaactatgcaaatccagaccttgttataagttataatacaactacaaatgctattaccttaaaaacttatacaggcgccaacaatcaaaaatggaagttaaactgtgatggtttagacggttttgccggtaattgtcttgttcaggaaggtgaaaaagctggtaccattggaggtttattaggcgaaacagtatatgtgtcaaatttatctcaacttaaaagtgcattgctcagcacgaaaccgcttacaattgttataactgcaaatattgacaactgcaacagtgaaatgtatgatttaaggatagaagataataagacgattattggttcttatggtgcaaataggcttactgacccccgtctgcgcacggacgactattttaaagaggaggcggtaagcaataacattgttatcaaaaatattaatttcaatattgctgaaagagaagatgtagttgcttttgcagtatatggttcaagaaatatttggattgaccattgttcatttaattgctcattagatttatattatgatgaagtaggtaagtttatttgggtaaacagatgcgaatatgcaagtttagatcctgattttgtaaccatatcttataatgaatttaatcatagattttggggtatagcttttggagctaaatatactgcagaagatagggcgagcgctatgtataacaaatttacttctgttgttcaccgcgcaccgcagcttggaaacggaactcttcatgtattaaacaactcatattatagaaatgattctaccctttataatgacggatacgcttccataaaatgcggagctggttcggcagtatattctgattcgaacagatttgtcggatataggaaagaatcaagcggctattgggatatggaagttacagtagattcttcagccagtttcatagaccatggttcatatacaaacaagggtgaaacacctgtgtctgtaccttataagctagcagcaccgactgatggaagcgttacaacatggagcccgtctgaaaattatggttatagtattgtaaaagcctatggaaataatgatattacagtattctgtgataattattccggagcagtaaagaacttttctgaactgcattatataaatcatgaggcttgttcaaattacattgattcaactgtaatttcgcctgttaattttgcctttagtgacccggataatgacggtgatgatactgtagataccggaatcgttgacggcggaaaatatatgataaaaaatgttaacagtggtctgtatcttgatgtagctggcggtgctgcgtcaaatgggacaaatgtacagcagtggggggctagctcatccgcttcttacaatacgtggaaagctgttttggtaggaaatggatattatcagctttattctcaggttggtgatggaaacacatatttattagatgttgcagacgggaatacatcaagcggaaccaatataaggatttggcaaaatactttttgtgacgcacaggtatttaaactggagaagcagagtgacggaagctatgctattttaactaaaatcactaataaccaatcaggtttggatgtggaatcagggtcaaaatccagtggtgcaaatgtacagcaatgggggtacgctggaggtgcacatcaaaaatggatttttgaaaaggtgaactaaaatcactaaataaatattggtaaaataactaaacattggaacttttttctaaaacattcgtcttattaagtataagtgattattttttgcttatataaaatgtactgaaaggcggagttattatgaagtgtaagaaattagtttcaatgtttttagttgtctttatgttagtttcaattgctttaattcaaacaattaatgtatcggcggatagttccgggactatttatgtttcctcttatcctgatttagtgaacatgatgaagaatcctggcggaagttatattcttttaaaggatatagagataaataacgctgataattttagtgttcaaaattttagcggcatttttgacggcaatggtcatagtataagtttctcaaattcaagggcaggcggttttgttgaagttcttgaaaaaggagcaacgataaaaaatctccatgtttatatttcagcggcaaccggtactgataacgtaggtattattgccggaacttcatatggaacgatggcaaactgctgggtttcagggtatgtcagcgcatctggtgttaattgcggaggtcttgttggtaagctttcgggtggttcggtgagcgattgttattcgttggcaacggtaagcggaaccagtatttatggaggactaatcggagcagctgaaaatgcaagtgtggaaagatgttatgtttcagcttcaatagagggggcaagagctgaggcggggtcttttttgggaagcaacagttcatcatcagtaaataactgttattataattctagtaaaaacggagcgtttttaggggtaggaattggttcggacactgtcactgcaaagactagtgaagaaatgaaatcagcggagacttttgccggatttgacttttctaatacgtgggtacatattgatggtgaatttcctaaacttgtctgctataacggaaagggaacttcagataatccatataaaattcacactaatgacgagttaatatcaataattcagccatatctaggagatgcaggcacaggcagatattatcagctggctgcaaacttaaaaaattattcaggtccatcactgggagatgatagtagcagatttaccggtttttttgatggaaatggttatgtattttataacaccaatatatcaagcggaggaattttttattcagttgctgaaaatgccgttgtaaaaaacgttgtttttgatggatacaatttttccggcggaggtgtagctggcgctgtcgcttcaataaatcacggaacaatagataattgtcatgttggaaatggtacaatttcaggttcaaaagatttaggtggaatcgttggagagagtattaatggcactgtcactaattgttcttttacaggcgatattaatggtcgtggttccggcataggcggtattgtgggatataacagttacggcacaatattgaattgtgcggtctattcgggaactattagaagctccgatcatagtgttggaggtgttgttggggataactccaatggattagcagaaaattgtttttcacttgcaagtgtgaacacaagtaccagcgaaagcggaggagtcgcaggaagactgtataatggagttatacgtaatagttattctaatgctggagtttatggaaacgactcaaatagtatcggaggtattgttggcagtataatcgaagacggagttgttgaaaactgtctttacaataaagaacttgtttctgttttaataggtggaacagaggataaaactggaggtatatcagcagatgaactcaaaaatgcttattactattcgggatttgattttacttcggtttggactgtagatgaaagcggagagtgtattgtattgtcttcgatttcaggaaagggcacaaaagaaaatccgtatttgattagaacatcttcagattggatcagagttggaattgggataaaaaacagcggagaaagaaattattataaaataatgaatgatttattctctgtaagggccttaggtcaattttgcggaagtttggatggcggaggtcatgaggtaggacaacataacggaaatttgattaccacattaaatccgggtggatatattggcaatttaacggtttcaggaataattgttgagaccgttgacaaagcaacaatagagcattgtacagtatataattcaaatgttagctattttgatggaggctttgtaaataaaaatttgggaggtaaaatttctgattgttcagtaattgactcaaccatttctttgactgatataacaggcggatttgtagggcaaaattccgaaggcggagtaataaataattgttatataatgaattgtaaagtttccggtaatagtattgccggtggatttgttggaaacaacactaacggcacaattgaaaattgttatgtttatgacactgttgtaagcgcgccaagtactgttggcggtatggcaggaagaaatgataataacggaaagattaataattgttatacgggggcttctgtttcggaagcgaattatgcaggagcttttgtaggtatgaattacgcagcaataagttcttcgtatgcaaacggtggatattcagcaggcaatgctgtaccggcagtgaaatttgcaggattgaatgaaggaaacatcaccggagaaaatcttgatttcagcggaaatactttaccatataaatatattcaaacttcaggtttaaatatatctgttaacgatacaacggtttatacacctcaaactcctgatgttacaccaggcggattaactgatattagcggtcattgggctgagcaaaccataagaaatctggtttctaaaaatgttgtaaacggatacgaagacggaactttcagacctgaggatagcgttactaagggagagtttattaaacttttgatgagtgcaacaggaaaaggaacttctgacggatttacaaattataaagatgttaatgcgagttgggcaagaccatatgtaagtaaggctatatatcttggaatttgtgataatataagcgacagcactgagatatttggagttgacaagtctataacaagagctcaggcagttgctcttatgggcaggttattagcgccggataaaacaggaattccatcgtttacagataacagtagtattccggactgggcgtcaaacgaggtttattctatggttgaacttggcttaataacaggtatggaggacggaagctttaaacctttagataatcttacccgtgcagaagcggcaacaataattgaacgtattatgaatttagggtaggtaataaatatgaaaaataaattaacaacatttatcctgactgtttgtttggtttttagcatagttcaaataggagctgtgtcggcagatgatagtttgactgttacttcaccaaacggctgtatatccatttcaatagaaacaaaagacggaaaaataaattatagtgttaagtataactcaatcagcataatcgaaagttctaatattggaattacattttcttcagttgattttagtgaaggggtaaaatatgtatcatcatataagaatactgtagatgaaacatattcgatgctgacaggaaaagcatctgtatatacaaataaggcaaatgaaacagttatgacatttgaaaaagacgggcatttgcttgatttatatgtaagagcttatgatgatggaatagcgttcagatatgggttcaatgaaaacggtcaggcactttcagaaaacacaactttcagattacctcaaaattgcacagtaaatgctatggaatacgaaatgtgttatgaaaatttttataatagacataacttatatgagctgaatggagtatatggtatgcctatgactgtcaaggttgctgataatacttatgctttaattaccgaagcggaacttaatggaaactatgcaggtacagtattaaatgctgacggcagcaatgttttaaaactaggatatgagcctaaacaatcagagccggttgaaatttcagcaccatttctgtcgccgtggcgcactgttataattggagaattgaataccatagtctctactgaaatgcctgaaaatctatgtgctccttgcaaattagaagatacttcgtggataaagccaggagtatcaagctggacatggtttaacggtgacccaactaatgaccctgaagtttataaacagtatattgacttatctgccgatatgggctggcaatacgtactgttggatgagggctggcagccattagaatacgatgagtatgggagaaagacatatagcggaattatggattggacagaggaagttattgagtacggaaaacaaaggggaattggtattattgtttggtctacaagctgggatcttgatactgaacaaaagcgcgagagattaaaagaatgggccaatatgggtattaaaggtataaaagttgacttttttaatagcgaaactcagcagacgttaaaacttatggactcaataactcaggagtcagcagagttaaagctgctggtaaactttcatggatgcgttaagccgacaggagaacgcagaacttggccaaatcttattacgcgtgaggcagtatatggaaatgaacattttttaagtggagaaaattggggcccgacggctgagcataattgcacattgccgtttacaagaaatgcagtaggaccaatggattttacacctgaacttactaatcataatgataaaaattattttaccgatggtcaaaaatgtgcgttgcctatagtttttgaatccgggatacagtgtttgtcagataagcctcaaatatatgaaaatagtgcggctcgtgaattatttaaaagcattcctgctgtttgggatgaaacgaagctcttatcaggagatattggagaaagtgccgcagttatgagaaggtttggtgatacatattatgttgggagcatttgtaataatcaatatgttgtggatataaatcttgattttcttaaaagcggcaagtattggtttgaaatgtatactgacggttccaatgatacagatatagctgtttataatggtgttgttactaatcgggatacaataactattccgcagttaacgcacggcggaggagctgtaaagtttacaccgataaaagaaaatacaaagttattttcggacattgacggacactggtgtgaaaaaaatatattatcattagctgaaaaaaataaattgaataaatatttttacggcgagtttggagtggatgaatatataaccagagctgaatttgttatgcttttgacagacgctttggatataggttgtatgcaaggaagtcctagattttatgatagtataaggcatattgctaagaatcatatttatacagccacagaaaaaggtattattaatggaataagtgaggaaacgtttttaccggaatcgaatatcactcgtgaagatgcggcaactataataggccgatatgagaatcttaaaggcggtataaacagtggattttctgacagcaatgagatatcccaatatgctaaagagtatgttgcacaatgtgttgcaatgggagttataaccggatacgaagataactcgtttaagcctaaaaataatattactaaagctgaagccgctgcaatgctgtttaggtgtcaaaacttaaagtgatacttttaaatcccatgatttcatatcatgggattttatatttttatttctttagaatatgctgactttttagttgcaaatactattattgttatatcaatataaaaaaacgttatagctattgccaatatatgttaaatatgttataataaaaataataaactattagttttatttataaatattgataaaaatttatataaaaagattttatctttttttgggagatggggaaaataaataaaataaaaaaatatattagatatgtttttcctttcattttagctggtatgttttgttttataagtgttacgtctattgttacaattattcatatgcagggtaacgcacgggtgattaattataccggaattgtaagaggtgccactcaaaggcttgtaaaacaagaaatgaatcagtacccaaatgatgaattaataaattatattgatggaatacttcttgaactttcaacaggtgatggtgagaatggtttgagaatgattaatgataaagaatatcagggattagttaacgaaatgaaggaaaagtgggaagttataaaatctgaggtacagtttgtcagggctggaggagataagcataaattatttgatttaagtgaagattattttgcgcttgccaacaagacagtttcttctgttgaactttatactgaggagcgcgtaaaaagtgcaaagtggactttgtttgttttaaatgccggttttgttatattatttattttattctttatgcttggtatgagacaaaaaaaggttcaaacagaccttatatctgctaaaaacgccagccgtgctaagagtgaatttctttcaagaatgtctcatgaaataagaacgccaatgaatgggattatcggaatgacagcggttgcgcgtatgtctttggataatagagaaatgttgatagattcattaaataaaattgatttgtcttcaagttatttgttatcactaatcaatgatatactagatatgtctcggattgaaagcgggaaaattaaacttgataatgaagtttttgagatcactgaagttttaaaacgaatatatataatgtttaagcaaaagagtgatgagagcggtatagattttaaaattaaaagcgataatgtaaccgtaaataaagttattggtgatgaattaagaattagccaagttattattaatataatctctaattcaataaaatttactcagttcggcggtaaggtaactcttgatgtcaggcagaaaatcgatgatgatgaaaaagttatatttgaatttgttgtttctgatacagggataggtatgagtaaagaatttcagagacatatgtttgaaccgtttgagcaggaacggaatggaaactctcatcaatatgcaggtactgggttaggattggcaataagttataactttgtaaaattgatgggcggtgaaatcattgtacatagtgaattaaataaaggttctgaatttgttatttatttacctcttcaaaaagcagaaaatgcgaagcttaatgaaaaacaagataaaaatatttttgaacaaaagaaagaggagcttatgaatctttgtgaggttcatatccttttagctgaagataatgaaataaacgcagaaattattacttttttattgcaaaaatgcggtgctgaagtagatttagctatcaatggagaagaggcagtgaaaaaatttgctgaatcagctgttggaagttatgatttgattttgatggatattcaaatgcctataatgaacggtttggaagcaagcaaattaataagagcaatggagcggccggatgcgaaagatattttaatagtgggagtctcggcaaatgcgtttagtgaagatgttcaaaaagctaaacagaatggaatgaatgaatatatatccaaacctatagatatgtcgaaattgtttgaggctattaaaaagtatttataattatatataaatagaataagctttaactaaaaaatatttgaaatatatactttcttttaatgtggcattttgttcttttatagaaaaataatttgtattttaataatgacagttaaagatattaccggttttaaaagctgataaatttggtgagagtgaacaataaaaaactctgtagacaataaattctcattatttatataataaaatcataatttggttatatccaacttatgatttgtaaaaaatccggcaatctggacaattaagttagcgtgctgccttgattatttcacaaataacctaaaatttgttaagcatgttttttaaaactgcagaaatacaaaagaggttatgttggtgagatagattaaaaagtgcataatataaatagaataaaaagtagcgggatagcatgtgctatcccgctactttctggtaaacttaaagtataagtaataccgattcaaaaatcaatacatttttgaatattaaaccatttggtgactcctaggggatttgaacccctgtagccggcgtgagaggccggagtcttaaccacttgaccaaggagccatatggtagcggtaactggatttgaaccagtgacactacgggtatgaaccgtatgctctagccaactgagctataccgccaaatactgttattccttcaatttgcgaacaacagttaatattatatcagagaaaataatatatgtcaacactttttttaaaaatttataaaaaattttttaatgcggctttttaatcttttacagactatttattggtttttaaattttctttttttatgaatatcaattcttaaaaaagaaataatattaatatgctgatacgatatattatatatggcttgctcggaatgaatatggaaatcttctggaccagcctttcgggaataaaaagcggttctcataatttaattggccatacttctatatggatgttttttatatatggtcttgctgtggtcatcatggaaccaattcataatttaattgctgaccaaaattggtttctaagaggttgtgtttgggcttcggtaatttttgtcatagaatttactaccggaggtattttgagattgtttcaaattgagccttggcattataccggtgaattttctatcatggggcttattcgaatagattatgctcctgcctggtttgccgtcggcttactgttcgaacgtattcatactttgcttttaaattataatattgggctgaaataggtgattgaattaactgtttatcattttgttcatatcttttctcagcctttttataattcttttttcaagtcttgaaatgtatgactgtgaaataccaagaaggtctgctacttctttttgtgtcatttcatcgccgttattgtttattccaaatcttaattcaacaatatttctttctcggcctgaaagtttttccattgcaagataaagcagttctctatctgtttcgtcttcaatgtttttttgggttacgtcattatcagttcccaatatatcagaaagtaaaagttcgtttccgtcccaatcgacgtttagtggttcgtcaattgatacctctattctgttattattattttttcttaaatacattaatatttcattttctatacatcttgaagcatatgtagcgagttttatatttttttctggcttaaatgtatttattgccttaattagtccgatggttccgattgagattaagtcttcaatacctataccggtactgtcaaatcgttttgctatatatactaccaatctcaaattgtgctcaattaatatttgtcttgccttgtcggaatagtcaggatttccaagtctcgatgtccaccattgttcatcttctttattcagcggaggaggcagagtgtcgcttcctcctacgtagaaaactttgccatccttttttgaaacaaagtttagataaagctgttttaagtacttttttagtttttggtacattattcttccccctgaagatatatttattatttttttctgtaaaggcgtccgggcttgcaattgcattataaagaccatcgctgcaaaactctgtatttacgaacccaacatagcaattttttttgtcaaaataatattttccatattttgttgttatatgttcgggttcaaataccggtattaagttatcattatttttggatacagtagatattttaaccagcctatattttatatgttcgttttctaaaaatgtatatgagtttttttcgccgccgattaaaataacaggttttccgcttagcggttcaattagctcacatcctgtgtccattaaaatatttagtttgtattttttattcatcaatatcaattcagcgctttgtattattttatttcggcttaggtttctgctgcatatttttataaaagcgagaataatcaaataggcagctataactaatgatataagagttgtaatgtttaagtccaagtatggtaccccgtttgagattatagatgtatcttttatagaaatttgatatgctataaaataaacaaatcccgaaaacaataatgatactataaagaataccaaagtatgtttaatcagtttaataaaagtgttgcatttataaaatatcattacgaataaaacagtaaataatattcggcctaataaagtatataacaaatatgtatgcggaaaaaacataattacagaatatagagctgatattgctgaacctagtgccagtctcaatatcgtggttctaaatctaataattatgcttgctgcaaaaattattaaagagttaatcaaaaaattgcttaaatataaaatatctatgtatatggtcaattatatcaccaaagatattatagagcagtttttgaaaaaaatatgtcagaatgggggaaaaataaaaataaattaattgatgtgaagtaacttcgcattttaatgttaaaacaataaaataacaaatatttatagtatatagataaaaattttttaattttgtgtcttgaattccatattgttatatgatacaataaaaaagttaaatacatatatttagaaaataatattaaatttttttaatgtaatctttaataagggaaggttgataaatgtggaaatcactataaacaaaacgcaaaatcctaaggtaaagcctgatatgagtaatttgccgtttggaaagtatttttcagatcatatgttcattatggactatgacgaaggaaagggctggcatgatccgagaattgtcccatatggaccaattgaacttgacccgtctgctatggttttccactatgcacaagaggtatttgaaggtttaaaagcatataaatcttctgatggacatgttcgtttgtttagaccggacaaaaattttgccagattaaatgtttctaatgaaagactggcaattccgcaaattgatgaagctttatgtcttgaaggtttaaaaaagcttgtagaattagacaaagaatggattcctgagcaggaaggcacgtctttatatattagaccgtttattattgctaccgatccatttttaggtgttaaaccatccgagtcatataagtttatgattatatgctcgccgagcggtttgtattatcctgaaggtttagctcctgtaaaaatatatgttgaggattcttatgttcgtgcggttcgcggcggaacaggatttactaagaccggcggtaactatgcaggcagtattagagctcaggttgttgctcatgagaagggatattctcaggttctttggcttgacggtgttgaacagaaatatattgaagaagtaggttctatgaacatattctttaaaatcaatggtgaagttgttactcctgctctaaacggaagtattttgagcggtataaccagaatgtctactattgaacttttgaagtcttggggagttccggtatctgaaagaaaaatatcaatccaggaagtatccgacgcttatgataacggtactcttgaagagtgtttcggaaccggtaccgcagctattatttctccggttggtgagcttagctgggatgataaagttatgttgataaatgataataaaatcggagagattactcaaagaatttttgatacaataacaaatattcagaccggaaaagaagaagataaaatgggctgggttttaaaagttgattaagtaattgattgggtattataatatatataatataattaggaatgcaggcatcagtgtcatttaaattcaaaatattttgatagaatgaccaatgcctgtttttttataatttaaggggatgagctgatggagcgcggaagtggaatattaatgcatatttcatctttccctgcaaaatacggaataggtacaatgggaaaggaatcttttcaatttgttgattttttgaaaaaaagcggtcaaaaatattggcagatcctacctattggtcctaccagttttggagactcaccgtatcaatcattttcaacttttgcgggtaatccttattttatagattttgatttgctgcgcgaagatggttctttaaatttagaggattattctgaaattgattggggaaacgagcctgacagagttgattatgaaaaaatatttaaaaacagatttaaggttcttaagattgcatactctagagacagaataagaaaaaaggcggaaatagataattttagatttaatcattcatattggattgaaaattattctttatttatggccttaaagtttgataataatctaaaaatgtatcgaaattggaatgaggatattgtaaaaagaactcctgaagcaattattaatgcgtataatgatttaaatactgaaattgatttttgggtatatgtacagtatttattttataaacaatggtatgcgttaaaagaatatgctaatatgcagggaataaaaattattggagatataccaatttatgtagcagaagacagcgcagacgcctggtctcataacgaggtgcttatgcttgatagctgtggtattccaataaaagtggcaggttgcccgccggatggttacgcacccaaaggtcagctttggggaaatccgctctataattgggactacctagcttcaaccggttatgaatggtggatagaacgtttaaaagcggctttgaaaatgtatgatgttgttcgtattgaccattttagagcttttgacgctttttatgcaatagattatggaaaacctgacgccactgagggagagtggcttaaaggtccaggagttgatttttttaataggctgaaagaagctttgggtgaatctcccgcattaatagcggaagatttaggaactataacggatgatgttagagccttactgaaatacagtggatttcccggaatgaaagttatgcagtttggcttttctccgggagaaaatagtgattatttacctcataattataaaaataattctgttgtatatattggcactcatgataacgatactctaaaagggtggtttgattcacaacctgaagaagttcaaaattttgcggttaaatatcttcgtctgaataaagatgagggatacaattggggatttataaaaaatttattatcaactgttgcgaatacggcaatagtaacgatgcaggatattctgaacttaggaaatgatgcaagaatgaatacgccttcaacactgggaggaaattgggagtggagattaaagtctatggatttgctttcagactctctttcttcaaaacttttagaaattactaatatttattcaaggtaagttatattttgtttggttcgcctggaaaatttgggcgaacctttttatttagaataattttataaattatattattataattttgttaacctacttgaagtttaagcttttatttgctataataagtttcaaaattaagaaaaatgtctgattagggcgtgtttaaatgggcaaaaaaaattttgaatcaaacaaaggaaaaagcaaacgaatatggatttattctattattggcgtgctgttggttttgactggagtttttttattaagtgaatctcaatttgacgtaaatcaaattcctaatttgttttcagagatgaaaaatatgctgtttgataaaacagagaataaagttcaaattgccgaggaaatgcctgcggctaaaattaaggcgtattcagaacaaacatcggttgttgagcctgacaaaataactccgtctaatctaaagagtgctgatggaacttataatgctgaaggcggagctaataatctttatgacggagatatttctacatgctcaggaagttccagttcttgggcaactctagatgctggagagttaaaaactctttcatatataagatatataccaaacacttcatcgcaaatcatgggcaatacatgcgttggaactaaatttttggcttctaaggataataaatattttgttgagctgggaacagttaatcctgacgttaacggtgatataaatttagattggcatacacttgagttcagcggttatggagaatacagatattttaaagttgagctttctccgtatgcgtcttttggagaaattgaatgggtaagtgatactggtataatcgcagatgaaaatgataaaaccgattttagttttatggcgtttgacgctatggaaggatttgaagggtatactgtcttatctatatataataaagataaaatattaaaatgcgtggaaactatcgactctgattttaaggtgggtgattatacaaagctggaattttctgatattcaattagagcttggggattacatacgagtaataacatatgataagcaggatatgaaaatggcggttgacttacctttggattatcgctttacggaggcgtcttcaaatttatcggtttcaaatatatatagcgataatatgatgtttcaggcagatcaggaactcgtgatatcaggaaaaggagtgtgcggttctgaggttaaagcggttattaaaaacatggatacgggagaagaattttcgggaagcgatattgccaaagatatttccgactgggagataaatttaggagtttttgaaaacggcggaaattatgaacttttaatatcgtctgaaaatgaaaagttagaatttgcgaatataacctttggtgatatatgggtttttgccggacaatctaatatggaattttatctgtgcggagaaaaaagcggaaatgaactattaaatactaaggaaggtaagaagaaatcaactactgataaaatcagaatgataaatatgtataatatcggatacatgggagcagcaggtgaagttgagaatgttccgctaaacgactggaacgagtattggacagagctcacgcctgacagagtttcttatatgtctgcaatagcatattatttttcccagggaataaaagaccgatatgaccgtaatgtaggaataatcagtgtagcggtcggagataccgaaattaatcaatggtatccaagaggagagagttttggaaaatttacaggtgacagcggaaagctgtacaataaccgtatatatccatttactaagcagaaaataaaaggtattttatggtatcaaggtgaagcggataattacagaactaatatgaatgctgaggaatacagcgacgcgatggccggattaattgatctgtacagacaaaaatggagcagtgaagatttgccgttttattatgttcaattaacaagatatgaaacgaaggatgcaagtgaaattcgagaagggcagcgcatagccctccaaaaagtgagaaataaaaagaatgtaggaatgtttggtctgcttgatataatcggacggtatgaccaaggagaaggatgtgcaagaaccgatattcatccatggcagaaagaagtagtggcagatagatttcttgattatgtaggacatgatatatacaaggattcagaagccaatacttcaggaccagtataccagtctaagcagaaaattgataataccatagttttaacttttaagcataaaggaaagttaaaagttatggataaaagtcaatatgctgattctgtctgcgagcaaaaaatatcagcttcatctacagataccagcattttgcatgagttctggatttctgatgagaatggcaaattttatccggcaaatgcaagaattgaaaatgataaagttgtcgtatggagcgacagcgtttctaatcctacagatgttatgtatgcttggggagcgtatcccgaaatgccaaatttaactgatgattcaggacttcccgcagtaacttttaatacatataacggaagtgaagttttatagtgtttatttgataaatattttgatttattgttttgaccccgcctaatatattaagcggggttaagtatagcatggaataaaaatattaccggtaaaatttataatatgaccaaaaaattgtcaaaaaatatggtttgtttataaaatagtaatctaaattattgacattaaagtcattcaaaggtataataaacagaatgctaatttgagtttttttggtctaaaacattttcagtttttatactgtttttttgcactctgattctaagtataaaatctaaaatttgtgtcttttggcagtttattttgaagatgatattttgttacataggaggtatttaaaatgttgaaaacatttcgtggcggtgttcatccaaacgatatgaaagagccaacagccggaaaggctatcgttgaacttgatccgtcgcaggaaatggtttatcctgttgcccagcatataggagcgcctgcaagtccgattgtcgaggttggtgatatcgtttatgcagggcagaagattgcagaagccggaggatttgtgtctgcctgtattcattcatctgtatcaggcacggttaaagcgattgaaaagaggcttcatccaaatggattaatggttaattccatagttattgaggatgacggacaggatactatttatcctaacttaaagggctgtgatgattatacacagctttcgcctaaggaaataattgaaattataaaagaagcggggatcgttggtcttggcggagctaccttcccaacacatgttaaactgtcgccgcctccggaagctaaaatagattatgtaatagttaatgccgctgagtgcgaaccatatttaacatcggattatagaacgatgcttgaaatacctgaacagattattggcggattaaaaatagtaatgcatatttttggattaaaagatggttacataggtattgaagataacaaagagctagcgattgagacgatgaatgctcttgcggcaaaatctaaagatgttgatattcatgtggaaaaattaaaaaccaaatatccgcagggcggtgaaaaacagcttattaatgccataaccggccgaaaagtaggaccgggacagcttccatatcaggttggcgccattgtgtgcaatgttgatacttgcagagctatttatcaggctgttaaaagaggtctgccggttatgacaagggtagtaactaccggcggtgactgtgttaaaaatccaggaaattacaaagttcgtatcggtacctctcttaaagatgttattgagcaaacgggtggatttgtacaagagccgaccaagctgataatgggaggtcctatgatggggatggctatccctacacttgatgtgccggcggttaaaggcacgtccggtcttttagcttttggcccggatttggcttatggttttgaagaaaacgcttgtctcagatgtggtaaatgtgtttatgcctgtcctatgaaattgctgccgaataggcttgatgaggcggcgagagcagatgattttaaagcactggagaagttgaatattgcagattgtattgagtgtggaagctgcgcgttcagttgtccttcaaaacgcagacaggttcagcagataaaggtggcaaaagttaagcttcgtgccgcacagcaaagaaataaataaaggtggagggaataaatttggataatttacttgttgtttcacattccccgcatatatcaggtaatgatacggtcagaaaaacaatgcttgatgttataattgctttgattccggcattgcttgcaggggttttggtttttgggtatagggctgtggtcgtcactgttatcagtgttttggcatgcgtcttatttgagtggttatggaataagatattaaataaaccaactactgttggtgacttcagcgctattgtaacaggtatgcttttggcctttaatatgccggttacaattccgctttggatggttgttataggagcattttttgccattataattgttaagcaattttttggcggtcttggtcataattttatgaaccctgccctggctgcaagagcgtttttgctggcgtcgtgggcattagcgatgactacatgggttgctccgcatacagctgttccgctttggaatactgcggatgttgtgacatcagcgacaccgcttgcagcatatgcaggaaccgaaggagcttctcagcttccaagctattttaatttatttattggaaacgttggcggctgtattggagagacttcagctttggcaattttaatcggcggagcctatctccttattaaaaaagttataagattgagaatcccgcttgcatatcttttgacattagctcttggaacttggatatttgccggtccggatggattttttacaggagacgctttgtatcaagttcttgccggcggcgtaatgctgggagctttctttatggcaacggactatactactactccatatactcctgtcggtcaaattatttttggtatcggctgcggagtaataactgttttaatcagagtgtggggcggatatccggaaggctgctcatactcgattcttcttatgaatattgttacgcctttaattgacagaatcacagcaccaaaacgttatggtgcctcaagaaaaagaaaggaggcacaagtataatgaaagagacagctactcttactataaagttgcttttgataactgcgattgtggcagctctgcttggcggtgtaaatatggtaacatcacctataatcgctaaaaatactgaggctgcttttaatgagaatatgaaagaactgcttcctgaagcagataagtttgaaaaggacggtacaaaactgcctgaacctgaatccggtataactgttgacggtatatatgccggtatgctaaatgacggtactatagttggatatgtcgcaagtgctgtatgcggagaaggctacggcggtgatatagttgtgatggtaggaattgattcagaatgtaaggtaacaaaagctaaagttacggaaatgagtgaaaccccgggacttggagcaaaaagtcagtctgattggatagaccaatatacaggtttgggtcaggatatacaagttgataaaaatggaagcgctgcatcagcagaatacaaggttgaagctatatcaggcgcaactattacttcaaaagctgttacgaaagctgtaaacgcttctcttgacgccgcacgcgtggttattgaggataataatattccgccggctgaagaagtgcaaaataatgaaaatttggatcaaaatcaagtcgaggaaggtcagccaagtgctgaatctgaaacaatagattctgaagcagaagttagtcaggaagattctgaaactaatagagaagaaccggctgacagtgatgaagatgttgaagggggtgcggcagaatgaagcaaaatacatattttaaaactttcctgaatggattactttatgaaaatccttcgtttgtattatttctaggtatgtgtcctactcttgccgttacaaccggagttgttaacgctatcggaatgggtctttcaactacggcggttttgatttgttcgaatatcgttatatcgcttctgagaaagtttatacccgacaagataagaatagcggcttatatagttataatagccggtttcgtaacagttgttcaaatgcttatgaacgcttatgttcctgctctgtcaagcagtcttggaatttacattcctttgattgttgttaactgtataattttaggaagagctgaagcgtttgccaataaaaattctgttggtaaatcaatgtttgatggattaggtatgggtcttggttttacagccgctcttattttaatctcagcagtaagagaaattctaggagccggaacatttgccggtatttcattgtttggcagcggatttcagccggtttccattatgatacttcctccgggagcattcttgacgctaggttgtctgcttgcggtaattaatataattgttatgaaaaggaaaaagaaaaaaactgctctgaattcgtcagatgaaaaggagggcatataatatggttgcagatttattggtaatcagtataggcgctatacttataaataattttgtattagttcagtttttaggaatatgtcctttcctaggagtgtcaaaaaaggttgatacatctgttggtatggggtttgccgttgtgtttgttatggcatgcgcgtcaataataacatggtgtgttcaatattatttgttggttccgttccatctggaatatttacagacgatagcgtttattttagttatagctgtgcttgtgcagtttgttgagatgtttttgaaaaagtctattccgtctttatatagctcacttggcgtttatttgccgcttattactacaaactgtgcggtgcttggtgtagctatacaaaatataactaagttcggcggaacagatatgagttttttgaagtcggtggtttatggtgtttcagctggtattggattcaccatagctattgtattgtttgcaggtgtacgagagagattagaaagttcaaacgttcccaaattcctgaaaggtatgccgattacgctcgtaacggcggcgcttctttcgattgccttcctcggattttcgggattaagtttctaaaggaggggaaataaatggtttcaagtattcttatccctgtccttgttgtcggtggaatgggattaatttttggagttttacttggtgttgcttcaaaagtatttgctgtaaaagaggatgagcgtgttcctaaaattttagaggttctgccgggagcaaattgcggaggatgtggctttgcaggatgttcggcttatgcaactgctttgtgtaaaggcggagttaagaccaatatgtgtcctgtgggcggtgacgctgtttccgaaaagatttctgaaataatgggtgttaagaatgaagtaaaagaaaaaatggttgcccgtgttctatgtaacggaagtcctgaaagagccgttcaaaaatattattttgacggtccaagagattgttacagtgcttcgcgtcttggcggcggggaaaaaatgtgtgcttacggatgtttgggatttggctcttgcgttaaggtttgtaagttcggtgcaatgagcattaaggatggagtagcatatgttgatatagacaaatgtgttgcgtgcggagcctgtgcggaagaatgtccaaaaaagattattaaaatactgccgcttaaaagtaagtatactataacatgtaagagtgttgaaaaaggaaaaattaccagacgagactgtgcggttggttgtattggctgcggaatttgtgcaaaagcttgtccgaagggggctatatcaataagtgagcatttggcggttattgaccctaataaatgtgttaattgtggtatctgcgcacaaaaatgtccgcaaaaggctattaataaagttactccagctggattggttcgtcctgaaccaaaaccgtctaaacctaaattgacgccggaacaaatagaagctttgaaagctaaaaaagctgctgaaagaaaagacttaaatcagtctcccggcgaaagtgaaaagaatataaagtcaaaagttgttgatgcagatactaaattcaacgatgttgtaaagaataatattgatagagaagtaaaaataaaaagtggtgtgcaaatttctgatactcaggaaataaatgttaaagaatcgaatagaatataatcatggatttatattcaggaggtatatgtatgattgataataactgcgcatattgtgttgaaggcgagttagttgaaaagtttggaataaaaatatgtgaactcgaaacttgtaaggtatatttgtttaaagaacaaagtcatagaggaagagttatagcagctcataaaaaacatgttggtgatatgacggaacttactccggaagaaagatgctcatattttgaggatatagcaaaaatctcttctgctctcagaaaaatttttaatcctcaaaaaataaattatggggcatatggggataccggaagccatttgcattttcatctggttccaaaatatgaagatgaatacgagtggggtggagtgttcctaatgaatcctgatcgtgtgtatcttgacgatactgaatatgcagatatgataaatgaaataagagaagcactaaaagaagaggatgcaggttaaataaaatgcaattaagcagggtcttgtttgactctgcttaatttagactcggaggtgtgtttatgctttcaaaaattctctcaaaagaacagtgcgctgactgcggtttttgttgtgttttcagaagaaccagtatttgggaaactcctcttttttcaaagtcagttattgaaaaactcaaaacaaaatatcaagattctgaatttgttcgcgtaggtgatttatatactatagatttaagcaaagagtataaaactgattctgatgatgaggaagcagcttgtttttttcttgacaaaaaaagtggctgtatgcttaatgatgatgaaaagcctctggactgtaaaatatggcctcttagaataatgaaggatgctgaacatttagttattgctttgaccccaacttgcaaggagattaataaattgcctgttgaaacagttaaagagtttgtccagtcggggattggtgaatatattagagataaagctatggaaatgccagatattataaaggaatatagaagtgattttccggtaataatgacattttctgattagtatacaaatgaaaggtgatttaatgccaagtttagaatttaagaggattgaactttcagataaagaaatagttaataattttttaaataaaacaaattcgaattcatgtcaaatgacattcgcaaacttgttttgtcttcgtgaaaaatataatactgaaatatgcgttcgggataatgttttatttattcgtcagaagaatagaaattttggcggtgaaaataatcaaattgcatattttgttccgataccgataggaaccggaaatcttgagtctgccataaatttaattattgagatatcgaggaaagaagggcatagaccttatttttttgctgtgaccgatgatacgaaagatgaacttgaaaaattagataagtttgagttttgtatagaggagcaggaagattgggcagagtatatttataaaagtgaaaaacttgttgatttttcttcatcagacctttcaaaacagcgtagggcagtaaatcgtttttggaatctctatggagaggaaaccaggattgaaagaatcagcgaaagtaatataaaacaattattaaagtatcaaagcaaatggcttaaagaaaacatagagagaaacatggattctgattctttaataaaagaaaatgtttctatatgcaacgcgcttgaaaattttaatgagttagaccttgaaggaattataatatttgttggtaaatcaatcagaggctatggatacgggacaattttgcccggaggggcttttgatattatagcacagaaaggtgatataagttatcagcagatttataaggtagtattgcaggagcatgttaagacctattatgaaagagctgaattgactaatatggaggaagatataggtcttataggtttaagacgttcaaaaaccaggtatagacctgaatatatgttaaaaaaatatacagctttcttcaaataagtaattattatacaaaagacagggatagtatatatccctgtcttaattttgtttatatagaaaaatcttaataaatcaataaaatttatctttgtcaacattaagcccatacttctcgttatattttttgagctgctcttctttattcttttcaagttttatatcttcatgtatatcagctaccttttgggtaaccatttcgatttgatgtttttcctgcatatggtctacaagagttgtgttgtagactgggtcttcatagtgagctgcttggtatttataaacaagtttgagcaatactggtgtgattatcgtagtgaccaccacgacaattacaacgggagcaaagaactcctgaaccattaaaccaagagctgcacccttgctggcgacaatcagagcaacttcaccacgtgagatcattccaattcctatctttgtagactgtagattagtatatccgcacattttagcaccaacgccgcacccgactacttttgaaagtatagaaacaattaataagaaaaatgtgaaagcgattatagccggtcccattgagttaatggtaacttttaatccgacgctggcaaaaaatacaggagagagcaacataaaagacaccgtatcgaatctggaaattatatatgaagtccttttagttcctgataatataagcccggcaacgaaagctccagttatatctgaaacaccaaaaaatgcttcagagcaatatgccataagaagacaaaatacaaaactcaaaacgctgaaacggcgtaaatcttttttataaccattcatccaaggcctaacaaatttaaaaaacagataagcgacaataccacagaatgcaaagaaagctaaaattttaataagtacaatcggtagacttatagtcggatcagcacagctggttattattgtgagcgctataatacctaaaacgtcatcaataagtgccgctcctaaaatagcattacctgaatgggtagaaagcttgcctaattctttgagcgtttcaactgtgatacttaccgatgttgcagttaaaataacgccaataaaaatgttttgcagcagcgtattcgggtcacctgatttgttaaaaaagtaagctacaacccaaccgccaatcaaagggagaataacacccatcagtgctataaccgtagaggctacaccgcattttttcaattcttttatatcggtttcgagacctgcgctgaacattagaactatgacgccaagttcagatatagaagttataaaatccgtgctgtgaagccatccaaggcaagccggtcctaaaattaaacctgccagcaaagcaccgacaacctgaggcatttgtatttttcttgtgagcaaacctaataatttagtgcttaacaatataagcgctaaatcaatcaaatatccatattccataatccctaccatccttataaattcatattaaccccaaaataacattatagcttttattttataaaaatatattgatgcagaacacaaattgatttaagcaataatgcaccaagaactatgatactactttttttagtttttgtctacctatattttatcgttaatgtgtttttttttgctattatttttgttttgaaaatatcttggaatataatgtataatagtataaagatttgttatagtatatcaattataaaacttgttaattaatgattttattatttataggtaataattatattgtacaacataatcaaaaatctgcataatcataaatacatcatattgaaaagaccagcaaacgctggtctttttcgtatatttatgatgaaattatatgtgtaaaacaagagagatattattgttacagatcacggcaactacacattatatggtgtaaataatatgttaaaatattatgttaaaatattatgtataactcatcctcattgctccgcaagcggtcaaagccgttgtttttaccaaaattattttatattgtcaacaacctcaaagttatatgacaaatagctctgtcaaatagctttgaaaaatgaaactaattttatgtcataaattagtttttaagactatgtatcggtgcaggaatacgtccgccgcggttaataaatacttcactgctgtagttatgaacaggcataaccggagcttcaccgagcagtcctccaaattcaagagaatctccaacagttttaccggcagcaggtattattctgacagctgtggttttttggttaataactcctattgccatttcatctgcaataatcgcggaaattgttgacgccggcgtatctcctggtattgctatcatatccagacctaccgaacaaacacatgtcatagcttccagcttatctaaagttagagcaccgcattcagctgcggatatcatacctgcgtcttcactaaccggaataaacgcaccgctaagtccgccaacatagcttgatgccataactccgccttttttgaccgcgtcatttaatagtgcaagagcagcggtagtgccgtggcatccgcacttttcaagccccatttcttcaagaatataagctacgctatcgccaacctcaggtgttggagcaagtgataggtcaactattccataagaagagttaagcatctttgaagcttcgcgagctacaagctgacccattctcgttattttaaaagcagtcttttttatagtttcagatacagtgccaaagtcttcacctttgacttgctcaagtgctttttttactactccgggaccgcttacgcctacgtttataacagtatcgccctcacctacgccatgaaacgctccagccataaaaggattatcctcaacaggattggcgaaaacaacaaattttgcacagcccaaagagtcatcatcttttgacatgtcagacatctgtttgattatttctcccatctctttgactgcatccatattaataccggctttagttgttgcaactccgacagaagaacatacatattcagtggttgaaagagcttctggaattgattttatcaattttttatccgattcggtatatcccttatatacaagagcggaatatccgccgataaaattaactccgagttcttttgcagccttgtccaatgtttttgcaaactgaacatagttatcagttttgcttgctgcagcaaccaatgatattggtgtaactgatatacgtttatgtataatagggataccatatctcctgctgataatatttccggtttcgactaaatcttttgcacatctagtgattttatcgtagattttttgacatgctttgtcaggattctcgtctgcacaatctagtaatgatattcccatagttatagttctaatatctagatgttcatccctaatcatttttatggtttcggtaatctcatttgtatttaagtttatcatatgtatttcctttcggtggtttaaattctgtgcattgaattaaatatgtcttcatgttgaattctaatttcaactccaagttcttttcccaggccggcaagtttatcagacagttcgccgaaatctaatttggttgagcttacatcgacgagcattaccatggtgaaaatattttgcattattgtttggttaatatcgagaatattaatatcgttttcatagagcagactgctggttttcgcaattatacccgtcttgtctattcccataactgttaatactgctttcataatttttctccttaagtatataattataatttatcttatgtttagagtaatggtctaaagattttaaaccattactctaataaatatattatcattaaattttaaaaaagtacagtacaatattacatcaatttaaaattgctatacctatattaagatacaatgcaaaaatgcaccataataaatatggtatcagcatataagcagatgctttggatattctataaaatgctaaaatgtttaaaataatcagagcaattaatattgtaagccatacagctgaaaacgtgtgcagtccgaatacaaaaaataaaattgtccaagcaaagttaaaaaacagctgtaagccaaaaattaaatagcataatgatttcttaggctgcggagccgttgagttagcaattccatacagtgataaactcataagaaaatataaaaccgcccatactataggaaaaaccacacctggcggtgaaagcggaggcgatgcgagatttgcatattcttccatagcgttttttgtcaatatttctgataaaaaggcaactccaaatggtatcaaaaatgacaaaatgagttttttcaaatttaatgttttaaacatacaaccacctcatatagtttttagtatattgtatgtttattgttataattgtattcaaccgataaagctagtgaacaaaaaatacgtcttatattagaccataattttttaatccaacagttattccttcattcaacacggtttctgttacaaaacttgctatattttcaagttgctttgtgtgttttcccattgcaataccgtatccaacagttttcagcatatcatagtcattatcaccgtctccaaaggcatatgtatcatttaagtcaagtttaaagtgcttcattatttgatttatacccgaagcctttgaaatgttttgtttaaccaggtcgccggaaggattggaacggtgtttggttatattatatttatctccaaaattttcaattagtttgctgaataacttgtcaccgttatacgtaaacatcattttattcgcctgaactatatttatatcttccggcattgggaagaaacagttcatgctaatattaaaatggttcatcatttccataaaactttcataattatttttgctgtaatagcaggcgtcatgattttctgtaatataaccataattattttcatcaaaataacttattaattcagttaattcatttgttgtgagtttatcatttataatgtattctccgtttacagtggcacaagctccatttgatgtaatataacaatcaaagtcaattcctgtttcaggaacataacagcgtgctctgccggttgcaagaccaaccataaaattgttttcctgcagtttttgaatagaatctttagtagatttagtaggaataaagattttttcaccttcgtcaacaagggtaccatcgaagtcaaaaaataccgctcccctgtaattcttcataaatatatctccttatatcatgtttagtcgtaattcagcagactgaaatagatttacttaatctttaaatattctacctcaaactttaaatctttgcaatacattttttatataataggtaataaatctattaagaaaatttgcgcctattatgtatttatattgtataaaaatactatttataaaaatttttatatagtctgattttatataatttaagtaatatttttcttcgtattcttttttacaaatatgaaaaaataagtatggagggttattatgaaaacactaaaaaaatcattgacattaatatttataatttctttgttttgcatcacagcagaagcaaagacaatacagcatacggttgttaaaggcgaaagtatgtggaaaatagcggtaaaatatcaggtcggattaagtgagataatctcagctaatccccaagtatctaatcctgctttaatttatccgaatcaggttttaaatataccattgatggatgagtctataacttctttcgagcagcaggtaatagatttaacaaatgaaaaaagggcatcacgaggattaaaacctttgaatgctaattgggaattatcaagagtcgctcgttataaatctcaagatatggcaaataacaaatatttttctcataccagtcctacgtatggttcaccttttaatatgataaagaattttgggatcaaataccgttcagccggcgaaaatattgcttatggtcagcgtacaccggcacaggttgtaaacagctggtggaattcggcaggtcaccgagcaaatatgcttaacgctaattatactgatattggcgtaggctatgtagcaaatggaaactattggactcagatgtttatacaaaagtaggatattttagaaatctcagaaagaaattttaaaacatgtgtaaaagctctcagccgagggcttttaatttgtttgaaaatttagattataataatttatttgacataatatattatataatgctataatcataacatgaataaatttttgcctatttctaaaaaagatttagatttaagaggaattaagcagctggattttgtatatgtaatcggtgacgcatatgttgaccatccgagttttggacatgcaataatttctcgtgtacttgagcataatggatatactgtaggaataatttcacagccgtcatggaaaagctgtgatgatttcaaaatactgggaaagcccagattgggctttattgttatgtccggaaatattgatcccatggtaaacagatatactgtttcaaaaaaggtcagaaatacagatttatattctccgggcggaaaaggcggaatgagacctgatagggctacaatagtatattgtaataaaataagagaagcctttggcagtgttccgattattataggcggaatagaagcaagtttgagacgatttgctcattatgattattggagcaataaagtaagaagaagtattttaattgacagcggagctgacctgcttatatttggtatgggtgaaaggcaaatagttgaagtggccgaacttcttgacgctgaagttcctgtgagtgaaatcaaaggaattttgggaaccatgtatatagagaatgataaaaataatcttccgtatgatgcaatttcgcttccgggatttgatatggtttcaaatgataaaaaatcttatgctgcagcaacaaaaattcaatatgaagaacaggacgctgtcagaggaaaacctttagttcagctcgacaatgacagatatattgtgcaaaatccgcctgctgctcctttatccactgaagaacttgacgatgtatatgctttgccatatatgcgcacttatcatccgatatataaaaaacagggcggagttcctgcgattaatgaagtagagttttctattacttcatgccgcgggtgttttggaggctgcaatttttgcgctttgacctttcatcaaggaagaaccgtaactgcacgaagtcatgagtcaataataaacgaggttgaactgttaacagaattaaagaattttaaaggttatattcacgatgtcggcggaccgactgcaaattttagattcccttcatgcgaggaacaacttcagagaggtgtgtgtaaaaataaacagtgtcttttcccgcagccttgtaaaaatctagttgttgaccattctgattatattgagctgcttagaaagcttagaaagttacctaagattaaaaaagtttttattcgcagcggtataagatttgattacttaatgtcagataaaaatgatagttttttatatgaattatcaaaatatcatataagcggacaattaaaggttgctcctgaacacatttcagataatgttttgaaatatatgggtaaacctaagcatgaagtttttgaaaaattttccgctaagtataaaaaaataaacgaagagttaagtaaagaacaatttttggtaccttatttaatgtcatcgcatccaggcagcactttaaaagacgcagttaagttagcggaatatcttagagatacaggacataatccagaacaggtgcaggatttttatccaacgcccggaagtatatctacttgtatgtattataccggtatcgaccctaggactatgacagaagtttatgttccaaaaacatatgaagagaagcaaatgcaaagagcacttctccaatatagaaaccctaaaaattataatttggttttgaaagccttaaaaaaggcaggcagggaagatttaattggatttgattccaaatgtttaattaaaccgttaggaaataaaaaaatatataaacctgatacaaagaggagaggataataatggcaaagatattgagcggtaaaattgtttctgcccgtgtaaaagatgagcttaaaaaagaggtggaagaactatcacagcgtggaaaacaaacaggacttgctgttgttcttgttggggatgattctgcttcaaaagtttatgtcagaaataaggaaaaagcttgtgaagaggtaggaatttattcagaagttcataggttgtctgcaaatacatcggaagaagaacttttaaaacttataaatgaattaaatgaaaatgataaaattgatggaatactagttcagcttccattgccaaaacatcttgatgataaggttataattgataatattaaacctgaaaaagatgttgatgcttttcatccaagtaatgttggtaaaataatgattggagattacgactttttgccttgtactcctgccggaattatggaattaatacatgaaagcggagttgaagttgacggaaagacatgtgttgttataggaagaagcaacatagtcggaaagccaatgtcaatgctgcttttacatgaaaacggtactgttacaacatgccattctcatacaaaaaatttagctgaagttacaaaaagtgctgacattcttgtggcagctgtaggtattcctaaatttgtaaaagccgatatggtaaaacccggtgcggtagtcattgatgtcggaatggatagagacgaaaatggaaagttgtgcggcgatgttgattttaatgaggttgagcctgttgcaggagcaattactccggttcccggaggagttggacctatgacaatagctatgcttatgagaaataccgttacggcttcaaaaaagaaattagaaaaataaaaatgaaacagggaagactttttgtcttccctgttaaaattttgaaattaaaaattgaattatataaataattattttaaggtataagctcataagagcatatcctcccaatgttcctgtaataaatcttctgatattgttacattttattatgtttttagattgtaaaaaccaatctaaaaacattgccaaacaaaataatattacaataaatatatttggtttataaaaaaatattaaacaaatagcggcaatccaaccaaagaatacgccggtacatctagaacatacaggaaactgaaatccattgataaaaaaacttctttcaggtatttgatgacattttgtcagccttcctaaattcatgagttttaaccaaagcttatttgaatcaaaatttttatccattaaaacgtcttccgcaatttctgcaaatccaataggtgcggttagttgacgtagttccgctgttacaagctccgcataaaagacccaaaggaccaaacaaaatatatccgcagcatccgcttccggggtcgtatcctccgccggaaactttagtttctgtcattggctgacaattattacttccgcaatgaggacactttatgcctgaataaccatttgcttgttcattatttgaagcatttttagtacctcctacaacttctgcatcatattcaggcacactggcaggttgtccgcaatttgggcagaaagttgagttgcccaaatccgttccgcattttttgcaatacataaatttcactcctaaatctacatcaaggctttactaaatgttattgaatctcatctaaattatatggtgttgtttggtatacaaaataattcagccaatttgaatataataagtttgcgtgagaacgccacatcataagaggttcttttaatggatcattatccggaaaataattttttggcaaattaatatcaatacctttggctttatccctaaaatattcatttgctaatgtaatattatcatactcagagtgtccggtaacgaaaaattgacgtccgcttttagctgatactatgtaaacgccggcttcgtcagattttgataaaatttctagctctggaaccttaacaatatcagattctctggtttctgtatgtctggaatgaggggcataaaacttatcgtcaaatcctcttagaagtatcttatgttttttttcaggaagcacatagtgttcaaaaatgccaaaaagtttatccttcatttcatattttggtatcccataatggtaataaaggccggcttgagcgccccagcaaatatgaaaagttgatgtaacatttttcttcgaccattccatgatttcgcaaagctcatcccaataatctacttcttcgaaatccatctgctccacaggtgcgcctgtaattatcaaaccgtcaaattttttgtctttaaatttatcaaacgtatcataaaatgtttcaatatgactttttggtgtattttttgattcatagctttttgtgtgcataaaactaatattaatttgaagcggcgtatttccaagaaccctgagaagttgagtttcagtttctatttttttaggcatcaggtttaatattactatttcaagaggtcttatttcttgcttaagagctctagtctctgtcattacgaatatattctcactgttaagagttccggttgccggaagagtatctgtaacttttatcggcatatttctcaccaccatttattttgtattctcgattataacatataaatttatactagtaaagcaattttatattaataattttataaataagcagaatgattttataataagcagatttaaaatattatttactttattttataatacagatttattattctaacaaaatatataaaatattagatataatataaaaaactaaagagtaacatatagattttatattgaaatattttcagtttgtttttaatgtatatttcaagtctttatatttatataaatataattatgataatattgtcatgcgtattttttattgttaaatttaaataactatttgctaaatatgtattatgtaaaatttttaataacagttactttttatgtaataaaatatataattactattaaatttctacagataggtgtttgttatttaaaataaagaacagctaaataatatgatacggttttaattatatattaaacaaggtgaaacatgataattttctagtttgattttaaaatacatttatgataaaatatgttattattagactgtttaaatattaaattttaaggaggattaaaatatgaaaattgctgttttatatcaaaagaatagtccgcctgttatcaaaggaataaaaaaaccgatgaaggaaggcggatacagcgacagcggagcggatatttgctattgtcttcaaaaacataatattgatgttgtgactcctgttaaacatcctgatatgctaaaggattttgattgggtttttccggatactaaggaaggaatacagaatgcaatttctttgggtgcagacacaatatggttaaatacagttttgtataacaatcatccgattgaaagttttaacggtattaatattataggtcagcgtccgtcagatgtgtcaaaatatgatgataagtactatacaaataattatttgagaaatttgggatttccggtagtaaagggtgttttgcttaataaagagagtaaatataacggagattttccttgtgtgataaaacccgttcgcggcagaggaagccagggagttgtgaaatgctgttcagctgaagaactttacagtgctttaaaaaacctgattgatagtggaatctatggggatgaaatgattgttgagccgtttttagatggaaaagaaattactatttctgttttaccaaatggcacatgtttgccggttgttgaaagatttaaccattgcaatggtatagctccatataatggcgttgttgcggtttctaaaaatagccgggccattttaaaaaataatgaaagtttaaacaaaatttctaaagcctgttcaaaagctgttatttcaatggatttaaaagctttagtaagaattgactgcagggagaacatccatggagaatatgagatgtttgattttaatttgaaacctaatatgaccggagcggttagacctcacagattagaccaggatagtcttacaatgattgccgcctcggctgttggctggtcgttttatgatttactaaatgagttaatacaaacaaaatggcagttataattaatgttttaattttatacatataataaagtgtttttatacattttgtaaataacttgggtaaatcgtaaaataatataaatatcaaagaaaatattaaattgttaaattgaacaaattatttttaacttaaaaatatgaatttatgcagttatacaagattggataaaatcattaaatttcaaataaaaactagtataatttcaaaatttctacttgacttatcttgaaaactcttgtattatagtaatgacaactgtaaagtctcagttaattttttgcattaaaaggagcggtattatgtacatgaaagaggtagtagttcagaatcaggttggactccatgcgagaccggcaactttctttatacagaaggccaatgaatttaagtccagtatttgggttgagagtgaagatagaaaggttaacgcaaaaagtctgctgggtgttctttcgctcggtattactaaaggtcttacgatcaccataattgctgatggtccggatgaggaagacgctgttaataacttggttgatttgatttcttataattttgcataaaccgtttggttaaaatatactaaaatttgagtgaactgttttcacagtttactcttttttgatacataaaataaaatgtggggtgatattaatgacagaagatattatgtgtagaataaaagaaaaattaaaaactcttccaatgtcacctggcgtgtatttaatgaaggataaggacggaaaaataatttatgtcggaaaaagcaaggttcttaaaagcagggtcagctcatattttataaattcgaaaagccatactgtcaaaactgttaaaatggtgaatcaggtcaatgattttgactatatattaactgacagtgaggttgaggcgcttatacttgaatgtaacttaataaaaaagtatatgccgaaatataacatactcttaaaagatgataaacaatatccgtatattaaaataactgtaaaagaagattatccaaaaatatttgttacaagaagacttgtaaaagacggttcaaagtatttcggtccatatatgagcgccgccaatacaaaagaaactcttgacacgattaaaagaatttttaaaataagaacttgcaatagggttctgcccagggatataggaaaagacaggccatgtctttattatcagattggtcagtgcagcgctccgtgtgcaggaaaaatttctcaggaagaatattctgaaatgtttaataaaatttcagatgttttaagcggcaactattcaatgttagaaaaagcattgactgagaaaatgtacaaagcttcagataatttagaatacgaaaaggcggcaggttatagggacagaattaataatctaagagcacttgatgaaaagcagaaaataatatctacaaatgaggataaccgagatattattggcgtgtacagagagaataacgactgctgtgttcagattttttatatgcgaggcggaaaaatgcttggttccgagcactatgtttttgaaaatagtgacgatacattggaagaacttatttcgggatttataaaacaattttattttacggcaacaaatatacctaaagaaattttgattcccgtagagatagaagattctgaagaaatagagaaatggctatctgaaaagagcggacataaaatacgggttcatatgccaaaacgcggggataaagcgcatactattacaatggttaataaaaatgctgaggaatctttaaaagttcataaatttaaaagggacagggagcaaacaaatcaaaatgctgtattaaaaggactaatggaattgcttaagcttaaaagcacaccttttagaattgaaagttatgatatttctaatatttccggttctcaaagcgtaggtgtttgtgttgtgtataataatgcgcgtcctcataaatcttcatatagaaagtttaacataaaaacagtggagggagcaaatgactacgaaagtacaagagaggttatatttcgcaggatatctaaagcatatgaggaagaggacgcaataaaatcaggaactctgcaagatgataaagcaaaatttctgccgcttcctgatttaattttattagacggcggcaaagggcatgtccacgtaataaaagaactgtttgaaaccatgggagaagaaattccagtatatggtatggttaaggatgataaacacagaaccagagcgctaactgatgaaaatcaagaattttatattgataaagacagcgagttatttaagtttcttacgggtcttcaggaggaagtacataggtttgcgattactgcctttagaaaaaaacatgaaaaagccagcgttcacagtgaacttgatgatataaaaggagttggtccggcaaagagaaataagcttctattaagtttttcatctattaaaaaaattaagaatgctacagtcggagagttatccgctgttatagaccctcaaacagcaaggaatgtatataaatattttcatcctgaaaattaaaaataaataaaaggctaagtaattttgtaaaccgaacaagcatataaatcagtgaggagttgatttatatgtcttttgacttaagaagtattatcgtttacatattcggtctttttttattttttatgtgtattaagttattcaaaaaaccgctgatttggatttttaggctgatgattagctgtattattggtattggaatacttctgctgtttaatttaatatttcaaaaagccggttttactttggctctaaatccgtttaatgcggttacaataggtgtattaggggttccggggcttgttttgctatgcgtgttgtcatgtttagcatagcagcggtattgcgttaaaagtcacgtagattttcataacttattaagtccagcatttgttcaagagtatcgcattgattgataagatttctcagttttgctccgccgcacaaacctttaaaataccatgccatatgttttcttccctcaagaacgccgcggtgttcgcctttaaatttcactaaaagccggagatgtttttcggcaatgtcagaacgttcctcaagtgtaggcggagcaagttcatcaccggttttcagataatgaagcacagaactaaacaaccaagggtttccctgagctgctctgcctatcattataccgtcgcatccggtataatcaagcatatattttgcggatttgccgtcatgtacatctccgttgcctattaccggtatttttacagcttcttttactttttttattatttcaagattcgctttgccggaataaaattgtgctctggttcttccgtgtattgttattgcgtcagcgccgttgttttctgctgtttttgcaaactcaactgcgtttatactgtcatcgtcccagcccatcctgaattttactgacataggacaattgacggattttcttactgcactgataattttacctgccagttcaggatttttcattaatgcactgccgtcaccgttatttacaatcttaggtgccggacaacccatattaatatctatcatgtctgccccgaattcaagtgagcgttcagcaatttctgacattacttcaggttcgtgcccaaaaatctgagcggcggtaggtttttcaaaattcaaaacttccagcaaaacctcagtccttttatttttatacagaagcccctttccggataccatttccgtatacatcaaagcaggaccgaacggctttgttatgagcctaaacgctttgtccgtcactccggccattggtgcaagtattatattgtttttaagatttaaagttcctattttcatatcgtttctccttgcggatattatacactatatattgtgatttgccaatatgaaatattgacataaagagacattattgatataatacccgggttagattttaacaattatgaagaatgaaatttaagggttgattattttgaaaacaaaaagaatagtaataaaggttggaacttctacgcttacccatgaaagcggaaaattaaatctggagagaatagagaagttggttcgtgttatctcaaatattaaaaatatgggtcatgaagtaatattggtctcaagcggcgctattggcgtcggagcagggaaagtaggtttgaaagagaagcctgattcagtcagaatgaaacaagccctggctgctataggtcaggcaagtttggtttctatttatgataaaatctttaaagaatacggatacagcaccggtcaggttcttttaacaaagtttatccttgatgaggaaactagatataacagcgctcgcagggcttttgacgctatgatttcatttggcgttgttcctatagtaaatgagaacgatgtgatatctacttatgagatagagtttggcgacaatgatacgttatcagctacagtagccgaacttgtcagagccgacctcttaataattctttcagatattgacggattttacgacagcgacccgaggaaaaataaagatgcaaaaattattcctgtagtgtctgaaatatctgaggagattatgtcgtgtgcaggagcggaaggttccagccgaggaacaggcggtatgaaaacaaaattaagggctgctaagtttgtgaatgataatggtatagatatggttttattaaatggaaatgttcctgaaaagatctatagagttttagaaggcgagaatatcggaacattatttaaacacaaagaaaaataattacaaataatatattggaactttttccatttttttacgtctaaatactataatatctatcgggaggtatttttgtgcgtaaaaaaatatatggtttgttttttccaaaacttattattgctttgctggtactggctgttatagcggtttggagcagtgatttgttttctgataataaatataatgatgtatgtgcagataatgagtattatgggcagtattctttgtcatatatgccaatttatcttgacggatatgaaattcaagggtattactgcgatgaaaaagtcttaatttctattgatgatatgactagatatggttttgaattaaattatgactcagagaaaaatgtgcttaatttaaggtcaacatctgaaattgctgtatatccatataaacaatcaatagctgtttcaaattacatagctgagccgtccagttttgatgtgcggataaatggtataaaaatatacgcttattgtcttgatggatatgcgtgtgtcagcgttgatgatttggtttatttaagtgatgaatataatatacaaaccggttggtctgattacaatatgtgcggcggttatgacgcttctgccaacgcttttaatataaactgttttaggtttaaggttaatgattgggctgaactgcttgctcaaatggaaagcaaagtaaatcagactgagatagacatatatactgaaggaaagcctgaagaagcaacatattacggagctaagctggaacccagaagcggtatatatgcaggtatagtcagcgacggcaacggaaatcccgaagacggttcgccggaaacatttcatcatgattttggagtgtattcatcatatttagaatttgatgattttcaaacccagcttaataagcccagcagttatattgtcccggagaaaaactgtataagccaggttccctggaatgttgtggatattaatttggttttggacagtgcaaacgatgaatacattaaagaaacattagataatatggctaaatataataagccgacaataatacgttttggcgcggaaatgaatataggatacctgggggattctcctacagcatatataaaagcttttagaaagattgcggatatggtacatgagtatccaaatttcgctgttatgtggtcgccgaatgacaatggttccctggacagaccgtttggatatttttatccaggagatgaatatgtagattggataggagtgtcatcatttttaaagaaagattttttaaacagcctggctgttgaagatggttctgaggtatgtactacgcgcgaatctcagatatactttaccttaggtgattttggctatacaacgaattcacttaaatatataactgattttatgaaagaaaataatattaataagccgcttgccataagcgagggcggtgttgtctctcgaatctcttacagtgatgaaaacatagatttgtggggagaaaagcgggtcagaaatatgtattggtatgcagctatgagattcccgcagctaaaaagtattgtatattttaatcaagatatgaaatcagaagttataggatttgacctttcatttaaacctaactacacgcaaattatagaagaagctattacaaccggtccatatctgctgtcatataatgaaactcctaaatatacatttgttaaagcggacggcggaagaacttataacagcgattatattccgatatacggatatgtctatcagccggaacagtatacgaattatgtagagtattatatagacggaaatcttttggatacgaaaacagaaattccttataaaacatatttgaataaaaattctgtttctgacggaactcatactttaactataactgctcacggtgcagcgtcagaaatatcaaaatcttatacattagtaaaagaagcagggaatatagtaatctattaataattataaaaaaaataactcgttgtgttaaggcaacgggttatttttaatgtataagatttaaattaattttacttaaaccgaagtgttattaataagctttattatttatatttgtgacagttcataaagtttgtcaaaaacaatttcgcggtcccagatttttaccgctttttctatattattaattccgtttctgtttttcgccagcggaagttttgaagtagattttgcgttatgaaggagttcctgtccttttttattaaaattcaatattttaatatattgaggtggtgttacagcgtcttcttttgttattcccaaaaatatattcattatgattcgtctaatcctgctgtgtgcataacgttttgattttatattatcacataattcagaaaaggtttttgaagaaaatgctgactttttaattttattctctaatccctcagagacgtcaggagtattccgaatcgcattgatgtccgattttattatatttgatattatagcagtatctagcttttcaatcctgtggagagatgaatttttgtataatgaaatacagttttcaggaaccgctttaatcatatttgagccatgaatatttaatatattccttatagcgcttgcgctggctatctcgccatgaataacggtatcattatgctccgactcatatctctttattaaaataggttcaatattactgtttaatttgtataatgctttgacatattcaatagcaagaatattattgggttcacttaaaatattagcatagctgtttcctaaaattctgtacacagcgttttttcttgctaaaaaaaacgactttcctgactgaagttctgattttagaatcattttaaattcttttggttcagtgtatagcaatgaagcagttttttgtatttctgttatttcagaatgttcggcgccgaaagctatgctgtcaataagccccaaagaatgtaaaatataaattgaattaaacgcaaaaatttcagccgactgcattgaatgaacagcaggcagttctaacactagatccattcctgattgaacagccgccaaggcacggacagatttatcatacacagccacatcgccgcgctgtgtatagtttccgctcattataccgacaacagcgtcaaaacctaaattttgttttatatagtcaatctgatatttatgaccattgtgaaatgggttatattcacacacgattccgcagactttcaattattattcctccaacataaaagagcaatttttataaaatataaactaaataaaattatatcctactaatgtttatatgtcaatataggctattttatttcagaaaagctgttttatttaaaattttaatgtaataatttaaaaaactggttataagtattaaaaaaactatggtttatagcaaaattttttatatttaatacttgaaatcgactttttataggtgtataatgtaacagctgagtatcaaaaattaccatataaactggaatttttggcttattatgattttgtaaaataattatcaatatacacataggaaatgaggtttaacaaatgtcaaaattcatggacaagattaaggaaactgccagggcggataagaagactattgttcttgctgagggagaggaacgcagaacgattgacgcagcagcccaaattttaaaagaaggatatgccaatatcatacttttaggcaatgagtctaaaataaaaagtatggcggatggacttgatatttctgaggcaactattattgaccctgacacaagcgaacttacagaagagcttggaaacggactttatgagcttagaaagaaaaagggtatgctgccggctcaggctgctgagaaagtaaaagacgtattgtattttggctgtatgctggttaaaacaggcagagcagacggtatggttgccggcgctgttcacgctacagccgacgtaatgagatcgtcattgcagacaattaagactgctcctgacactaaagttgtttcagcatttttcttaatgatggttcctgattgtgaatatggaaataatggaacatttgtattttctgactgcggacttaacgaatatccggattcagaaaagctggctgaaatagctatttcttcttcaaagtcctataagagtcttgtaggcggagagccaaaggttgctatgctttcatattcaacttacggaagcgctaaatcagaacaggttgatttggttaagaacgcagctgataaggctaaagaattagctcctgacttaaagcttgacggagaacttcagcttgacgcggctatcgttccaagcgttgcttctttgaaagctcctgacagcgatgttgcaggtcaggcaaacgttttgattttcccgaatcttgacgccggaaacattggctataagctggttcagcgtttggcaaaagctgaagcatacggaccaatgactcagggaatggcaaaaccggtaaacgacttatcaagaggctgcagtgcagaagatattgccggagttgttgctattacatgtgtacaggctcaaaatcaggattaattatattatcggagggtgtaaaataaatgaaagttttagttattaacgcaggtagttcatcacttaaatatcagcttatcgaaacagaatcggaaaaagttttggctaaaggcttgtgcgaaagaattggtcttgaaggttcaaagcttacacatagccctgagggaaaagaaaaatatgttgaagaaaaaccgatgccaacccacaagactgctgttcaaatggttttggacgcacttgttgatgaagagcatggagttattgcagacataaatgatatttccgctgttggtcacagagttctccatggcggacagtattacagcgactcagttgttgttaacgatgatgttaaaaaggtaatcaaagattgtttcccattgggacctcttcataatccggcaaaccttattggtattgaggcatgtgaggacgctatggccggaactcctcaggttgcggtttttgatacagcatttgggcagagtatggagcctaaggcgtatatgtatgctataccatataaatattacgagaagtatagtattagaaaatatggtttccacggtacaagtcataagtttgtttccggcagagcaattaaattcggggaattagataacagcaactgcaaagtaattgtgtgtcatttgggcaatggcgccagtatttctgcttctgtcggcggaaagtgtgttgacacaagcatgggtcttactcctcttgaaggtttgataatgggaaccagaagcggtgacattgacccggctgttgtacagtatattgccaataatgaaaatttgtcggttgatgaagttttgaatatattgaataaggagtccggtgttttaggtatctccggcgtatcgagcgactttcgcgatttgtcagccgcagcacaggaaggcaataaaagagcacagatagctcttgacgcgtttatttaccgcgttgcaaaatatgttggttcatatgttgcagctatgaacggtgttgacgcaatagcgtttaccggaggaataggtgagaacgactgtgatactagatataaaatttgtcagtatttaggatatcttggcataaagattgatgaggaaaagaataaggagagaggtaaggaaatctacatttcaactcctgattcaaacgtaaaagttatggttattcctacaaatgaagagcttgcaatcgcacgtgagactttggatttagtaaaataattcacttattggttaaggctgtctcgattgagacagccttgcttttaaaaatgaggttgatattatatggctttaaactattatgaaaatatgactgatgaagaaatagtgtctttagcggaaaaggataggtctgctgaggagttcttgctgaataagtataaaaacctggtcaagtctagagctaaaatgtattttttggcgggtggagataacgatgatttgatgcaggagggcatgataggcttatttaaggctatacacgattataattcggataagcaggcttcgttttatagttttgctgaactttgcgtcaaacgtcaaattttcactgctataaagacggcagcaaggcagaaacatcagccccttaatacgtatatatctttaaataaacctgtgtatgaggacgtctctgagagaactttagttgaaaccttggcagaaagggaatctgtggaccctgaaaagctttatataatgcatgaaaaattaaaagatatagagaaagaaatagatgaaaagttgagtgatttagaaaaaagagtgttgattttacatcttcagggtatgtcgtatcaggaaatttctgaaattattaataagcctacaaaatcaattgataatgcacttcaaagaattaaaaaaaagctggatgaaaagtaaaaaaattgtagagcaaaatatctgtagtaattttcaaaaatttatttataaattataatttttttgaaattttacacttttattttattatacttttctttaaaatttaaataaatttgtgttaagaaatattattatccacttttagaatatcccgtaaaatcagttatcaacagagttattcacattatccaccgtttttatatagtaaaaataactaaaatcactgatttttaaaagttatccacaatttgcgtttttacgggcaagtccctcacttaaataaaaaattttgtttaaatttatttttatattttatattcacaattatttaaattattgaaaaatacagatatattgttctttttaatgttgttttttgtctactgagaaagatattattttaaattaaaccagttttttcataaaataccttgaactttgcaagactttaatatataatatcttaagttatattttttaagttaattatgttaattattatttttatatagaggagtatagtatgaatatttataagttatctgaactgacatctgaaaagagagaattcataatgaaacgcgctgaatctgacatttctgaacaaatgaagattgctaaagaagtttcggatgatattagaaagcgcggggatgaagcagttttagaatataccgctaaatttgaccatgtaactcttagcgcggatgaaatgaaggtaaaacctgaagagattgaggcaggttatgagcgcttggatgcagaaactagagaagcaattgaatatgccgttaaaaatattagaaattttcattcaaagcaaatgcctgaagagatgtggtttactgaagtggataagggtcttttggttggtgaaaaaactactcctatcgtagatgtttgtctttatgttccgcggggcaagggaagcttcccgtctgttttatgtatgttggctacacctgctgttgttgccggcgtagaaaaaattgtagttgttacaccgcctaatgaggaaggaaatgttgatgacgcaattcttgcggccgctaaaataatcggcgttagtgaaatatataaggtcggaggaattcaggcagtcgcttctgttgcatacggaaccgaaactattccaaaatgccataagataataggacccggaaacgcttatgctacagcagcaaaaagagttttgtccaactatattgattcaggtttgccggcaggaccaagcgaatgtataatacttgctgatgaaaacgccgaccctgaaaaggtggctttggattggatgattgaagcagagcatggaccggattccgctgcacttttagttactaattgtgaagagttggtttataaagcggctgaaattgttgaaagacagctcgaaaaaatatctgataaaagacgtgagtttgtaactacgaatttcaatacatacggcggagctattataactgaaagtcttgaagagagtattgattttgtaaatgactatgcaccggaacatatggaagttatgacaaaggaaccgtttgtggttcttcccaaaataaaaaatgcgggagaaattctgctgggagattatactccggtcacattgtgtaattttgttttaggtccgaatgctattttgcctaccgggcagtttgctaaaacctattcaagcgtttctgttatggacttcttaaagcgttcttcggttggttacgcaagccgcgacggctttgaaatggttagggattatgcctataagattgcaactgtagagggctttgatacccacgctttagcagttaaagagagaaaataaaattgagcgtacgcgaggattttactatgaaaaatagaattactgtaaagagaaaaactactgaaacttcaattgaggtagtaatagaaaaaggtgagctaaagcctgactatagaaaatatattaaaacgccgctgccatttttgaatcatatgattgagcatattgcgtggcgcgcatcacttaatatcagcattgatatggattttgacgaatttgaactttgccatttggtgtgtgaagatgttggaatgacgcttggaaaagctgtcggggaatatataaatataaattctccatcaggttatggttttgcgacggggattattgatgaagcgtgtgcagatgcggcaatttcatttgaggacaggtcgcagcttacgtttcaaaaatcaataaattattgtgagaatgttgaagggatgccaagcgaagagcttattacttttcttgaaggatttgctcagggagcaagatgtactctgtttattgatttaaaatccggtcagaacggccatcatatttgggaagcagttttcagaggtgttggaatcgctctcggtcaagctttgtcatttgattcttccagagaagggttaacctccggcgttgcaggaaaggtagaatatgaagtttcagccgaataattttgacaagataatatttgatatggatggggttgtaacaagcgaatatatttattgggatgcggcggctttaacggtatatgagcttttatacagccataaattctatggattgagtgagatagaccataattggtgttacggcaactttaaagagcttcacaaaataattttttgcggagataaaactataaaagccgtgaaagcattaggagtaaatacaaattgggatttagcttatatagttttttgtgtttcaaaatatctggagccggatttgacagaattcaacgaatggcattttgagtcagttcgtatgtttattgaaaatatcacggttcaggctcctgaggtctacaatctcgtgggtgaacttgctgctgtatctttaaatagtgagttttccgattttaagcgaggcaggagcaagttatgggatgatgttattaactgttttcaattatggtttttaggaggggaatctgtccccggtcttaatactatggaaaaacctttggtagatttgaatgatttaaaaaagacttttttagatttaaagagcaagggaattagtttggggataggaaccgggcgtccaaaagatgaaattttgtttcctctgaaaaagtggggattaatggaattcttttctgacaatatgattgttacatatgacgacgtattaaaagcggaagaagattttaaacccgaaactcctttgtcaaaaccgaacccgtttgtgtttttaaaagcggcttttagaaatgaactggatgatgagaaattaatatccggtaattatgataaagagagatgtttaaaaattgctgtagttggagacgcgccaagcgatttgatggcggcaaaatcagcaggtatggtttttgtaggtgttcttaccggtattgataggaaatctgctaatgaatattttttaagccataatgctgattatatatttgaagatgtaacacaacttattgacgattaaatatttttgtggggattattatgcaaataaaaattgaaacaccattaacaagtgaaaaggtaaaatctttaaaaagcggagataccgttctcataaccggagaaatttatacagccagagacgcggctcataaaagaatgattgacgccttgaaaagcggagaaaaactcccttttgaaatagaaaataaaataatttattatgctggtccaacgcctgcaaaaccaggtcaggttattggttcgtgcggtcctactacaagcggaagaatggacgcgtatgctcctgaattgataaaattaggtcttaccgggatgataggcaagggtgaaaggtcagacgatgttgttaatgcaatgaaagagtatggagccgtatatttcggagctataggcggtgccggcgctttaatagcgaaaagtattaaagctgcagagataatagcttatgaagaccttgggactgaggctgtcagaaaacttactgtagagaactttcctgctattgttattatagattctaatggtaaaaatttatatcatgatagataataaaaaataccggtatgaaaaccggtatttttttaatttttatcaaatattttattcatcatatttttaatattttcttttcttaaagatgtttcatctctgtcaattgttatattaattacatcgccttcacgggcttcgggcggaatcaattcaaccggcatatcggcaaaccctgaaccttcatcaaattctacaactgcaaagtttccttcaaatctatcaataattattttcatttaaaatatctcctttaatattctctatatacattattgccatcgcttgcaaaaattattgttccgtcagtatcagttctgaatgtctttatacccatattgtttaaagtatttaaagtttgttctgtaggatgaccgtatttattatctgcgccgcaggatataaccgcaaacgtcggatttaccttgcttagaaacgcttgctgactggatgaagaagaaccatgatgtccaatcttaatgacgttagcccaaagagattcaatgttatagtttgataatatttcattttcagattcaatctctgcgtcacccataaacaaaaacgctgtgtttccaaatgctattcttattacggcagaataattgtttaaatctttatattcgttactgcttggagccagtataaaagctgacattgtattttcattgaatattgtaactccggatttagcttcaactacatttatatttttctctattatagtgcttaagaattgctcatatgttttggtagtggttacggcgtttggcatatataatgttccgatttcaaaattgttcagaacttcattcataccaccaatatggtctgcgtgaggatgagttgcaaccaaataatcaattttattatatcctaaattttttataaaactgcatatttcttcgccgtatttagaagttgacgcgtcaatcagcattgtttttccgttaggaagcaaaacaaattcgctgtcaccttgaccaatatttaaataatacacttttacaaacgaattgccaagcgcaacatcgcttggcaactcttcattgttattattgactgaatccacatatgctgtattatcattaggaaaagctctgtatagtattgcagcaacttcgcatcgtattatagggtctccgccttgaaatgttccttcttgagtacctgttatataaccttgtttaacagcttctgctatataaggacgatcttgtttaggaatggtattataatcgtaaaacacatctgataacaagctgtcatcaacaggataatattcggaaaggtcataattcataactttcattaaagcaactgttacgtcctcacgggtagcattatcccaaggcttgaaatacagtcttgaatctcccggagatgtgctttggtatccaggcatttgctgagttattgaattgatataaggaaaagaccagtcattaacatcaacgtctgcatatgggcttgtgcgttttgtggaaagtttaagtccggacgcattaacaagcattttggcatattcacatctggcaacatagttctgaggtaaaaaagttccgtctccataaccggaaataattccgcgtgattcaagatttgttatgtaaggcgccgcccaaaagtcatcaggcacatcataaaacgatgttgcatatgctgagaaactgccgaaacacataagtaacgtcaaaactgcaatagtgacagaccatgtaactctttttcttaacattacaaattctcctttttcgtttaacaatataaatattatctaaatacaatttcaagcaaggattatatcattagtcttattatttgtcaagttttacggaaaaatggagttataataagactattaaatattttatattataatatgactgattcaacaagacaaaagttcctgtatcagccaaaattatttattgctgttgcaaaaaataacatatataaacaaagtaaagtgttataaaataaaaaatttaagtttgatattttttgttttatactttggttatagataaaagtatattgtttagaaacaaattaatttttatttgtctttattctcattattttatataagaataaaattaatttccgtacccaatacttatctcgttaaatatgtgtaggtaatcatcaatactttttttgtttttttcttctgatttgacatccaaaactattttaccttcatgcatcattatagttctgtctccgtatgtcacagcgtgtttaagattatgagtaaccataagagtagtaatatttttttcatctactactttttgcgtaagattcataatagtgtcgcttgatttggggtcaagcgccgctgtatgttcgtccaaaagcagtaaatcaggttttgataatgttgccataatcattgacagagcttgtctctgacctcctgaaagagaacctgccaatgtatccaatctgttctcaagtcccatacccaataattcaagctgttctttataatatttttcgcgcttatgatttaaaccccaagataacccaaatgattttcctttgttatcagctattgacagattttctaaaattgtcatagaagagcaggtgcccatagatggattttgaaaaactctgcttaaatatttggcacgctggtaatttttttgtttaactatatttttaccgttaattattatttgtcctgaatccgctttaatatcaccggaaataagattcagtatagttgttttcccagaaccgttagaaccgattatacatacaaattcacctctgggaacgctgaggttaaagtcattaaatattactttttcatcaattgttccccggttaaatgtttttgaaatattttttatttcaagcatcaggtctcactccaattcctttgtcacgtttaaataagatattatttataaccaaaataaatataaataggactgtaataaccaggttggtatctgttgccatcaggcctgaagcaatagcggcgtatgttaaagtcttatatattatcattcctataataacgctggtcgtgatttttaaaaatctcattttcttaaaaatagttgctcctataattactgcagctaatcccataactaccgttcctgtgccgcctccaacagaaaactgtcttgtatattggcagtttacggctcctgccagtgcaaccagaccgtttgaaatagccagtccaagaatttttatgtttcccggatttttaccgagggtaacaacaagactttcgttatcaccaacgcttcttaaaagaaatcctgattttgttttgagataccagtcaagaagaagttttgatactatagttataaaaaacataataataagcttgctgtataagttaataggggctggaagcatacttgaaaaactggaaaatatagtattgtcagtcatacttataaaaactgttgatgagccggctattctgtaattaatggaatataaggcggtcatagttaatataccgcacagcagatttttaattttaagccctacatttaaaaatcctgtaaatgctcctgctgcacagcctgataaaaatgctaatattaaacttagccacggatctattcctgcggcggaaaccgttatacataaagcggctccaagcggaaaagtaccgtcaacagaaaggtcaggaaaatctaagattttatagcttatatatactccaacagccatgatgccataaataaaaccttgctcaagtatgcttgtaactataccaaccatatatttatctcctatttacttttttcagcgttttccaaaatatcatcgggaattactatattcaaatttgctgctgtttcttcattaactgcaatttcactttgattaattacctcatatggtattgtgctgatttcttcaccttttaatattttagaggccataattccggctttttttccgagttctatataatcaacacctgctgaggcgagacatccgcctgtcacttgtctgctttcggaaccaaatatcggtatattggcggcattagccttttcaagcataacagggagattatttacaacgatgttgtctgttagattagatatgcagtcagcttgtccaagaacaatatctatcgcctgagaaatttctgatgcgttgctgatacctttttctataatctcaaaaccaaattcactggctttttctttataaatgttaagagtgctttgagagtttgactcatttgttgtatatattattcctattttttttgcgtcaggcagaatttttcttattaattcaagctgcttttctacaggcggctggtctgatactcctgtaataccatccataggttctgtttcgcttttagctaaatttgctttaacgggatcagatacagcaccgaaaaccaccggtattttattttcataacaataattatatgctgtcattgccgatggagtagctataccgaaaactaggttaacttttgagtttacaaaattttgaactatttgtgtgtttaatgaactgtcaccctgagcggatttctgaataatttctaagttgtcgccggacacaaaaccttcatttgcaagtccttctataaagccggttttgcagtcttctaatgttgtatggtcagcatattgtactatccctattttatatttatctgattgttgtttttttaaatcattgccgccgaaatttgagcatccgtttataaaaagtatagatataataagtgcagataaaataaacttttttgaattcataagctgctcctctcaaaagttaagtattaaatttttccataataaaaaacaccttatttattaagtattccaattacataaaaatacattcttaaattttatatttaaaattttatggctaaaaacttttattgtttatttgattttaaaaatatatttaattatttttttacgtataaaaatattttgttttttggagtatttataaatatttattaaatgtataattaaatcaattttaaagtgtttatgtcacattttatagataaaatatatgtgtatgtattttttatttattttctacaagaagaatatattttttttgtcaacattgcttattgataaaaataaataactgagttattataagtttgtagatttcataatatatgcagcctccccgctgcacaaagactgtgtcaaattggcgcggtctttgttttatttatattttaaatattgattgattttatataatatagatgttataatattttttaatgcattaattttttattaaaaagagaaaggagttatggcatattagtatgccatatgtttcaggaatgagattttatgaaatagttttaattgctgttggtcttgctatggttgcttttgcggtttctgtctgtaaagggcttaaaatgagtaaagttgactataaatatacttttatcatagcattattttttggagtatttcaagctgcaatgcctattataggctggtttgccggaaaacagtttgaggcttacataaccagtgtcgatcattggattgcttttatattgctggcgtttataggcggtaaaatgatatacgaagcaataaaaaatgaaggtgaagggtactgtgatttaaaatacgattttaaagaaattacattgcttgcttttgccacaagtattgacgcgctggccgtaggaatttcatttgcttttttgcaggttgaaatatggtcggcggcttcatatataggtgttattacatttattctttcaattattggagtcttagttggaaatcggtttggagttaagtttaaatcgaaagctgagtttgcaggaggaataattttagttttgataggtataaagatacttttagaaggtttaggaatattgagtttttaatttaaaatagatcggtggtaatgatgtgaaggaacaattgtatacaattccggtgaatgaagcgattgataaaaatgaagaatgtttattctgtactttaaataaaaaggtggaagaagatatattgaattatattttgggaccttcatatatggaagaagatattaggtctgaaaccgacaaaattggtttttgtaaaaagcattattcgcaaatgtataaagcgcagaatcgtttaggtgtagctttgattttaagtacgcatatgaaaaatatcagacaaaatttgaatgatatttttaaggatgaattaactgaaatcaatcacactattaaaaaaaatctgtttagaaaaaatgaggaacaaacaaaatctgttgaatacatttctgaaatagaaaattcttgttacgcttgtaaaagaatggaatctcgaatgaatagttatattgatacatttttttatctgtggaagaaggaagatgattttagggaaaaaattttaaactctaaagggttttgtcttgaacattttaatatgattattaaagagggaaaaaagaaactaagttcagataaatataaagattttttgaccgtgttggttccgcttgaacttaaaaatttggatttgcttcaagaagatatagattggtttatacaaaagtttgattatcgctttaaagatgaaccatggaaaaattcaaaagatgcacttcaaagaacaatattaaaagtttcttcggagaatgttgaggaatagtccggattaaaatcgtgaggaaatacaatggatattatagatataattataaagcagaaaaatggtattgatctttcagattcagaaattgaatacttgattaacggttatacacaagggataatacctgattatcaaatgtctgcttatttaatggccttgtgttttaccggggcaaatgaaaaagtaatatcaaagatgactatgtgtatggctaattcgggagatatacttaatctttccggtatcagcggaacagtagtggacaagcattcaaccggaggagtaggagacaaaacaaccttagtagtaggaccgtgcgtggcagcgtgcggcggcaaggtggcaaaaatgtctggacgtggtcttggatatacgggtggaacaatagataagctagaatcaatcaaaaattttaatacacaaataccagttgaacgttttatagatataattaatgaaattggtatttctatcgttggtcagttgaaaaatcttgcccctgccgataaaaaaatatattcattgcgtgatgttacaggaactgttgattgtattccgctaatagcgtctagtataatgagcaagaaaattgcatccggtgcaaatgctatagtattagatgtaaaatatggcagcggtgcgtttatgaaaacgtataaaaacgcaaaagagcttgctgaaactatgataaaaataggaaatcagaatggtaaaaaggttaaagcactgcttacagatatgaatgagcctataggaaatacagttggaaattcacttgaagtgatagaagctatacagactctaaaagggaatggaccaaaagattttttagaactttgtatagatatttcaagtgtaatgcttcagcttgaatttgttgataaatcggtagatgagtgcagaaagatggcgctggacagtattgaaaatggaacggcactgaataaattcagagagttggtatttttgcaaaacggagatgtagaatgtattgatgatacaaataaatttccaaaatcaaaatattctttagaagtaaaagctaatatgtcaggtcaaataacaaagatggattctgaaaagattggtaaaactgcatgtttgttaggagcagggagacaaagcttgaatgataaaataaatcattcagcaggaatttttataaataaaaagactgatagttatatttcaaagagtgacgtattagctgttctatacacggataaaaaagaaattttagattttacaaaagaatattatttagacagcttaacgatagaatgattatattttgtgtaaattggatcggaggtaatattggtgagagttgtaaatgcgagtcagatgaaacagatagaaaaaaacgccaacgatatgggaataacatattatcaaatgatggaaaatgcgggaatgtgcgttgctgattttgtacgtaaaaatataaaagattttgaaacgaaaataatattgattctaacaggaaccggaaataatggcggagacggctttgtcgctgcaagaataataaaaaagtttggtggaaacccactaattatgatggttgacggacctcctaaaactatagatgctatcaaaaactttaataaagctaaagattgcggaatagaaataataacttttgaaaaagataaaagtattcccataatttggggaagtgacgcaattattgatgccgtttatggaacaggatttcacggtgaattaaatgataatattaaatcattattttctgcaatttctgacagcgatgctataaaatttgcaatagatattccgagtggagtagatgattcgggtgaaatttctgacggcgctttcaaagctgattttacaatagcattagatagtttgaaaaatgctcatatgaaagaaaatacttttgaaaactgtggaagagtagtatgcgctgacattggaataccggaagaatgccataaaatataattttataaataattaattatatatttaaacgtaataaagtcagttttaattattaaaactctgttgcatataaattattttttataaataatgttaaagaaaaataagattgaattaattataaaatttggcgattattctttaataaaataattaattcgtgtgataaaaacgctgcgctttaaaaaagcgtgacgttttttctatttataaataaaaattttgttttcaatatataatcagtaacatttgtatactaaaaaatgaataaaagtataataaaaatattttttaaatgatattaaacgttgtatgaaagatcaatatattatttgaacagcatataaatattataaaatatcaattcgtttgactttaaatatatatagttttaattcttgtaattttttataagttacttttaaaatattttaaatagttttaatgtaatctataagttgttaggagtattttatagcattcttgacttttattgctttaattaatataatattataatgaaataaattaaattgaaaaggaacttaaagatgaataaaagtttttatgaaaaaaccagtcctgaaaacgcaaacattaattccaaaagaattataaattttataaataggttagaaaaagaagaagtagatatgcacagcatattgataatgaggggaaataagctgatttgtgaagcctattataatccatttaattcaaatactcttcatagaatgttttctgtcaccaaaagtgtggtatcaatggctattggtgccctagccgaagacggggttatagatttagacgcttcaataactaaatattttccggaatatgaacctgaagatggattttatccttatcttattgaaacaacaattcgcgatatgctttctatgacaacgcctcataacggaacaacatttgataaacgcagtaaaaataattggacggaatcatattttacaaagaagcctactcataggccgggaactattttttcttatgatacatccgcctcacatgtaatggcagctttggtagaaaagttaacaggtttgtctttgcttgattatctgagaacaaaaggtttgtcaaaagttggtttttctaatgaatcttattgtatttcggatgggtgtggtgtaagtcaaggaggatcaggtatgatggcgtatcctaaggatttactgcttttagctaaacttgcaattgattatggaaagattgataatattcaaattttacctgaaaaatatttaagagaagcaacaagttataaggttgcgaattttgtaaagggaagttttttagctgaaatgcaaggatacggatatcaattttggatgaccaaaaataatgggttcatgatgtatggaatggcaggacagttggcattatgttttccggataaagatttaatacttgtcacaacggctgacacaaccgatagaaaaggcggcgtacaacaaataatagacgcattttttgatgaggtgtattcatatatagacgaggaaaacgagtttgataaagattcatatttaaaactttgtgagatatctgataattgcagtctcaaacctcttaaaaataatatttcagttgagcttgataagacatatgagttttttgatgataatagtttagaaataacaaatgttagaattattaccagcgtcagcggcggaaaaattatattagataatacttatggcagtcagattataaaatttggatttaattcatttttggacgggaatttcagccattatgattgcccatatattgcttcaggatgctggacagataaaaatactcttgttgttaaggctaatcttatcggagaatgtataggaaaagttataatgcagttttcatttaaaaaggatggagctgttacaatattttccagaaaaactgaagaaatattatttggtgaatattccggttttgctcaatcaaattagattaataattcatactgtgttatttttatatttgtatattgttaattgacatgaatattaatatgtaatataattacattatgatacttttaaaaaggagctaattatgaaaaaaatattttgtaaagtatttttttgttttgttattattgttttaagttcaatatttttgatgagttgtggaaaaagtgccacaaatccggataaaataacagacaataatatttcagaaaataccggtaatattgaaaaatatgatagtgcaataaatgacgagagcaatactgttcttaaaaatgatgttgttgctttggtaaacggtgaagaacttaaagctaaagattttggatattatatttataacaatgctgttatacaaatgtataaagaggacagtaataccacggaggatgttacaacatttgattggtctaaaacaaataaagatgggaaagcattacgtgatgtagttgttgagaacgcaatagaggatgcgataaacgatgttgtgttcagacagtcggctgagaattctgggtttctcatttccggtgctgaaaaagaagccgacgagcttgtaaatggttcaattgaacgtcagggagaagaacaatttaaagtaagtgcgaatttagttggtgtgagcgatgctgaaacatataaaaaaatttatactaatatttctgtttttgaaggcgttgctgaagactttcagaataatcccgaaaaatatgttactgatatttccgtattatctaattatattggcaataaaggcgcctctgtacagcatgtgcttattttaaacgatacagatgacgcttctcaattggctgaggacgttctccaaaaagccaaaaacggtgaagactttgtggagcttatgaaacaatataatgatgataccagcgaaaaagaatccggatatacatttcctgagggagaaatggttccatcgtttgaaaccgctgctttttctttaaaaataggtgaaataagcgatatagttgaatctgattacggttttcatataataaagagaattgttggtgcatatgagcttcaaaatttttggaggtcggaagcagatgttcaaatatctccgaattctctgcaaatggttaatttttacgatgtaatggatatgattaaagaagctaaagcaaaaaatgttggttagataggttagaaaaatttatataaggatggtatattattatggaaaacaaatcaaataaagtgttggttgaaatggaaagcggagattcttttgttattgaactatatcctgagtttgcgccaaaaactgttgaaaattttaaaacacttgtatcaaaaaagttttataacggtttaacttttcatagggttatagatgggtttatggcacagggcggctgtccaatcggtaatggaacaggcggaagtgatgaaaacatagttggagaattcaagcagaatggttttgttgataacacattaagtcatacaagaggtgtagtttcaatggccaggtccatgagtcctaattcggccagcagtcaattctttatatgttataatgatgcgtcttttttagacggtcaatacgctgcatttggaaaagtagttgaaggaatggaaacagttgataagttccttgaaacagaaagagtaggtgcggagggcggaactccggttactcctatagttattaaaagtatgagttttgccgaataatattatataaggtgattttgtgaaaataaatgtacctgaagaagtaaaaactataataaaacgtttgaattctcaaggtttttcggcgtatgttgtaggcggatgtgtaagggattcaattcttaacagaaaaccacaggactgggatatttcaagctccgctaagcccgaacaagtaaaagaaattttttatgatatgggagttatagaaaccggaataaaacatggaacggtatctgtaattattaatcataatccgtatgaagttacaacatttagatgtgatggtgaatataaagataacagaagacctgatactgttacttttgtgtctgacattgatatagatttatccaggagagattttacaattaatgcgttggcttgcggctgtgaagatagcagtgaggttatagatctttttggtggaattgaagatataaaaaatggtatagttcgctgtgttggagaaccggaaaaaagattttctgaagatgctctgcgtatattgcgggctcttagatttgcttcggttttaggatttgatattgataacaaaacttcaatagctattcataagcaaagggacttgcttaaaaatatttccgttgaaagaataatgtctgaatttaaacagttagtttgtggtatcaatgcagtaagtataataagagaatttagagatgtaatcgaagtttttatacccgaaattactgctatgtttgaatttaatcagaatacgccgtatcattgctacgatgtttgggaacatactttgcactctgtcgaaatgatagaaccggaagttgatttaagatttacaatgctttttcatgatattggtaaaccaaaagtttattcagaagaaattttagaaaatggtaatactttgggtcatttttacgcacatgcaaaatattctgaggaaatagctgcaaagatattaaatcgtcttaaatcagataaccgtcttttgcatgatgtaagaaacttggtaagaatgcatggcgatcaaattccattatcaaaatcaggtataaaaagaaaacttaataaaataggcgtagagttatttagaaaattattgaaagtaaaacgcgccgatgttttggctcagtcgcctggattggctgatgaaagaataaaagctcttaaagatattgaaattttatttgatgaaataatatctgaagaagaatgttttaaaataaaagatttaaaaataaatggcaaagacctaattgaattaggtttttcaggttgtgaaatcggccaaactttaaaaattattttagatgcggtagtagatgggaaaatagataatgatagggataaaatctttgaatttataaaaatgatttaatccgttgttttataattttcatattttgacttgatttttatttatattttatatataatgtgtatcatgaaatttttataagatttatgtttagttgatagatacatttggttaggagttttatatatgaaaaaaaggtattcaattggtatagattatggttctatggcagggaagtctgtgttaattgatgttgatacaggtgacgagattgctgtgtcagtttttaactatccgcactcggttatgacggaatgtcttcctgatggcaaaacaaaactagaagatggctgggctctgcatgacccgcaggattatcttgacgtattggcctcaactataccagctttgcttaaagaaacggatattaatccggcagatgttattggaataggtgttgattttgcttcatcgaccgtcatgccggttaaagaagacggaactcccatatgttttatggaagagtataaatctgaacctcatgcttatgttaaactttggaagcatcatgcggctcaaaaatatgctgatagtttaaataaatacgctgaaaaaacaaatgaggactttttattaaaatacggcggaaaattttcttcagaatggttagttccaaaaatttggcaaatagcagaagaagcaccgcgcgtttatgatgaaatggacaagtttataggggctgctgattggatagtttggcagctaacagggattgaaccgataaatactcaaggaatagaaaacacgctgccgtcaaaagagtttttaaaatcacttaacccaaaacttgaggactttgttgatataaaatttaaacgcaaagtttcttcaattggtaaaaaggctggtgaactaaaccaatttgcagctggacttacaggtttgaagcaaggaacagcggttgcagtcggaaacattaatactcaggtatcacttccggccgtagggatagctgatccgtgcaaacttcttatgataatcggaaagtctgcttgtgatattgttttgggggaagaagaaaaaaatatttccggtatttactgcgccgataaaaatagtattattgacggatattatggctatgaggcaatacaatccggcgttggcgaacattttgattggtttgtaaaatccagtgtccccgaaagttattatagggaagcgaatgctcttgatatgaatattcatcaactgctgtgcactaaagcaagcaaacaaagacccggcgaaagcggattgcttgctttggattggtggaatggcagccgaagcgtattgatggataaagatttgtccggtgtaatgctcggattaaacttacaaaccagacccgaagaaatttatagagcattgcttgaagctactgcttatggtgctagaatgattttagatactattagagatgctggaatacctgttacagagctttatgctgccggtggagttgctcagaaagacgcgtttataatgcagatatatgctgatgtaatgaatatggacataaagattgccggttctgttcatacacctgctttgggttcagcaatgtcaggtgctgtcgctgccggaaaagaaaatggcggatatgacactattgaggaatgtgcgaaaatattaggaaaaacaaaagctcattattatcgtccaatacctgaaaatgttgagacttataatgagttatataaagaatataagaaacttcataattattacggtaaaggcggaaatgatgttatgaagcgtttaaaagatataaaaatggcattaaaaaattaaatgatttttaaaaagaggtaaatcaaaatgttagaagaactaaaacagaaagtctatgacgctaatatgatgcttccgaaatatggtttggttacattcacttggggtaatgtttctggaatagacagagagaaaagtttagtagttatcaaaccgtcaggtgttgattatgataagttaaagcctgagcatatggttgtggtagacttaaataccggcaggattattgacggaaatttaaaaccatcttctgatacagcaacccatcttgaattatataaagcttttaaaggaattggtggtgttgttcatactcattcgtcatatgctacttcgtgggcacaggcaggcagagcaatcagagcttacggtactacgcatgcagattatttttatggagatattccttgtactagagctctgactaagatggaaatagagaacgactatgaattaaataccggaaaagttattattgaaacatttgagaataaggatccggaagctattccgggggttttagtatttaatcatgctccattttcgtgggggttagatccagctgaagcggttcataatgctgtagtgttggaggaagtcgccaaaatggcttttcgctgcgagataataaaccatgatattactagaatgggtaaatatattttagacaagcattatcataggaaacatggcaaaagtgcctattacggacaaaataattaaactttacggagaattttatgggtaaatttattgtgtttgaaggtcttgacggctgcggcaagacttcacagattgatatactggcaagacggctaaaagaaaaaggtgaaaaagtctatgttacggctgagcctacaaattatgaaaccggattgtatttaagacgaattttgtcagaaagtttggaaaaagatatatatttgttggctgctttattcttagcggataggattgaacatataacgcatcccgaaaaaggtataaaaaagtatttagatgatggttacacagttatatgtgacagatattattattcatctctcgcttatcaggggaaaaatccaaattgtaattttgaatggatacttaatttgaaccttaactgtgaaagattgttaacccctgacatttgtttgtttcttgacgttaacccatcaacatgcaaagatagaattgatgtatccagggataatatagaactttatgagaaaagcgtggaagaaatgagtaacataagacgcggttttttggacgtgttttctacgctgaaaaaagattatagtcaaaatattatgattattgatgctaatggaagcattgatgatgttgcaaaggagatattaaaatatgtatagaagattattcacttctgagtctgtaacagagggacaccctgataaaatatctgatttaatttcagacgcgattttagatgcaatccttttaaaagatcctaatgcccgtgtggcagttgaagttactgtaacaaccggactggtgcttgttgttggagagattacgactaaaacttatgttgatataaagagtattgttcgtgaaacaattcgcgaggttggatatgaccgagctaagtatgggtttgattgtgatacctgcgctgtgcttgtggctattgacgagcagtccggtgatattgcacggggagttgatgacgacggagacggaattggcgctggggatcagggaatgatgtttggttttgcatgcgatgaaaccgatgaatatatgccaatgcctatatacttatcacataaattgacaagacaacttacaatggtaagaaaaaagaatgttttagattacttgagaccggacggaaaagcgcaggttactgtggaatataatgaggatggctctgtaaaaagagttgacactattgttgtttccacccagcacaatgaaactgttacacaaaagcagcttcaggatgatatcaaggaatttgtaatagaccctataatcggtgatgatctcaaggacgaagatactattatatatataaatcctaccggaagatttgttattggaggcccacagggcgacagcggacataccggaagaaaaataatagttgatacttatggaggatatgccagccacggaggaggagccttttcaggaaaagacccaacaaaagttgatagaagcgccgcatatgcagctagatatgtagctaaaaatgtggttgcagcaggtcttgcaaaagcatgtgaggtacaattagcatatgcgattggcgttagcaagcctgtgtctattagagttgacagccgaggtaccggtgttatcagtgaccaagaaatagaagaaaagattttaaaagtttttgatttaactccgggcggtattataagagatttgaacttaaagcgtccgatttacaagcagactgctgcttatggacatttcggacggaatgatttggacttgccgtgggagaagattgacaaagctgaagctttaaagaatgcataataatattacaaaggaagcgcattcatgttgcttccttattgtttatatattgataggagagtattatgtcttatgatgggtttgttacacatagtgttgttcatgaattaaacggtaaaattttaggcggtaaaattgataaaatataccagcctgaaagcgatgaaataataatttcggtcagaacatttgatgggaattaccgtttattattatcagccagcgcatcaaatgccagagtgcatttaacgacatcaaaacgcgaaaatccaatgaccccgcctatgctatgtatgctaatgagaaagcacttattaggcggcaaaattatcgggatagaacaggtagattttgatagaattattaaaattgatatagaatgttataatgaacttggcgatttaggagttaaatcaattatttctgaaataatgggcagacacagcaatataatttttattgatgaaaataataaaattttggatagtgcaaaacatgtggattttacagtgagtgcagttcgccaaatactgccgggatttgtttatcagcttcctccaaagcaggaaaagatgtcgcctaaggagttttctctgcttgattttactaatgattttactaaagaagataaggatattttactggataagtttctgttaggtaaaattatgggtttgagtccgcttattgcaagggaaatagtatatagattttcaaatcacacaaaaatcgcaaaaagagaaattgatgattataaatttgctgccacagtggatttatttcttaaagatattgtttcagataagtattcaccgtgtcttgttttagaaaaagatacaggaaagccgatgtatttttcatgtgtagaattaactcagtataaaaatgttgctgaaattaatatattagattcaatatctgagataattgataaatattatttaacaagggcttctcaggagagaatgaagcaaaaaagtgcaaatattttgaaattagtccacaacaatattgatagatgcactaaaaagcttgttatgcatcgtgaaaatttagaaaaagcgaaaaatagagataagtataaaatttgcggagatttattgacggcaaatatgtatagggtaaaatttggtatggatgaagtctgtgtggaaaattactatgataataactctgaattaaaaataaaacttgatccaaatatatctccttctcaaaatgctcagaaatactataaaaaatataataaagcgaaagtaacagaaaaatatgccgaagaacaaattgtaggtgctgaagaagaacttgagtatttagaaactgttcaggaaagtatattaaaggcagaaagccctagagacttatctgaaataaaagaagagttggcagaacaaggatatatctctaatactgcttcaaagaaaaagaagaaaactcaaaaatctatgcccatgaagtttatatcaagcgatggctatgagattttagtaggacggaataataagcaaaatgatgaagtcacaattcgtatgtcatattctactgatatttggcttcatacaaaaaatattccgggttcgcatactttaattagaacaaatggttcaggcgaagcaccggatagtacaatacttgaagctgctcagctagcggcatattatagtaaagctaaaaattcggctcaggttcctgtagattatacacaaataaagaatgtaaaaaaaccaaacggtgctaaaccgggctttgtaatttatgaaaaaaataatactgtttatgtaactccaaaattatttgaaaaagttacagaataaatgtttaagtaaaatattgtttttttagataaaatataagtttttatgatagttaataagtaaacttgttattttagtaattatgaacgtatttttttagattgaaaaatgtctttatttagtatagtttaaaaatgtcttttaactatatatttttatttggattaatgatctaattcagcttcccaaatgggaagctgataatgtatttgccgaaatttttaataattaactatttttttcttcatagtatttctttatttcaccagctaaaaataatgaacctataacacataataactcatctttatgaagtgttttcacaacttcattaaatgcagaaattggatttgaattaatatctgagacgatgttatttttcataaaaatattctttatagtacctgaatccaaacatcgcggcatatttatttctgttgcagttatttttgatttttctgagatagcataatcagaaatcaaattaataattgattcataatctttatcagacataaaagcaactaaaaaatgaatttttttattcagactttttaaagattttaagaaagaatttattgcctgcggattatgtgcgccgtcgacgataatattcggtgcaataaactcaaatcttccttctatgtttgcatgttttaagccatttgttatacaatcagaagaaatagcatatccttgatttaataaactattgataatttcaatagctgtaactgcattataagtttgaaatctgccatttaatgttaaatcatagcgcgttcctttatattcaaaagaatttttataaggttccggaagcgttggtaattccggaatgattaaattagagtttttttcttgacatattaatctaatattatcaaatacttttgattcttgaataggatataaaaccacatctgaatttttcttaattatcccggctttttcttttgaaatttcatctatggtattgccgagatattgacaatggtctaatccaattgcagtaaaccctactaccaaaggatttttaataatatttgtagcgtctaatttacctccaaggccaacttcaagaataacaaaatcacagttttgtctattaaaatattcaaacgcaacagcagtgtcaaaagcgaactctgatacaaatgcgtcatatttttctgttattttttttacatatgacgcgatatcagctaaatcagaattgcttataggtacaccattaattttaattcgctcattaaagaattttaaaaatggcgatgtaaataatcccgttttataacctgcttcagtcagtatttgtgaaaccattgtacaggttgagcctttgccgtttgttcctccaatatgtataaattttaaattatcctgagggtttcccattttgtttaaaagtttttctagcagagcattacccaaaacacggttaaatttaggaatactatgtatatattctaatatttctttatagttcatattattctgtcctcctgacagaaacaccctcgttttcaagataattttttaaatcacaaatttctatttctctaaaatggaaaagtgaagcggcaagtgcagcgtcagctttgccgtcagttaatgcatctttgaaatgtgacatgtttccggcgccgccggaggctattacaggaattgaaacattttcagatatagtttttgttaattctatatcataaccatttttggttccatcacaatccatagaagttaatagaatttctccggcacctaaactctcagccttttttgcccactctaaagcgtcaagcccggtgtctatacgaccgccgtttatataaacattccagcttccgtattcatttctttttgcatcaattgcaactacaacgcattgacttccaaatttttgggctgcctctgatatgagttgaggatttcgtatagcagatgaatttattgaaattttatccgcaccttgcagcagaagttccctgaaatcatcaacagatttaattccccctcctacggtaaatggtatgaaaacagtctcggcaacttttttcgccatttctataactgttcctctggcttcatgcgtagcggttatatcaagaaaaacaagttcatctgcgccggcttcgttatatatctttgccacttcaacaggatcgccggcatcaattaaattaacaaagttaactccttttacaactctgccgttttttacgtcaagacatggtatgattcgctttgcaaacattttatttctcctttttataaattgccaaagttctttaaaactttcaatccttcatttccgcttttttcaggatgaaactgtgttgcaaaaatattgtttttatgcacagcaatcggaagttcagttccatattcagttacggcggatataatttccttatcctttggattaatataatatgaatgaacaaaatacatatatggttcttcacttaatccttgaaaaataggacagtttttgtcgtactttattgaattccagcctatatgaggaattttaaggctgccctgttttggaatcttgatacaatttccatcaaatattttgagaccgggttcattaggtgattcctcacttgtttcaaataaaagctggagcccaaggcatattcccaaaaaaggtacgttattttctataacttgatgtatacactgagttagataagctttattaatagaattcatacagtcgccgaaagcaccgacgccgggaagaattaccttatctgcagaaattatttcatccggttttgaggttattttagctttaaatcccaaaaattccaaagctttttctacagaccgaagattgccggctccataatcaataatcgctatcatcgtgatctccttaaagttttgtcaatataatatgaattcaattatactattttataataattatttcaagagtaattgagaaaaatattgctgtaattttacataattcgttgacttaaacagtaaaatattacttgccatatcatttggtttgtagtataatgacaaaaggtataatttactataatgacgtttattactgaaatcaggtgacagaaaatgaaagtattatttatgggaacgccggattttgcggtgccttgtcttgaatcaatcattaaaagtgaaaataataatgttattggagttgtaacacagcctgataaaccaaaaggaagaggtcataagcttcagcctacacctgttaaagcaaaagcagttgaatataatatacctgtgtttcagccggaaactttaaaaaatagaagttttgaagatgaattaaaacagctgaatcctgatattattgttgtagtagcatatggtcagatattacctgaatatattttaaattttcctaagttcggctgtataaatgttcatgcgtcattgcttcctaaataccgcggtgcagctccgatacaatggagcgtaataaatggagacacaacaaccggagttactacaatgtatatggctaaatcccttgatacaggggatatgatacaaaaagctgaaattcaaataggcgatgaagaaactgccggagaacttcacgatagattatctcttataggagcagatttgattgttgaaacaataaaaaaactttctgaaggcaaggcgatcagagtacctcaaaatgattcactatcgtcttacgctcctatgcttaataaagaaaccggtcatattgattggaataaaaattcttctgatataatcaatttaatccgcggaacaaacccatggccaggagcttttacaagttataaatctgaaataatgaaaatatataaagcatataaaggcaatactaatacagttggtaaacccggagaaataataggaataaaaaataaaaaaatagaggtttgctgcggtaactcaagttcaatattaattgatgaaatacagtttaagggcggaaaacgtatgaatgtttcaagttacttaaacggtcatagtatagatatcggtgaaattttaaattaggaggtaattaaatgtattttggtttatttgaccctacaatgtatttgctgattcctgcaattatattagctttatgggctcaaacaaaggtttcaagtacctttaacaaatattcaaagatagcaaatgcacgcggtttgacaggttcagacgcggcgagaatgatattagacaaaaatggtttgtattcggttaaaattcagcatataagcggaagtttaactgataattttgacccaagaaccaatgttgtaaatttatctgacgcaacttatatgagtaacagtataggtgcaataggtgttgcggcacatgaatgcggtcacgctgttcaatatgcaaccggatataccccgataagaattagaaatggaatttttccagttgtaagcatatgcagtaagctttctatgccaattattctattaggatttatacttacagctttcggcggtatggctcctttaattgtggatattggtataatattgtattcagctaccgttgtttttcagcttattactcttccggttgagtttaatgccagcagccgtgctttaaaaactttggaatcatatcaaatgttgggttctgaagagataaaaggtgctaaaaaagttttatcggctgccgctatgacttatgttgccgcagctttttctgcgcttatgacattgctgaggcttgttttgttatcatctaacaacaatagaagagattaggagtattcatgaattcaagagatatttcattgtcgatattaaataaatatgattatgacaaggcttatgttaataaattattagcagatacttttaaaaataaaaatatagacaataaagataaaggtttaattaatgagctggtattgggaagtatagaaaatcggtatttgcttgattttataatttcccaattttctaaaattaaaattaaaaaaatgtctgtatcagtaagaaatattcttgaaatgggaacttatcaattattatttcttgataaaattcctgattcagctgtgtgtaatgaaagtgttaagcttgcaaaaaaatatgcaaatcgttcgtccggttttataaatgcagtgttgagaaatataagccgcaataaatataatataaaatatcctgataagacagaagataaaatagggtatctttctatatactactcatttccaaaatggatagttgaaaaattagttgaccaatttggatttgaattttgcgaagatattttaaaatcttcgtttaaaacatattctccggctatacgtgcaaatatattgaaagtgcctaatgatggaaatggtaaagttaaaactgacgagtttatcgatactttaaaatctgagaatattaatataattcctaatgaagatatacaaaattgtttttgggtagatggaaaacttgatataaataattctgaaagctataaaaatggtttatatacaattcagaatcctagttcacaattaacggctataacgttagacccaaaaccgaatgagataattatagacgtatgtgcggcacccggtggaaagaccacccacatagccgagcttatgaaaaataaggggcgcgttttggcttttgatatttatcagcataaaattgatttaataaataagtcggcaaatcgtcttggaatagatataatagaagcagttaaacatgattcttctatatttaagcccgaacttgttgaatatgctgatagagttttagttgacgctccttgttctgggtttggcgtgatacatactaaaccggatattaagtggcatagaaatgagaatgatattaaagaattaataaaaatacaggaaaaaattctttccgtttcgtcaaaatatgttaaaaaaggcggtacattgatatacagtacttgtacaattttgaaagatgaaaatgaaattcagatttcaaagtttctttcagaaaatagagactataaattgatttcagagaaaagattgtttactcatattgacggaggaagcggtttttatattgctaaattaaagaggatttagaggcttaatattcatggataaaataaatttaaaggatttgacattagaagaacttcaagattatataattaatcttggagaaccgaaattcagagcactgcaaatatataaatggatatacagcggtgtgcggagttttgaagaaatgactaatatttctaaaacgttaagagataagctgaaatctaatactactatcggaaatcttgcaattaataaaaagttcgtatcgactcttgacggaaccaggagatatttgatacaattatcggataataattatattgaatctgtacttatgaaatataaacatggttattcaatttgtatctcatctcaggttggatgtgcaatgggatgtaagttttgtgcttcaactaaaaatggtaaaatacgcaatctctcagccggtgagataattgatcagattatcactgttgaaagggatgttgatgaacgcatttcaaacgttgtcatgatgggtgttggcgaaccgttggacaactttgataatatagtaaaatttataaaaaatgtaaataatccaaacggtttgaatattgggcaaagacatataaccatatctacttgcggtattgttgaaagaatttatgaattggcagatttgaattttcaaattactttagctatttcactgcatgcaacaaatgatgaaaccaggaatgatattatgcctgtaaataaaaaatataatatttcaaaattgcttgaagcatgtaaatattacgtgaataaaacaggcaggagaatcacatttgagtatactcttattaataaaaagaatgattatactcagaatgcagaagaactctcaaatttattaaaaggtattttatgccatgttaatttaattccggttaattcagtagatgggactggatttgtaccaggcagtgaaaaaaatataagagaattccaaaatattctcgaaaagaatggtataccggcaacagttcggcgtgaaatgggaagtgacatctcagctgcgtgcggtcagttgcgttcacagatataaacaataaggaaggagcgttgacaatgaaatttgatgtttatggcgttactgacactggatgtgttcgtcagctcaatgaagataatttttgtatttgtggatttgagaacaataatgaacctggatattgtgtcgttgctgatggaatgggcggtcataatgccggagaggtagcaagccagctggctattgactttattactgaatccctcaatgatatacttcaaaacagtgaaaatcctgatgtgccaagaagaattaatgatgccttaaattctgcaaacgagagtatttataaaatggcaagagaagacaaaaatcggaacggtatgggaacaaccacggttatatgtacatttgccaatggtgagggatatatagccaatgtaggtgacagccgtgcttatgcttgcagaaatgatgaaatttatcaaatcactattgatcattctattgttgaagagatggttgctaatggttcaattacccgtgaggaagctagagttcatccacagaaaaacattataacgcgggctataggaagtgagaaaaccacaaaagctgatatatttgaatatgaatataaacctggggatagtattattatatgcagtgatggactctcaggaatggttgaggacgctactattttgaagacggttcaggatggtaaaagttcaaaagagattgccgataatttgtgtgagttggcaaagaaaaatggcggggttgataatataactgttatagccattagaattatggaggaggagagttccatatgaatatgattggtaaagaaatagatggaagatatgaaattcttgaggaaatcggcaagggtggaatggcacatgtttataaatcacgggataagtcactaaatagacttgttgcagtaaaggttcttaaagaggattataaagatgataaggaatttgtacgtcggtttaatgtagaggctcaagcggcggccagtctgtcaaatccacatattgtttctatatacgatgttggatgcgaaaatggaatgcattatattgttatggaatatattgaaggagaaactttaaaagagtatatagaccgagttggagttcttccctggcgtgaagctgcaaattattccattcagatttgtgaaggtatagaggaagctcataataactcagttatacacagagatataaagccgcaaaatataataatggcttctgatggtgtgctaaaagtaacagacttcggtattgcaagagcatctactcaggcgacaatgaccatggcgaacaataatacaattggaaccgcacattatttgtctccggagcaagctagaggcggatatacagatgagcggacggacatttattctatgggtgttgttatgtatgaaatgcttacaggacaacttccgtttgatgataacagtcctgtggctattgctataaagcaccttcaggaaacggctacacctataacagatataaatcctgacgttcctaatgcattggaacaaattgttatgaaagccatgtcaaaagaacaagacagcaggtattcttctataacagatatgatttcagatattaaaaaagttttggctaatccaaatgtaaatctttttgcggcaggcagacgaagtttacctgttgataatcaggtaaacgatgcagcttcaaatacaataaaaatgcctagaacatttgtggattctaatcttgatgaacaaatgatacctggatatgatttagatgattatgatgagcaggatgaagaatacgaagctatggaacgtttaaatgaaaaaagagccaaaagattgaaaaaaaagaaagaacgtaaaattgcttttattgcctttttgtctgcacttgccgttttagcagttggatttgcggctgcttttgcatttaccggtggttttggtatttttggcgtagagaaagattctattcaaatacctaatgtagttggtatgactattaaagacgctcaatctcagtatggcaaaagctttagtatcattgaacaaaacagaactgaaagtacaaaaccggcaggaacaatattagaacaaactccggctggaggagatacagtttccaaaagagacaacatcattatcagagtagtagttagcctaggaagcagttctgttactcttgatgattatactggaatcaaatatgataaggcaaaagaagaattagaaaagttaggtttaaagtgcagtaaaatagaaaaagttgaccctgaaatagaggcaggactaattattagtcaggaacctaagtccggcagttcggttgcagcaggagatatgattacatttactgttagcaagggaccggaaagtacaccggaaccttctcttgtgccaaataaaaattctaataatgactcgaataatcactcaaataatgagaacagttcgtcatcaaataataaaccgaattcgaatgattcgtcaagtaactcgtcaaataatgacaaaaatgatgagaattcttctaataatagtggaagcaattcaagttcaggcggttcaggtaacactacaaatgagggctctagctcaggcagcagtaccggttcgggaaccagcacaggctcaggcagcggaagcggaacaggttcagaaaccggatcaggaagcgagtcgggttctgagggcggcacaggttcaggcggaggaagcggatccggatctgaaagtggttcaggaagcggttcagagactggctctggtggttccggcagtgaaagcggaatgggtagcggaacaggttctgaaggcggaagcggcaatggtttagaggattaatatatgccggaaaaaaatcaatttgaaatacagggtaaaatttttaaaggtatcggtggtttttattacgttaaagccggtaattttatttatgaatgcagagctagagggcgttttagaaaagatggaataactccattggttggtgatgaagttaattgtttgattgataaaacttcaaatacaggtatgattagtaatataatgtctagaactaattctttaatacgccctcctgttgccaatgtaacacaaatagctatagtcgtttcagtcactaatccgaaacctaatttaaaaactgttgataaacttatatcatcagctatatatgctaatataaagccattaatatgtattaataaaaccgatttacaaaatggcgaaaacctttttgaaatatattcgaaaataggatttaaaactctttatataagcgctgaaagtaaagaaaatatagatatgcttattgaaaagctctcaggagaagtcacggtatttgccggaaattcgggtgttggaaaatcaagtttactcaactgcatattaaaagacgctaatcttgagaccggaacggtgagcagcaaaatagaacgcggacgtcatactaccagacacagtgaattaataccgcttgataacaacggaggatatattatagacacacccgggtttagttcattctctgtaagcggttttgatgaacatgagctttataagctttttcctgaatttatagagtattccgataattgcagatttgccgactgcagtcataccgttgaacagggctgctctgtacttgaagcggtagaaaccggtgaaatcagtaaatccagacatgaaagttatgtcgaacaatataaggaaattctagatagtaaaactttttgataacgggggataaataaaatgtccaaaataattatttcaccttcaatattatctgctgaccctgccaatttagaacgtgatgttaggctggtagaagaggctggagctgagtatctccatattgatattatggacggacattttgttccaaatttaagttattcggcaaatgtaataagagctttaagaaagaaatcaaacttaatatttgacgttcatttaatgcttcaagatgctgacaaattcattgatgaatttgcagaagccggttctgatataattacagttcatcaggaggcagttccaaacttaaaagaaacacttaaaaatattcactcatttggaaaaaaggcaggagtaagtttaaaacccggaactcctgtagatatgattttaaatgttttggatttgactgatgtggttctgcttatgactgttgagcccggatttggagggcaaagttatcttcatcaagtagataaaaaaatctctgaattatataagattatcaataatcaaaatctaaatatcgggatagaggttgatggagggataactgaggaaaatgtgaacagacctgtaagagcaggtgcaaacattattgtttcaggctcagcaatttttaattctaacaacataaaagatacgataaataaaatgcgtaagaaagcggaacaaggagtacaagaacgtgaaatcaataatttttagcggcgcttatatagaaaactatgattatttgtctgaaattaattttgatgaatatctaataatatgtgcggattccggatataaacacgcagagaatttaaaaatagtaccggatgttattttgggcgacaatgattcatatttaaaaaagtatcctgataatattaaaaatcttgtttttccaccagaaaaagattttacagacacccacgcagcgatagattatgctattaataataatgcagaagaaattttaattattggcggtcttggcggcaggatagaccatgaattttctcatttttgtcttatgaattatgctttggataaaggagtaaaactaaagttgattaatgacacaaatgaaatatggatggaaaataaaccttttaaacttaaaaaatctaaaagaaaatatgtttcattctttccttatgcaggagctgtattgaatttttcaataaaaggtttaaaatatgagacaacaaatatgcgtttggttccaaaccgagttcaagcgtcgagcaatgagttttgtgattctgatactgcaattgtaacctttgacagcggacttgttattgttatgttatgtgacgacagatattaattttaagtggagattttgcaatgaaatatatattaaagaccttgtcgtattttgtattaattaccattgtagctgtatacagttcatcatgctctttaagtgataaatctgagagtataagtccttctccagccccaagtattggagtgagtaataatacggctttcagcgatatattttctgagtttaacgaattaaaaaatgtatcagcagccctgttaaatagtaaaactgatttagtttggtggcagaaatttgattcaatatataataatgtgaatgcagtatatgaagaaaataatgctattaatatgagcggtaaactcggcggtatggataagtctttatcacaagcgttggtaagtgtttcgtcatcatataaagacgcatttgatattatgaacgcagcaaaagacaatgatgattcggaaatacagcaatatgcttataatgatttttcaaataaaatatcttctgcaaataatcaatgggaatatgttttagaaacattgattgaaacatctccgcctgatagtagtcaataaaacaattatttatatattgttaatttaaaataaaattatattttagctatttgtcgttaaaccatctatatagtttgtcgtatatagagtatatattataaaataagttataatattaatataagaccccagcgtgtaagaaactacgcatggggtcttatattaatgagattatattcaactatgcctttactatctttaaaaatttctttttacctttttttactatcatttcgttttcattttcgaaataagtattatcaataattgtcgaaacgtcagaaattttctcgttattcactgtcagtccattttgctgtataagtcttctgccttcagcttttgatggtatgagtccaacctgaaccaataaatcaagtacatttattcctgcattgataattgaagcatcaacagtttccgatggcatatcagctgcattaccacctgaaaatatagccatagccgcatcatttgctttttttgcttcttcttcaccatgcaccatttttgtaacttcatatgctaataagcatttcgctttgtttagttcagcaccttcacatttttcatattcagcaatttcttcaagcggtagaaatgtaaccaattttagaagtcttattacatcggcatcatcaacatttctccaatattggtaaaactcataaggtgaaactttctcagggtcaagccaaagagctcctttttctgttttacccatctttttgccctcgcttgttgtaagcagagtaaatgtcataccataagcctgtttgccgtctttacgcctgattaactcaatacctccgagaatattagaccattggtcgtctcccccaaactccataataacgccgtaatctttatgaagcttataaaaatcatagctttgcatcagcatatagttgaattctaagaatgaaagccctttttctaatcttgttttaaaacattcaaatgtcagcattctgttaacggaaaagtgaacgcctacgtcgcgtagaaagtcaatataattcagtttcagcagccaatcagcattgttgaccattatagcgttctcaccgtcaaaattaatgaatttagacatctgttttttaaagttgtctgcattatgctgaataacttcctgagttatcatagggcgcatatcagcttttcctgttggatcgccgaccatggtagtacctccgcccaataaaacaataggtctgtgtcctgcgttctgcatatgtttcattactataagctgcataaaatgacctatatgaagactgtcagcagttggatcaaagccaatataaaatgttattttctcttttccgagaagctctctgatttcatcttcatgagtagtttgggcaattaagcctctttctttcagggtgtcaaaaacatttttattattcattgtccgaattctccttttctccatcatctactggtacagttatttcaatacccagttcttccaattgttttttatcaacataactaggcgatttcagcattaattctgatgcggtttgaacttttgggaaagcaattacgtcacgtattgaatcgcagcctgccataatcataacaagtctgtcaagaccataagctagtccgccatgcggtggagttccaaatttaaatgcctccattaaatgaccaaaacgctcccaagcttcatcatgcgtgaaaccaagtgctttgaacattctttcctgtaaatcagaattaaatattcttaagcttccgccgccgatttcgcttccgtttaaaataatatcatatgcttttgctctaacgttttgaggttcagtttctagtttttcgatatcctcatctaccggatgtgtaaatgggtggtgtttagcaacgtatctgtcttcctcctcagaatactcaaagagagggaagtcagtaacccaaagaaaattaaatttagaattatcaataaggtcaaattgacgtgccacttcaagacgcagattaccaagagcatcatagaccacatcgtttttatcagcaattataagtattgcgtcgccaggtacagcgtcagttttagaaagtattgaattaatctcatcatctgataaaaacttggttatttgtgaacgcaaagaatcatcttcaacaacaatccaagacatccctttagccttatatgtcttaacatattcagagagtgcatcaagcttcttcctggataacttgttcccaagaccttttgcatttatacagcgaacgcttccgccattttcaacggcgccggagaacactttaaaaccgcagttttttacttcatcagaaatatctataagctccaaaccaaatcttgtatctggtttatctgaaccaaatctattcattgcctcattatatggcattcttataaaaggagtttctatgtcaattcccatagcttctttaaaaactttttttaaaaagccttcatttatgtttattatcgtgtcaatatctacaaatgatagttccatgtcaagctgtgtaaattcgggttgacggtctgctcttaaatcctcatctctaaaacatctgacaacttgaaaatacctgtcatatccggcaagcataagcatttgtttatattgctgcggagactgcggcaaagcgtaaaattttccttgctgaaccctgctggggaccaaataatctcgagcgccttcaggagtgcttttggtgagcataggagtttcaatctctaaaaatccatttgcatcaaaataatcacgagcaattttagtaactttgtgacgcagcatcatatttttttgcatatcaggacgccttaaatcaaggtatctatattttaatcttagtgcgtcattagtgtcaatgttttcctcgatatagaaaggaggtgtttcggatgagttaagaacccttagctcagtaacaaaaacttcaatttcaccggtaggcatatttttattgacattttcaggcgttctcttgagaaccttacctttaacagcaataacatattctccttttaaatgctcggatttttcaaatacatctttgtcagttgaatcgttaaaagctaattgtactatgccggttctgtcacgcagcgtaacaaaatttactcctccaagttttctgttttttgctacccaccccataagaacgacttctttgttttcatctgaggcattaagctcaccgcacatatttgtacgtttcatatcagacaatgtttcaaattccatttatctttctccttaaaataaattataaacaagataatattattattttattatattataaatcgaatcacaggataattctacaatagtttcttcaccggtatccatgtttttcagtgaagccttattatttaaaacttcatcatctccgataacaatactataacatgctccaagtttatttgcatatttcatttgtgctttaacgctcctgtcacataaatcgcgttcagcccaaagacctttatttcttaaatcatatactaacttttgtgcggttaagctggcattatcgccaattgaagctacaaatatattcggacccaaactttctccaagttcgattccttggctttttaaaattaaaatcagtcgctcaatacccatagcaaatcctataccaggagttggcttacctcctaattcttcaacaagtccattatatctgccgccgccgcatactgtagactgagctccgagagcgtcagatgttatttcaaacactgttcttgtgtaataatcaagccctctgacaatatttggatcaatagtatattttatattaagtttatctaaatatgatgtcagctgtttaaaatgagaatcacaatcctcacataaataatcaatcatacgcggagcattagcgcaaacttcctggcataccggtgatttgcagtcgataatccgcattggatttttctcaagtctatctttacaagtatcacataatttatcaatatggctgctgaaatatttttttagttcttcattatactttggcttgcatttttcacacccaatactgtttaaattaagtgataagtcttttacaccaagagttttaaaaaagtcaaaagcaagagttattatttcagcgtctgtggcgcttgaatcgcttccaaaacattcaagaccgaactggtgaaactcccggagtctgccggattgaggcttctcatatctatagcaagaaattaaataatataactttgtgggttgaggattcgcataaagcgaattttcaatgtaacttctaaccaatgaagcggttccctctggacgcaaagtaatgctacgcccgcccttatcgttgaatgtatacatttctttttgaaccacgtctgtcgtgtccccaactcctcggctaaaaagagaagtatcctcgaaaacaggagtacgaatttctttatagccgtatttagcacaaatttcatgagccgtattttcaatcagtctccaaatttttgaatcgtttggcagtatatcttcggtgcctcttggcttttttatcatttttgcctctcctttacaaaatttgttaatgtcccaataccatcaatttcaacctccactgtatctcctatattcatagaaccaataccggagggagtacccgttgtaatgatgtctccgggataaagagtcatgatttgcgatattgcagaaactaaataatcagttttaaatataaaatttgatgtattggattcctgcattacttttccgttaaggcgcaaacgaatatcagcgttatcaggatctaattctgtctctataaatggtcctattggagcaaatgtgtcaaatcctttagctcttgtccactgtgaatcaagcctttgcaaatcacgagcggtaatatcatttaaacaagtatagccgagaatatattttttagcttcagattcgcttacgtatgatgcggtttctccaataactattgctaactcagcctcataatcaacttgttctgacatatcaggatatataatattatccatattaccaataacagaagaggatggctttaaaaacagagcaggaaatttaggaatattcagccccatttcatttgcatgattcgcataatttaatcctactgcaactatttttgagggttcgcacgtcggaagaattttaacttcatttctattaacatttgtacttgtatatgaaaagaaatcaaaaatatctccttcaattaattcaaacatatttgaagaactatcatactttgcgtaataaatctcatcattatataatattctggcaaatttcattatttcatctccgtttatttttctgatatagaataatttgaaaggatttcatcaaataaagctatcaaatcatttcgtccggtacgcttttcggcagaaaatggaattaatattgaattattatccatttgtaaatcattataaatctcggttaaatttttgtcaatttgtgatttctttaatttatcaatttttgttgcaacaacaattgtattaaaattataatgtcttatccaatccgccattgtaatatcatcttttgacggtgcatgtctagcatcgactaactgaataacttgaactaaattatatctttttgatagataagtatcaatcatggctgaccatttttcttgctcagcttttgaaactttagcatatccatagccgggtaaatccacaatcctgtatctgtctttttgaatttgatagaaatttattgtggcggtttttcctggagtactgcttgttcttgcaagtttatttctatttgtcaggcaatttattaaagaggattttccaacattcgaacggccaacaagagctatttcaggaactaatgtatcaggatattgttcaaatgaaactgcggttttaagtaaatctacttcaacaaaatccattcgtatcacctcatcaaatttatatattacagttttgcaatcgttacattgcttatatcattttttatatatagttcattgtcaaggggcaataagttattcccacttttttttacaggcaatgacggtttgaatggtttagttaatgcattttccaaaacatcaaccatatttttagcaaagataaactcaatattatttttaactatatcaggaagctcttcataatctgctttattttcaaacggtataataactttttttatacctattcttaaagctgccaatgttttttcttttaagcctccgattggaagaacttttcctcttagtgttatctctcctgtcattgcaacgtcatgttttacaggtttgccggttaaagcagaaatcatagctgttgccatggtaattccggcagatggtccatcctttggtattgctccttcaggaatatgaatgtgcaaatcataatttttataaaaatcagacttaattccaaatttataactgtttgaacgtataaagctatatccggcctttgcagattctttcattacatcgccaagattaccggtaagctcaagttttcctgtaccgtccataatattaacctcgacggataatgtttctcctccaacttctgtccatgctaacccattaactattcctacagaatctttcttttcgattgagctgtcgttatagatttttttgcctaaaaattcatttaagtttttccttgtaacgcttatataaaaatcattatcttccgcaactttaacagcaacttttctgcaaaccttagaaattgctctttctaaatttctaacgccggattcacgtgtatacccgttaattatttctttaataccactgtcggtaatatttaaattatggctagtaagtccattatttttacgttgtttttgaattaaatatttttttgcgatattgagtttttcatcttctgtatatccagaaacttcaattatgtccattctgtccaaaagaggacgaggaatattttcaagactgttcgcagaagctatgaacataacgttggataaatcgaaaggaagctcaatataattatctctaaagcttttattttgttctgggtctaaaacctcaagcatagctgaagttgggtcaccgctgatatctttcgtcattttatctatttcatccaatagtataacagggttatttacattggcacgctttatagcatcaattattcttccgggcattgcaccgacatatgtttttctatgacctcgaatttcagactcattatgtacgccgcctaaacttagcctaatatatttcctgcctattgattttgccaaagagctgactattgaagtttttccggttccgggaggaccaactaagcataaaatatttccgtttaccttatttgtaagtttgcttactgcaatgtactctaaaactctttctttaaccttatccaaaccataatggtctctgtccagctgtgtttttgctgcttttatgtcaagagtttcatcgccggttatatcccatggcagagctagtatggtttctatatatccttgaataacagcatattcctgtgaatgagggggagttttagtaagccttgagaattcatcattcagcttgtccataacttcttttggtaaatttctgtctttgatgctctcacgatatttttttatatcagagtcgttttcttcgccttcgcctaattcttcctgaattactttaagtttttctctgagtacataatcacgctgattattatcaagattttcctgaacctgatccattacacttttctctatatcaagtagatcaatttcttcagacattattgttataagctgttccattctttcaagaacgttcactttatccagaaccgtttgtttaagagcaggttttataggaatatttgatataatgacatcagtcatttcaccaggatcgtcaattgcgagcagagcgcttatggcctcaggagatgccttatcatacagttcaagatagtcctctgtcaaacgctgaatttttcgaattaagatttgagtatatgtatcatcatcagaattaatatcgtcaagcttagtaacattaacttgtatatactttcctaaatcttcaaaatcatttatgcttgctcttgattttccctcaacaagtattcttatagaaccatcaggaagacgaagaatttgacgtatttcgcatatagttccaatttcagctaagtctgatttaaccggagactcaactaaaaaatcattttgataacacaaaaatatcaatttatttttctgcattgccgcttctacagcgtcaatcgaccttggtctgccaacatcaaaatgaagtgccatgcccggaaagacaataagtcctctaagcggaacgaggggcagtgtatatttattatctatcatatttattataccttaactttctatatgaatttaatgccgtgtaaaaatactcggcagaagttaattatactattaatatatataaatatcaagtatttccgcaaaattctactgtataaattcttataaaaacataagaagtttttgtgcaacgaataaacaaataaacaaaaatttacagattatagtataatagtcaaatttgcgttttaaatcaatataaattacttttatttgcatatcaattgaaatataaaatatattgtgatataatagataaaatattgggggaagtgatattatgagtttactcatatataaagcgttgtgttatttttttatatatggatttttaggctggtgctgtgaagtcatatatgccgcaataattgacggaaagttcgttaaccgcggatttctaaacggacccatatgtcctatatatgggtttggggttttatttgttttaactttattggaaccgattagagaaaattttttatttttatttatagggtcagttatattaacatcagtgcttgaatttataacaggatttttgcttgaaaaagtatttaaaatgaaatggtgggattactcaaacgaacgttttaatattcacggttacatatgtttaaagttttcaattatttggggattggcatgcttaatagtagtcgatataatacatccattttttatgaaggctgtggaaataaatccaataaatattggtattatcacaattggtatattaagtgttttatttatatctgacattatctcaacaattattggaattaacagaacaaacagatatttaaaattattgtcaaaatcaggcagtcagcttagaaagatttctgaatctataggtgaaaatatttctgacaaaacaattcaatttactcaaaaaagtgaaaatataaaaaatgatgtaaaagaaaaacgtcaaaaagccataaatgatatggaaaagcatagagcggctattcagagaaaacaagaggatatattaaagaatatgcctatgactgcaaaacgtatacgttctgcatttcccgacttaaaattatttgagtattgggataataagaataaagaaaataaaaaataatttataatataaaataaaatttggaggaagtaacataagtatgattaaaagattagtttctgtagtatccatcattttaatttccgcattgttattttgctcatgcaatcagattgcatcagttaaaaacgatgataaaataagtgtagtcgccacaatttttccggcctatgattttgttcgtgaggtctctcgcggtacagacgacatagatttaaaacttttgcttaagcccggttcggaagcgcattcatatgaaccaaccccgcaggatataattgctatacaaaattgtgatgtctttatttatgttggcggagaatccgatgaatgggtaaaaaatattttgtcatcgattgacactaatttaataaatatagtttctatgatggattgtgttgagcttgttaaggaagaaacagttgagggaatggaagaggagaagagtgcaaaagaaacatatgagccggaatatgatgaacatgtttggacatctcctagaaacgcgataaaaattgttgataaaatcaattcttcaatggcagaatcaagacctgttaataaagaaatttataataataacactataagttataatgaaaagctagaacagcttgataaagattttcatgaaattgtgaagtcaggcaaacgaaatacaatcgtcttcggcgacagatttccatttagatactttgctgatgaatatggattagaatattatgcagcttttccggggtgttcggaagaaacggaagctagtgcaaaaacagtttcatttttaatagataaaattaaaacagaaaatattcctgtagtattatatcctgaattgtcaaatcaaaaggttgcaaaaacaatatgcgagtctaccggagcattttcgctccagttcaattcatgccataatttaacaaatgatgaatttgaaagcggagctacctacttgagtcttatgaaagaaaatataaccacgctaaagcgtgcattaaactgaatatggagatattatgagtgattttagcagaaaaaatgttatagttattggcggaggacctgccggaatgattgcggcaggcacagcggcagaacgcggtcacaatgttaaattgattgaacagaataagattttgggcaaaaagctgttaataaccggcaagggcagatgtaatttaaccaacgcttgcgacgatgttgaaacactgatacaaaatgtacctactaacgggaattttttatacagtgcattttatacattttcaaatatggcggttatcgacttttttaataagcttggcgttgaaactaaagttgagcgcggaaacagagtctttccggttagcgataaaagctccgatgttgtagaagcgcttagaaattatattattaaaaacaacgttgaaataattaatgacagagttgattctatacttacaggtaatgataattctgatgaaaagagcagaatatccggtgttatgtgcagcaaaagaggaaaaatatcagcggacagagttattattgccacgggaggaatgtcgtatcaaaagacaggttcaacaggcgacggttatttctgggctgaagagcttggacacactattacggatattagaccttctttagttcctgttaaagtaaaagaagattggattcaagatgttttaggacttactttaaaaaatatatcaattaaagtaaagaactcaaaaaataaaactatatatactgattttggtgaaatgatgtttgcacattttggattaacaggtcctgtaatccttagtgcaagcgcgcatatgaaaaatattaaatctgaacattatatgatagaacttgatttaaaacccggactgagtgaaaagcagcttgatgaaaggattttacgtgattttagtgaaaatttaaataaagattttaagaatagtttaaataagctaatgcctaaaaaattaatagatccaattattgagatgtctgaaattgatccgttaaaaaaggttaattcaataactaaatccgaaagaactgcgttagtaaaactgctaaagtgtattaaattcagcgtagttgatttttgtcctatagagcaggctatagtaacgtctggaggaataaatgttaaagaaataaatccatcaactatggaatctaaaatcgttgacggattattctttgccggagaaataattgacgttgacgcttataccggcggatttaatttacaaatagcgttttcgagcggctttcttgcgggaacgtcgtgctgaactgcgctgaaatgatgacttaaagtttctgtatagagttgcggaaattacacagaatattattgataaagcatatgtaataacagcagtaattataaatcttgatatagtatctgtaactttaattccatttaaaatttcataagtcgaagtgattatcaaacaatgcacaagatatatgttgtaagaggctccggaaatgctgataaagaatccttttccacggctttctagggattcagtaagaccatacgcgtactggtaaaaaccaaatgttgagaacagacagaataatatcactattgtaggtgagaaaggattgtttataacaccgccatactccatatatgaagttacgcagtgaagtattgcaaaaacaagccagcctgcatagaccaaaagtcttgatttgcttaagaaacgtaagaactcattataatacattccggcgtacattccaagtatccaaaacaccaagtatgacggaaatatcttatgcgtatattcagtcgaagatatcagcattctgaatcctattgaacatacgacagctataaagattattattgtattaaaaagcttagatttatgcttgctaagtaaaatccaaagcggcataagcagataaaactgcattattaagacaacaaaataaaattgagcagataaatctccgttcaaaatatattttatcaatgaaactggattaaattcataaatatggaaagcataaacaaagatgatataatatatgacgaccataattatatacggcagatatatttttctgattctatctaatagaaacggcgcgtatgtaaattttctttcgctgaatttataaaataattttaatgcactggtaaaaataaaagcaggtacagcaaaagtagtgagtttcgtaactgtgaaaaacactatagataaaacgctccatttcggaaatacatttatgccctctgaaagcaaatgtattaatataacaaacatacagaggaagaattcaaaaactgaaacttccgtaatttttcttttcatataacatccctctacataatagtatttatattttacactattttcatatttaagtcaatgcttaataaaactacataaattttataaaaagattataaaaagtttatgtagttttattgtatattatagttgaatagttgtgcaaggtctggtataatcaaacttgccgatatacaacatattgtagaatatggaaattttatttaggaggaactgctatgacaaacttaggttggcaaggttttaaagatggtgtttggaaagatacaataaatgttgaagattttattagaaataattatactgaatataaaggcgacgaaagttttttgtgtgacagaagcgaaaaaactgatgctgtatataaaataaccagagaacttattctcgaagaaataaaaaagggaattatagatgttgaaactgaaaaagtttcaggtattgataattttgaccctggttatattgataaagataatgaagtaatcgtgggtcttcaaacggacaagccgttaaaaagaatagtaaatccatatggtggaatgagaatggttgaacaatcattaaatgagtatggatataaacttaataaagacattgagaaccatttcaaagaatatagaaagacacataatgacggcgtatttgacgcctatacctcaaaaatgagggctgccagatcagttggattaatgaccggtttgccagacgcatatggaagaggaagaattattggtgactatagaagaatcgctctttatggagtggatagactgattgaagagaaaaagaaagattttgaactaaaggaatctcttcctgcgtcagatgatgttatcagaatcagggaagaaatacgtatgcagattaaagctcttaatcagataaaaagtatggctgaaaaatatggatttgatatttctaagcctgcaaaagacgctagagaagcgatacagtttacgtattttggatatttggctggtgttaaggaaaataatggagctgcaatgtcatttggcagaaattctgcattttttgatatttatatttcacgtgatatagaaaatggagttttgacagaagaagaggctcaggagttaattgaccagcttgttataaaacttagattggttcgtcatttaagaacacctgaatataacgaactattttcaggcgacccaacttgggtaactgaatcaataggcggaatgggcgcagacggaaggacaatggttacgaaaacgtcttatagaatgcttcatactttgacaaatcttgacccggcaccggaaccaaatatgacagttttgtggagtaataatttgcccgaagcatttaaaaactactgtgcaaaaatgagcattgagacagacgctatacaatatgaaaacgacgaccttatgcgccctctctatggagatgattacggtatagcttgctgtgtatcatcgatggaattgggcaaaagaatgcagttttttggtgcacgcgttaatcttgctaaaactttactaatgtcaatgaatgacggtgttgatgcgctaaagggcttgaaggttttgaaatgtacagaaccaatgacagatgatgaatatttagattatgaaaaggttaaagcgtcatatttcaaatgtttggaagaggttgccgagctctatgtaaataccatgaacacgatacactatatgcatgataagtacgcatatgaagctggacaaatggcacttcatgacacagatgtaaaacgtttcatggcgtttggagttgccggactgtcagttgtagcggattcattatctgcaataaaatttgctaaagttaaacctatacgcgatgaaaacggtttagcttatgattttgaaaccataggtgattttccgaagtatggaaatgatgatgataaagtagacagcatagctgttgaagttttagaaaaattctttaatgaattaaagaaacatccaacttacagaaatgcagaacatacgctttctgtattaacaataacctcaaacgttgtgtatggtaaaaagaccggaacaacacctgatggacgtaaaaaaggtgaacctttggctcctggtgctaatccaatgcatggaagagacataaacggcgctttggcttcactgaattcagtagctaagctaaaatttgctgactgttgccaagatggaatttctaacacattttcaattatacctgatgctcttggaaagagtgaagaaacaaaggttacaaacttagttgggcttttagacggctattttaaacagggaggtttccatctcaatgttaatgtattaaatagagaaactttagaagacgctatggaaaaccctgataagtatccaacacttacaatcagagtgtcaggatatgctgtaaacttcaacagacttacacgtgaacagcagcttgaggtaatatcaagaacattccatgagtctatgtaacgtgtaaagtgtatttgtttacacgttgatgtaagagaagataatattaatattatagcaaacgccatctgtaaagaatatagctttacggatggcgttaaagcatttatttgttgctgaaaataatatattaaatttacgcaggtgatacattatggaaaatgaaaatataataaaaagtaatactgatataatcggtaatatacattcttttgaaagtatggggagtgttgacggacccggtatacgttctgttgttttttttcagggatgtagtttaaggtgcgccttttgtcataatcctgacacctggggaaccgatcctaataaagtaattacttccgccgatttaataaaaaaaatactgcggttcaaaccttattatgattcatccggcggcggtgtaacattttccggaggcgaaccgcttcttcagcctgaattcttgcttgatatattaaaaaaatgcaagcaaaacaatatccacactgcgttggacacatccggagtaggtcataaaggggacaaaaagttcagacctgattataaagaaatactcaaatatactgacctggttttgctggatgttaagcatactcgttctgaaatgtataaagaaattacttgtgtagatatgagtttttttatggagtttcttgacacgctcaattcatcagatacggatgtttggataagagctgtaattattcccggaataaatgataatatagattatataaaagagttagaaaaatttgctaaaaagattaataatgttaagaaatttgaacttttgccgtatcatactcttggagtaaataaatataaagagcttggtattaaatacagattagaaaaacttcctcccatggataagaaaaaaacgaaggaatgggaagaattattaaataagtcattagtgtaaagcatgaaatttttatatttttgtaggtttgtcaatgatgtgttacaaaaaagattaaaagagttcaccgaaattgataaaagagttgatgtagtcaatgggagctttccagcgtctactgatcttacatatccgtctccgtttatgtccgccgtatgcgctatcactgtattggctgtctctccctccattactgacagtctgtccttaacttcctgctccgtaattgttgttccgttgttcgatacaaatgccgcatatcctcccaggccttctgagtaatacatttctattgctgctgttccggctgactgcaatacatatttggcattttcattctttgctgtcgttactactaccaaatcttttccgctcggcgccgcattgtaactgtcgtgcgctacaatctttaccgttcctgttattactcctgcatatatctggatattctctccaaacatctgatatgggattgtatatactccgttgcttcctgttaagtatcctttgtttcctccgtttactgtgtaatatacatatcctactatatcaccgctgtttgccggctctacactgaacgttatatctgttccatatgtcgcttttccgtctgttactcctgtctctcctgtatacgctccatttgtcacagtattaaatgttacgctatactgggcttctgtatatgccgctgtcaatgttgcgtctcctgtcacttcatatgtactcaggtctatctttacatctccgctcatccagccatccggattatatcctgcttctgcttctattgtcggcaggtctgactgcagcaattttgagtttacatcctttgctatctctgtcactgctcccgctgcaaaacttccgtgtgttcccggctcaaatgttatcttgtattggcgcactgcctgagctgtcagacttgtatcttccgtatatgttcctgttgtcaaatctgtgcttgtataccctgttcctccgcttgttttccacagcggttcctctgttgtatcttttgccaaacggtagttctcgtttgcagttaccagtccctttatttgcgtatctgtcactgccgtagtataactgtcgtctgtgtatagtcctgctgtattatactttgtataatatgctgccggtgaacctgaaacagtgtttccatctccgcttgagagtgttacttttaggttatacagattaacggtttcagctgttgatactgctgctatatcagtatcagctcctgttggtgcaaaatatccgtccttcgttcctactgatacattagccgctgtttctattcctctatttactgtatactttactgtcattatagttacagcttcgcttgatacatcaaccgagctgcttcctgacgtatacgcaatcttattttgctccgctccttctccctgcaccaaattatatccgtttgtttttatagcgtctgacgcttctactgatgtcaatgtcatttttgtgctgtcatagtcaagagctatattaaagcttccgaaattagtcggttcactggacttaacttttaccgctaccgctatctcgtcaccggggttaaagttctcgtttgacggcgttactaattctgtaaccaactcatatcccaaactgtcagttattgcatatgtgctcaaatgctttaactttgttattacctttttacttgctgtgtcatatgccgacgctactcctgatttttctccggcgtcatttatatacactactgatacttttgaaggatttgttactgccgcctcggtttcatacggcacttttagtgtcaagtttccgtttgagcctgctgagctttccggcaacaattctgtagttcctgacatcagttttacgtctataacttttgctccggacattatcatattatttactgtttcattttcgctggcatcatgaacgtcaacttttaaactaataccttcacttcctgcagtatttgaaatcttctcaaatgcagttttatcaagttctatctccgccacatcagtattgattaccacactgtcaggaactgcactgcttatactatctaccacgtcttttggaatactaacatcactgtttttaatttcactgcttggctcatcagttgttgacgcatttattacaggatttcctgtgtccgcccctgttattttgctgtcatcaatagtaacgtttttggcaaatgccgcagtaattaaaactccgttttcgggcattacaaaactataagttccattattttcagttattaccacaggatttgctccatcagtcaattcagtatatgttaaacttccgtttgcaaaggtatatccttcattcggttcaacagttaaaaccactgtgtcgccaatatttgcgtccggattttcaacactaactgttccccctacaattccagtatcaattgttatttttttagaaattgaagaaaatgctgttccatcataataatatgtaccggcatcaagttttgtatcaaaccatagagctccatcaacatttccgacagtatatctggattttttatcagataaaatttttcctgtcattaacgatttatcaccggcaattatatttgaagaatttccaaaatcaaattttgaatttgtggacttgaagtctacaaaaccaagattatttaaattaatagcactattcacattctcaaaagcaacagatgaattatcaaaattaaatccaagtgctgtataccaagagtagccatcaagatatataccattttcagagttctttacagtcaaattaatatttttaaaattaatatattgcgtatctgaatttttagttttaatcgcagatataccgttgccattcatatcgatactaagcgttggtggctgatttgttgaatcttcaattcctacaatattagatgttcctgtaaatataccacaagcatcagcttctgttcctgtatacttaatggaattatctccatacataaatatttgcatattatcatatgagtctataatagctttttttgaaagatttgaagttacagcaattttatcagtttcaattgttacattatttaatattagcagtttttcttctggaatccattttataccatattctgccagctctgaaattgtcaacgaatttagttctgaaccgatatcatctgcgcctaaaccacctgtaaatatatttcctgacccactgtttacataataataattactgtcttcatatgcagcgttgaaattccaaactgaattttctatactgtatattcctgacggaataatatttttatcataaatatacatatcagaaataaaattaatacttcctgaaccttctgcagcttcaggcttaacagaaaatgctttgtatttaacgttatttaatgtaatatcaccgcttagtttaattctattattatcattgttaagcgtaaacccaattgctttcgaaacattttctatattagtagtcccgccttgaatttgtatacttccattctcttcaatattaattgctgtagcggttataccatgtagattctttatacttgtagtacaatttgttaaagaaattgttccgcctgagcttgtttgaaatccatacacatatgaagatgaagatccatccaaatcaatatttactattgaatcagttaatataatagattcctttgtaatcacaaagcctttcaatgtatttttaatattaacttcactattttcagaaataatacttttattccccttcacacctgcagctccaccggaagaattaacattaattttagaattatttctaaacgtaaccgttccgctaaaatcaagaccgtttccttttgtatttgtaactgtaatattagaattatcaaaaatgacattttgcttagcatatgatataaatatacctgaaccacttgtataattagaatcagaaaaattaattttagcattttcaaacctaacttctccttcagaagaagattcagaatatataccatatcctccgccgctcatatttaattcaccatttgtagcagaatcgctggatataaatccatcacctttcatgaaaacagatgctgccgcatttgaagatgtagcgatagtattctttatattattaacacccattaatattacttttgtattagccggcaaatttattattccgctcacttgaccaaatcttgcaacttccaaagctacttcaatatttgcattataaagtgtcaaagtatggcttccatctgtgttatcttcaaaatatattccatagtccttttgctgctgctctgtcaaagggttacttgaagtaaaatcaagtttcttctcgcactttactgtaccgggagtttttgcttctcctgccggttctttatcagaatttggatatgtaaatgtcactgctaaatcatgtatattgctgtcgcccaacgattcaaaatatccgctttcacgtacgtccgagtatttatatgcaaacgctggactgctttcgaatatacgtacttctactccaaaatcttctcctgttgacaactgttcttctgtatatgtctgtaccggatgtaatgttattgtctctttatcgaaatcttctaatgttactccatcctttaacctaaaataaaaactcatcaagtcaaatgaattaatcgctttcgataacggcgttgtccatcctgctgtcattcttactgcttttcttccttctatatccgcatgatataattcatttgctactgctgcgcctgcttttgctgctacttccagcgctcctgacactgttattctattatcttgatccggctctgtatataataaatcactgtattgatcatttgataaatcaccaatcgcatataccggctgtatcttagaatcgtcatagtttaatactgtctccaccatctgcaagtttgcaggagctgataaattacatactatcttatatatttgtttattatcagattccctaactcctgcttcctgccaatttagagcaacttccggcactgtcacgtcagccagctctgcttcactgctactgtctataatttcttcattgttttcttctgtttttattttatcaacactgtcagaaatatttgtatcagacaaattattatcagcaaatacaaaagtcggcgatacgctgaatatcatcgctatagccaataccaaacttaaaataccttttttacaattcatttttattcctccatagattttcatatttaccattcacgttatttatataatttaattattcataagcaacttattcagctatggcgcttctttgataattcgcgagtaaaatcgaaagatcagccgacgtaaccattccatcaccattaatatcgccaatatcaattgatttttgataatttccaagtagtattgaaagatcagacgaagtaacctttccatcactatttaaatctccgccgtttaaaaccacctcagatatatttacaatattagaatttgatattacaattgctgattttctataatttaaaaagtttaatttttgaatatttaatatataagaaccatattcaatattactgaatgtatatcttccgtcagaatctgtaaccgctgtataattattttctgaatttgaaagcgtaacactaactccctcatttgatttgtttccgtcaagtgttaccattcctgtcaactgtccgtcactgcccgtctgaactatatcgcctccgctccaaactgttccggaatacaaatattcaccggcttttgtccccaaatgttttgttgagtcagcaaatataaattcagtatcaaaattcaatttaactgaatccggtcctgatgttgcacttggtctgtatccatttgcctctctagttgtgacatcaagaaccgccccatcagatatcactactttggccggcgccgccgccgaacattcaggacttccggttatgtcagctgaaaaatcacaaccactgtcaactgtcacaacagctccggcatagagttcaaacttagccgccggacgttcaggatattcagtatttacaagatttttaacatcatggaattcgtcataaaatacaactgtgccgcgtttacccgtagttgttggagtttcctccctatatcctccgtttattgttaatgtagaagattctaaaagatttaactcagaaccggtcaaaaatttaaaatcatcattaatcacataatttccgttatgaagattaaatgtcattatcccgttaattggatataaataatcttttgtgcttaggtcagtgcctacaatattaagagagctatgacttgcctcagcaccgccataaatatcgattgtagaacgtcccgactctttatcaagagtttttataacataaccgccgtcatttattctaactaaaccattatttttatcaaactgcggaaatcttgttcgattatatcctccgcccgcatacatttttacggttcctgcatatgtagcacgcgaatcaattttaactggcacttgaatatttctgcattcatactcgttcataggatatattccttcgtcaagagtaatagttgccgcctggcttccgcctctccagctcttaacaacatataaatcatagactgtagacgacgcgtttgcatttacttgtccatttcctgaaatatatccgcagcagtcaagcattccatatgcaccgacctcaattgtgccgtccaatattatctcggcatatcctgctgaaatattttggtcaaagttgccgcctcccgggcgtccaaccactgagtttattaaaaccttgcctaagatattcatcgttacattttgaggtatagtaagcgtgcaatattttgactcttttccagccacatcagttccgtccggacaaaagcctgtttctgtatcataaccggtatcaccgtccatacaagacaataaaaggaacactcctgatggtacagtaatgtcccgggtaagttcataatcttttaatagaacaacggtatcgccgcttacagcaccgtcaagtgcttcttccaatgtattatatcctgttccgtttctctgagctatcgtatcggcttctgtctgtgccaacacaacttccggtaaatccaaagtactcctgttaagctcgtctgaaccagcaatttctattgttatatcattactgtcggcggacaaaagcatggcacccgaaaaatccggatctgaaaaatatacattaggttcgttagcttcattaaactcagtttctgcaaaagaaaaagtacaaaaagaaaacgaaaaaaatattgataaaaataaaatactaaaacgtaattttgacataaaattcctctccctaaatacaaatatgacataaaattattatatagacatattttatcataaaaattacataaatctctatgttatatttataacacaaactataaccacaataaaaacataatattttttaataaaaaacagttccaagagtattcttggaactgaaaataaaacttatatttttactcattaaaattattttaaaataaactgtatgatacttaaaaataacctataatagtattttgctatttatcaagtccctgcatatactcatccatggcgtcggctactaattttgaatattttaccgcttcaacaactgtttttgctccttttacaacatctccggaagcaaatatcccctctctggttgtttcaccgtattcatttgtaaccaaaagaccctttttgtttgtatctatacctttggttctcgaaaggatttggtcttgagcgccttgactgattgatataattactgaggtagaaggatataatttttcgcttccttcaacttcttctattgaaccgtcttcgtttactacagagtctttaaaaataacaccgtccggctttatctctaccggaatcttacaaaattcaaaatcaactccgtcaaactttgcatattcatattcaaggtcgcttgcggcaactttatcacttctgttaaacaccgtaacatttcgaacacccttgcggatagctgttctggcaacatccatcgccgcatttccggctccgatgattataagattatcaccgagattgtactcgtcaggattaattaaataagctattgcatagtgtacgtttcctaaactttcacctttgattctaagactattcggtttccaaacaccggttcctataaataatgcgtcatatccgtctctaaatatatcttcaatacttatagcccctccaatagtagcgtttggccttatttttataccaagctcgagcataagtgatttatatttttcaagaatagtttttggaagtctgaattcaggaattccgtacctaagaactccgcctattttatctttagactcaaaaattgttacatcgtaacctcttcttgcaagttctatggcgatcgtaattcccgcaggacctgaaccaactattccaaccattttaccattgctctctggtttctcaaatttgagacggtcaagataagtagtggaaatataattttcaatactgctaatatgcacaggatttccttttcttccaagcacacaatggccctgacactgtttttcatgcgaacataccaaagaacaaacaactgataacggattgttatcaaaaagcatttctcctgcctcttccatctcaccattcaaaaacatttgtatcatctttggaatttcagtgcttatcggacatccttccatacacattggctttttacaattcagacagcgtctcgcttcgctaactacatttaatgccaattcaaacacctccaatttatatttttatcctactatataacaagttaaaaagtcaatttaaaattcattttataacaataaattatttaaatataacaaaatattcaatttgtcataaaattaacattctcatttgataaaatctatagcaaaggcgctatcaaccttataaccctgcccaatattctagtaaccaagcttctatttttaatcgtatcttcagtaacttcttcacataaactcagcgtatgaacaaaatcactttccatatctttaatctgaggcacatcaaccaaataagccgcacactcataatgaagataaaggcttctataatcatgattaatggttccgattatagcacgcttatcatctgaaattgacatttttgagtgaacaaatccaggcgtatattcatatattttaactcctgctcccaaaagttctctgtaataagttcctgcaagccaaaaagcataaggcttgtccggtatatgagggaggattatcttaacatcaacgccgcgttttgccgcaaactttaatgcctgcatcatattggtacccagaacaagataaggcgtcattatgtgaacataatctttggcaagattaagattattaatatacatagtttcaccaaatctgtcctttttcagagggctgtccgcaaacggtataatatatccctctccctctttaaaatcaccatcagaagcagaatttatatatttatcataattatcttccttaactttattaattgaagtattccacatctgaagaaacatggaagtatatcctgataccgcgtcacctgttatttttatcgcgttatctttccaatggccgaatctttctctttcatttatgtactcatcggcaaagttaacgcctcctgtataaacggttttaccatctattaagataatttttctgtgatccctattattttgatatgttgaaaaaaaaggaactataggcgcaaacactcggcagtttataccaaattttctaatcgtatcatcataatcatttggcagaagagacatacatcccattccgtcatacattaatctaacttctacgccctccttagctttttctttcaatatttctaaaatttcaggccacattctgccgtttaaatttattataaacatttctataaaaataaacttttcagctttccttagttcatcttttaaatcaataaacatttggtcacccaaagaaaaatactctgccgacgaatttttatataccggaaacccggaataatcatatatatattttgatatacctatatcctcttgataagtttcagaaaatttttgtaagacatcagtctcctgttttgtatatttaagagtacggcctcttatttcgtcactgtgaacagcaattttttttgaggctctgttataatgcagaaatatataaagcaaagttccgaaaattggtataatagcaataagcattacccatgtcagtttaaaccccggttcttcttctctgttaatttcatatataatcaatacagcgctcagaaaattcataaaagtataaaaatatttagaataatcaccaagccaagcgctgagcaataaaagcacagaaagctgtgctatcatcataagaaggcaaaacaatttattagaatatattattttaaaaaaacgagtcatcatatcaccccaaacctaaaataaaattggcgtataaatcaaaaaaatgaaataaaacctgtaattattaaactatttaaaaagtcaataaacaacgctccaactatcggaacaactaaaaaagcctggggcgacggagcatatttatctactatagactgcatattcgccatagcattaggagtggctcccataccaaatccgcatgctcctgctgtcatcacagcagcgtcataatccttgcccatatacttaaaaattacaaaacgagaaaataacatcatcaaaataagctgggaagcgagcagaatcaacattggcagcgctaaatttgataaagtccatagttctaatgtcatcaatgccatcgataaaaagaaagacaatgaagcttcgcctatttcctgaatttccataaaataaactttaaacttccctgtgaaatcagaatagtttctaattgcagctgccacaagcattgcgcctatataggaaggaaactttaatcctgtcaatttcaaaacatatgaaaccaaagtaccaagtcccatagcaattacaatctgataaaaaccatatgaaaatccgctggctataaactccttaaacccggaaaccgagtcctcgatatcagggtcatccaatctatgttctacttctttatagagatttttcttttcaatcaatcttttagctattggtccgcctatggcgctgccagcaaccaaaccaaaggttgctgaagcaattgccacagatgtggctccgtcaacgcccatagcttttatagtgggaccaaaagcgccggcgcttccatggccgccaaccatgggtatggatcctgtacatagagaaagcaaaggcggaacattcaataatttacctattcccagagcgataatgttctggcagataattaaacaagcaataagaacaaggaatataaatatatgctttccgccttgttttaatggctttattgaagcattataaccaaccgtagtaaagaatgcaatcataaaaaaatcttgcaatgtggtgttaaagttaatatataaccagccaaactcatgacatataaaaactaatacagaaaaaatcagaccaccgataaccggagatggtatgcagtatttttgaaaaaaatgtattcgtctttttacaaactttccaaagaacaatagaccagtagccagcgctaatgactgaatcatatctaaatatattgtcatttactgcaactccttcttaaatgtctcataatcgtctttattcttaggaacaattatttcatcagaaattattttttgttttatgttctgtgttttttcatacaactcatctgaataattgtcatggtttgacggtatatctacagaaccattttccaatccaaaatagtatgtgtttttattgctgtttttaaaattatttttaattatatcctcagatacatattttgcaattgctctgcaatgtttcagcgcagacgtaagaacatttttgggcgcaatctcactctgatctacatcaacgccgataacccacctgtcattttgaaccgcagattcaataactccaagtccggcagctcctgcggcctgataaatcacatcattaccggctttatacatttcatcgccgattgaaaaagcttttgctaaatccacataagaaccaacatattcagaagatatattaatattagtttttctttctttagccgcaaactcaacaccggctttatagccatattcaaatgttgctatattatcgtcatttattccgcctacaaatcctacttgatttgtattagtggtcatccctgcaatatatcccacaagaaatgatgattcctcagttctgaacacaacgccgaacagatttgttgttttatcatcagagggactgtcaagtacaacatatttagattttgtattaaactccgcagctttttttgcatcatcaaaaaaataagccccgcaagcccatactaaggaaccattttcaccggcaaagtccagcttatttaaaaaatcactttcatttttacatgtcaaactttcaaaattaaaattattatcaccgcaaaaatcgtttactccgctttttgtttcttcaagaaaactatccttttcaactgaatccactactatatatatattatttcttccactctttgtatttccacaggcggataataatattgtcaccacaattacagacaatacactaaaaaacacactaaattttttcatattatcccccttaaaataacacatcaattattatttttagtatatcataatcacataaatttgtcaaagaaatcatataaaatttgtttatattttcaaataaaaaaacgcccttaaagggcgaaagtttatatatctaaatttgcataagcattgagcgacaagtcggcaatatttccattttgatactcataaaaacctgcgcatcctatcattgcagcattgtctgtacagaggataggcctagggtaacaaaactcaaattttttctcagcagctttgtcacttatagtttcccgtaacggaatattagacgccactcctccggccaatgcgacacggtcaacacaatactgctcagccgcttttataaggtgatccgacaatacgtcaactactgcttgctgaaatgaagctgctatgtcgtttttatttatctcaatccctttttgctcagcattatgtatataatttaatactgatgttttcactccgctgaaactgaagtcaaatccattacttcccatattaacacgcggaaaatttattgcatatttatttccggattcggcagctttttgtatctgaggtcctccgggatagccaaaacctaaaacgcgcgacactttatcaaaagcttctcctgccgcatcatcattggtttttgctataacatcatattcaaaatatgatttaacataaataatatggctatgaccgccggacgctaccaaacaaataaaaggaggcttaaaatcaggattttccaaataatttgcgcatatatgccctttaatatgatgaaccggaatcagcggcttatccagcgaatagcttaaccccttagcatatgacacgccaacaagcagcgctcccacaagccccgggccatatgtgaccgcaacagcgtcaatatcctcaaaagtcagattgcagtcatcaagcgctttatcaacaacagcgcttatgttttcaatatgttttcttgaggcgatttcgggcaccacaccaccatatagtttgtgcaattcaatctgagtatttataacgttagataaaatattagttccgtcttcaactacagctgccgcagtttcatcacatgaactctctatagctaatattttcataatttaccaccttctataaatcctttgtcattaatatagcgtcagaattatctttataatatttttttctttgaccaactgatacaaatcccattttttcatataacgatatagctgcaatatttgttgattttacttctaagtttatatacttgcatttattttttttagatttctctattatataatatagtatagttttaccgattccctgtctccaaaactcaggagagacagcaatattagttatctcagcaaaatccgcaatgaaccaaacacagcaatatcctagaatagcttcttcgtcgtttgacaaagcaacaataaatgaagaaattttgttctttacttcactttcaaacattaatcttgtccatgaatctcccaggaaacatttttcctcaatcttaagaagcctgtcaatatgactttcatccataggtttaaatatcatatccataactattcattagcctttatacgtaatataagtttttcaatcaaggattttatatcaatcatacagctcttataaagattcaaatctccgccaaaaggatcagatacgtcacttttctctccaacaaattccgcaatcgtataaaccttattttttaaatcaggaaattcatttattatcgccgacttatgtgacgatgacattgtcaaaactaaatcagcgtcacttattaactgaaaatccaactgtttgggctgatgttttgaaatatctatgttttcaacactcaaagcgtccactgagttttttgacacttttgaacacggcaatacatagataccggcagaacttgctctaacattcaaattttcattttcagccatactgttaaatattccttcagccataggacttcggcaggtatttccggtgcaaacaaataaaatattatgaatatcttttatttcagattttatattaggattaattctagattttttaaaataatcttttgtgtcaactattctatttccggcagctctgtataatctgtttctaacaccgctccatttatcagtacttgggatttcaggagcaaaaactctcttcacgccacggttgtccatttcccttaaagctttaaataaagaacttgccgcttctttcggagacttcatactcccaagcgagataatctcgatattgggactaatttttttatttagttctgaagaaaactcgtcaaatattagaataccgcatctgtctttctgaccgtttacgcaattcactacttcctcaaccgaacctttaacaatgataacctctgcttttggagaatagtgcttatatttaagacctggagatttgggcttttcattttcttttacttccgatactgttttaactttacaattcagtatctgttcaatttgttcagccgtaacatcacccggtctgtatataataggttcacctgataaatctataaccgtggactcaataccaacattacagtcgccgccgtcaattattgcatcaacccttccgttcatatcgtctacacaatgtgcaaacgctgtgggacttggtttgcctgacaaattagcgctgggcgcggcaatcggaactcctgaaagttctaaaagtctctttgcttcaggctgtactggcattcttacacctacggtatcaagtccggccgttacttcattcctaattttgttgcttttctttaagataattgtaagcggtcccggccaaaatttattcattagttttttagccgattccggaacttcacttactatctcgttcaactgcttaacatcataaatatgaacaataagcggattgtcagccggcctgccttttgccgtaaatattttttttactgcatcaggatttaacgcgtcagcgcccagcccgtatactgtttcggtcgggaaaacaacagttcctcccgaccgaattatctcagctgcaatattcaaatcattctcactatttgataataatttagtttccataaacaacacctgaattaattatatatttccctcagcttgagacttcagcttttcactttggtcagttgtaatcaaagcgtcaataatctcatctaaatcaccgttcattatctgttccagtctatacaaagtcaaaccaatacgatggtctgtcattctgccctgcggaaaattatatgttctgatacgttcgcttctgtcaccggttccaacttggctctttctgtcagcagctatagcggcgctccgctcctgctccattttatcatatagtcttgaacgaagcattttcattgccgcttccctatttttatgctggcttctttcatcctggcatgtaaccactattcctgtaggtttgtgagtaattcttatcgctgattcagtcttgttgatgtgctgaccgccggcgccgctcgaacgataagtatcaatttccaaatcatccgggtttatctcaacctctacatcatcaacttcaggcagaacagcaaccgtaacggttgaagtatgaattctgccgctcgattcagtttcgggcactctttgaaccctatgaactccgctttcaaacttaagccggctgtaggctccttcaccattaatcataaacgttacttctttaatgccgccgattcctatttcacttatattcaaaacttctattttccactttttactgtccgcatacattgaatacattctgaaaaggtctccagcaaacagtgccgcttcatctccgccggcaccgcctcttatttcaaccataacgtttttatcatcattaggatcttttggaagaagcaatatctttaattcttcttcaattttttcaatattggctttagctgtttttgattcatcaacaagcatctctttaaattctttatctgtatcagggtcatccattaatgcgttagcgtcttcaattgtttccatattttttttatattctctgtacttttcaacaattggagtaaggtcggaatgttccttacataatttacgccaagtctcctggtccgcgatgacctccgggtcacttatcttttttgccagctcttcaaactgttcttctaaaaatgatagtttttcaaacatcttattctcctcatagttttaattatatctcaccttttgattttgctttaagatacgcgttaataaatccgtcaatatcaccgttcataacagcgtttatattacctgtctcatagtttgttctatggtccttaaccatgctgtaaggatgaaaaacgtatgaacggatttgatttccccatgcaatttctgtctgtacaccctttaaatcgtcaattttgtctttctgttccctctcagcaatctcgacaagctttgattttaaaactttcatagcagtttctttatttttatgctggcttctttcattctgacatgtgaccacaatacctgtcggcaaatgtgttattcttatagcggattcagttttatttatatgctgaccgccggcgccgctggagcgataggtatctattctcaaatcctcaggatttatctctacgtccaactcctcgtcaagttccggtattacttcacaggaagcaaaagaagtatgacgtctggcggctgaatcgaaaggtgaaattctaacaaggcgatggacgcccttttcagattttatatatccatacgcattcagtccctcaatagaaaatgtcacgctttttataccggcttcttcaccgtcaagataatcaattacctcggttttaaaaccttttctctccgcccacatattgtacattctatatagcatttcgcaccaatcctgggcttcagttccgcctgctcccgaatggagagtaataatagcgcttaatttatcatatttaccggagagcagtgtatcaagcttcatattgtctattttttcctgaagctcgctatatccggactttacttcacccaatacgctgtcgtcattctcttcaattcccagttccacgagggtagaaacatcctcccactggtttttaatatcattaaaaccctgaaccttgtttttcagcgattttattttctgcagtatctttccggctttatccatatcttcatagaaacccggctcaaaagatactttttcaagttctcctatttcacattcaactgcggacaagttaaagtgaatccctcaattcagtaatatctttttccatgctctcgagccctaacttaaactcatcaaacgctatcactttatcacctcaataaaatttatttatatagatatatagttatatatttccattatcacggtccttatcaagacagcagttcttatactttttacctgaaccgcatgggcaaggatcgtttctgcctatctttgtaacccttcttatcggcttctttttaacagttccatctccgcctgcattttcagcaatcggttttgctacctgctgtctctctatctttgactgaggtattacatggaacaaatgctttattgtatcctctttaatggattctgtcatctcttcaaacatatccatagcttcaaacttatattcgattacagggtcatgctgagcatatgcgcgcaggaaaataccctgacgaagctgttccatattatcaatatgatccatccacttctggtcaacaacacggagcaatattatacgctcaacttcacgcatagcgtcgccgaacatttcttctttctcagcatattttttctcggcatcttccattacgtaatcagtcagtctgtcctgagtcattttgtcaatttcaacatcagtgaatttcaggaaatcttccggcatttcaccaagtatggtttcaagatggtcttttaagccttcccaatcccattcttcaggagtatttcccttgtcgcctatatatagaccaattacaccactgaatacgtccttcatcattttcatgatgctgtctcttaaatcttcgccgtctaaaacttggtcacgctgtttgtaaataatctctctctgctgattatttacatcgtcaaactgaaggacattttttctgatatcaaagttctttccctcaactcgctcctgagcagtttcaatagctccgctgagcattttgctctcaatcgcgtcatcgtcttcaagtcccagcgtattcataactttagaaatacgctccggcgcgaacaagcgcattaggtcatcttcaagtgaaatataaaatttagatttacctatatctccctgacgtcctgaacggccgcgaagctggttatcaatacgcctgctttcgtgtctttcagtacccataatatttaaaccgccggcttcaagaacttccttttgctccggttctatttcagatttaaatctatcgtttaattctttaaatgttttgcgcgcttctataatttcctggtcgtctgtttcggcaaaaccagttgcctggttaataagctcctctgaaaatcccatcttttccatctcatgcttagccataaactcagcatttccgcccagtacaatatccgtaccacgtccggccatattcgtagcgattgttactgctccttttttaccggcctgtgcaactatttctgcctctttatcatggaacttagcatttaagacattatgttttattccgcgctttctgagcattttactaagcttttcggatttttcgattgacaccgtacctattagtacaggctgacccttttcgtgagccgcagccgcatcatttataacggcattaaacttagcgtcttctgttttataaacgctgtcatgctcatcttccctttgcagaggcctgtttgtcggtataacaataacatcaagcttatatatttcctggaactcttcttcctctgtctgtgccgtaccggtcatacctgataatttcttatataatctgaaataattctggaaagtaatagtagccaatgtttttgactcattttctacagttacgccttcctttgcttcaatagcctgatgcaaaccgtcattatatctcctgccgaacatcatacgtcctgtgaactcatctactataataacttctccgtcttttacaacatagtccttatcctttttcattacaccaatagctttgatagcctggttaatatgatgagacaaagtcatatttgccgggtcggttaaattttcaacatgaaaagcttcttctgcctttttaacgcctctaggcgtcagcattgcagttttagctttctcatctacaatataatcatattcgttaagttcatcttcgtcttctacctcaacctttgagtctgtttcaactacctttttgaattttaaagtctttgcaaacctgtccgcttgagcatacaaatcagttgacttatcacccattcctgaaataatcaacggcgttctggcttcatcaattaatatgctgtcaacctcatcgacaattgcataattatgtcctctttgaaccttattctctttatatatcaccatgttatcacgcaaatagtcaaagcccatttcgttatttgttccataggtaatatcagccgaataagctctcttacgctcagcattgtccatatcatgaataattaagccaacgcttagccctagaaagctatatagttttcccatccactcactgtcacgctttgccaaatagtcattgaccgttacaatatgaacgcctttgccttcaagagcgtttaaataggccgggagagtagcaaccaaagtttttccttcacccgttttcatttcagctattctgccttggtgaagaacaacgccgccgacaacttgaacagggaaatgcttcattcccaaaactctccaggcagcttcacggcaaaccgcaaaggcttcaggaagaatgtcatcaagtgtttctccgttacttaaacgttttttaaaaacttcagtcatagctttaagttcagtatcgctctttttttccataacaggttcttgttcgaggaccttatcaacaataggatagatttttttcaattccctgtcgctgtatgttcctattactttctcaattatcccttttatacccataaaggatacctccaaaatctcatattattttcaaaattaatataataaatctataatttatactttgtaatttccataccatttatgttatatgttaaacaaactgtttctaaatttaaacacatactggtatattataactccaaacaaattttattgcaagagttttgttacactaaataaaagttcgtaggcttatatatttaaataatgtaactatatgattaaaaactgcaaacaaaaagcaggcattcacccataaaatttggcgtgtatacctgcgtaaattatatatttagaaaatttatacatattttctgtacacaaataataacacggccaaataaaattatataaccgtattatctattgttttatctgctctatcgcattcaaagtgtttgtaacaagaagttcaggcagtgcagaaccatctactttccagcttccgccctcttttttcatatttacatcaatagttttcgtaacattaggaactccgccgttatccagcacatttgcaagctggtcgtccataagtttttgataatcctcttttgtcattgtagcaagattattctgatattccggacttgagaccatcgcagcaatattttctatatatttctgcattacttgagacgcgtcaataagagtaatatctgcattaacaacagccttttttgcacttgacgcagtaacagaattaatatcatacgtcacattctttaacgatgacagaattgcagctcttaaatcagtattatcatttatctcaactgaatcacagtagttttttatctgctcaacattaccggatttaaatgcctccatggtttctgaaaaagcttgttcagcttcctgtcttgcctcttcagtgtttccgccgcatgatgtcaaagcgccgataattaatatcaaactcaaaagcaaagcagtacaggaaaaaaactttctcaccattatctttcccatttcatcactcctaacaatttataactatgattatacactaaaatattaaaatgtcaacattttatatgaataaaaaaaggatacccaaaacaggtatcctgaaataaacactttacttataaataaaatattaatccactatgtctatttttctactccgcagtacatttttgttgccggtctattttgaatttgatccaaggcttctccaaatctttggaaatgcactatttccctttgacgcaggaattttataacatcgtttacatcagggtcgtctgatactttcaaaatattatcatacacaacccttgctttttgctcagcagccaaatcctcggttaagtctcctataggatcgcctgttgaagctatagccattgcatcaaatgggactcctgtagcatcagccggataaactgaccttccgtgattcatgaaataagcgcctaaaggactgttagcaatttctttatcacttgcatttttagctaactgtctcaccagggttccaacaatttctaagtgtgcaagctcctcggttccaatatccgtaagcaaagcctttgtcataccgtttggcatagcaaaacgctgtgataaatatctgagcgaagctgcaagttcgccattaggaccgcctaattgtattatataataaatcttatataaatctttatccttcttttattcttagttgtctgcttctttcgggcaatctattattatattgttttccacagctgcaaataatatgaaacgcataatttactactttatttctatctatgtaaaacagctcctttttacaccgtctgcaaacagccactccatttataatatctatataataattttctgttgtatcaggattgccttcttctgtcctataaacaacctcagctccgcatttacataaataaactaaaaacaaatatttataatctctcaatattattcgtcctaaacgttcgccgcattgcgtacaaaaaacttgaccataattttgtcttccgattctaatattacgtctgtatgcttccctatgcaaatatatcactcccaaaaaactatatgtaatacctattttaaatatccttctttgtcttttattattaaactgacaaaatataggatattttatcaaaattctcaacatttcaaaaggaaatgtattgctcaaattatatattttgtaactaaattttactgcaatttttagaaattgatatatctattttatataatatactcattttataatttcaacttatttttttgcaataaacactaataatatatatattataattagttctatttatccactattcactttatattattattttttatatacgtattatattcgggtttccaaactgctttctgtaatccattgctcacgtattcagaaagaggacaggcaatatgttcaataaaatctatactataatcatatggtttagtactgccatcagataatattactgatgaacttgcagaccatggctttatattccatttttttctgtttgaaatatcattattttttattccattttctttcataaaaccacctctgttaaaaaatatacttataactgcttatccaatataactctaaaatctatatttttataaaaaacaaatttataaagttcatattaacttaattaaatacaatattttttacagaaatataagctctaatctgaatttttgtgttatctaaaatggattttttatatattttttaatttattatgattgctagatacaaaaccgtcatattctttatagtgtacttgtatatattatttgaataatcacaattttctttttattatatctaacagaatactatgaatcaggtgaaattatgaaaacagcagcttgctatattcgagtatcaactgaagaccaattggagttttccccagacgctcagcttcgggctatgagaaagtattgtgacgaaaactacttattgctgccggatgagtttatttatattgatgaaggaatcagcggccgcaatgcaaaaaaacgccctgcatttcaaaatatgataaaaaaggctaaatcaaccccaaaaccatttgatgtaattttagtacataaattcgaccgctttgccagaaatcgagaagacagtgttgtatataaatctttattaaggtctgagctaggcattcaggtattatcaataacagaaaatatcggcgatgacaaaatgagtgtaattatagagtcaatgcttgaagccatggctgaatattattctctcaatctttctgacgaagtaaaaaaggggatgagcgaaaaagcgaaaaaaggcggcgtacaaacaaaaccatctttcggatatacggttgttgacaataatttttcacctattgctgaagaagctgttatagtaaaaaatatatttcaaagatttgtttcgggtgagtcattcggacaaattgcagctcgtttaaattcacttgggttacgcactaaacttggaaatccttttaggaaaagaactatcgaatatataatatccaatccagtatataccggaactttaagatggactcataaccgaaaatccgaaaatattaatgacactatttatttagaaaatcaacatgaacctattgttgaaaaagacttatggattaaggcacagaaacgttataataaaataaaaactattaaccgcaaacatttgaaagaccaagctgacaagtcatactggctcagcggtctgttggtttgcggcagctgcggctgtacactcgcacgaagcggagattatttgcagtgctgcggatatattaagtccgcttgcaatgtctcacattcaataagtataaaaactgctgaaaaaatagttatagaacaattgaaagcagactgtttaaaagcagaatcagctcagataataaaaaacgcaaatacaaaaaataatgatgaagtattgttatataaaaaagctgaaaaacgcttaaaaaaatcattagacagagctaaagaagcatatctctcgggaacagacactttagaagaatatagtaaaaacaaaataaaactgcaaaacgaacttaaagaaatacaaaataattcaatttgcgatatagcagataatcataaatatattaaacagacaaaagatattttagattttattcaggataaagatatttcagacgacgataaaaataacgcattaaaacaaattgttgcaaaaataatttatattaaaccggaaaagcatctagaaattatatattattaatttattataaaaagcaattaggaccgccgtattggcttacaatatagttagcaaggctaggattcgtagtttttatatttactggatattgtaattttttttgataattccacatatattcttccctccagattatgtgttaagttaaacaattatttttataaaagtaattaaataaatattgtcattggcttttttgtcatgcctgaatatagttatcaaacattatcccacggccatggttcttcaatccaatcaaaacattctgtgttagtcacattcatagtagttaaaggaccaaacttttcctcaaactctttacttaattcctttgccttatcagccattcttctgtgcatcataaggccatctctatcatttggatgagtatccaaatataggttccattctttttccgcaaagctataggcggataatttttttaataactcttctctcgcattcatattacattcctccgtttttaaaaattatgtcgccttttgtttgctttccatacacacccataggtttatttaaaatagggaatatagttccttccttaagaccgtactcaggatcaaacaaatttctcatttcggcctgctgcataggcacataggcatagccaacaagcggcatttcaagaggcacggtttcatttgcaaatggcataaaatcattcctttcaaattagttggctcgaataattaattaatattttgtttcgtcaaaaattgacatctcaagcctgatatattatatgattatataagtaatttgtgctagaagcctttaaggaatatattatttacatatacaaataccggcaagatagtatttgggagattaattcaaaacagttcactaagattgtggtaaaagctataataaaaaatcagtatataaaaaacactgtaaccaattaaaatttgattacagtgtcttttaatatcatactatttttataagacggtatcttaaccgtttatccagctattttatatcattttttaagaattcgcgtattgccttttcaaccatatcaacctcttttttaaactcatttgccgacaccctatatgcaccgttcccaaggattattaactgttccagtccgtcagaagtcgctactctaactctatgttttttacttagctgatgagataccttctcaatatacatatcggcagtttccttttctttggtataaacaatatttatattgtgatatttttcaatttcgcccgggttatttttgaccttataagcgtcaaacactaatattacctgacacttgcaaaatccctgatagttacacaaaatatttataagcttgtgcctagccatatctaaattttcatcagcatattctttcaaattatcccaagcatatataatattgtatccgtcaactaatagataatcctctccctgttcttttttaggtttattctttatcggcttattgttgttaacatgagacttttttgtatataacgcagaataggtatcccgttttataggtccgtaagtgttttcaaatattttcattaattctttatcagttacaacactgctgatatattctgatgtccttttctctgaaacatcaatttctttttgtaaaccatctatatcaaaaccactgtcaacatgcatataatcccgaacttcattccatttcacaacaaatcccgctccatgagaacaaaatacagaatcagcagtattttcaatatctctttcactgtcatatccgattttttcaatgacttcatcggaattattacatggctcatagccgtttggcaaacatgtaagtcttcctctgccttttgtatacatactgacttcactttgataatccatcatcccggacaccggcgcagatcctgaaattactgtcatatcaacgccattattctccggctgtgaaaatcttcctcccatctgctgtatatccgtcattgctctgcctatcgaatcagtcggaacttctaatttaaactcataccaaggttccaggagaatgttcttagtcatttttaagccctgtctgacagccctatacgttgcctgcctgaaatctccgccttcagtatgtttttgatgagcccgtccggccactagtgtaatttttatatcagtgattggggaaccggttaatacacctatatgagtcttttcttttaaatgcgtcataatcagtttttgccaatttttatccagtttatcttcattgcacttattataatactttattccgctgccccgctttcccggctgaagaagcaaatgcacctctgcataatgtctgagaggttcataatgaccaacgccttcagtctgttccgcaattgtttcacgatacgctatatttcctcttacaaagtcaattttcattccaaatctgtcaaaaactatttgcttcaaaacctcaagctgtacctcgcccataagttgtatgtgtatttcctgaagctgttcattccacataacataaagctgcggctcttcttcttcgatctttctcaagtttgaaagagcgttatgcaagtcaatatcagaaagcaattcaactttataagaaagaacaggcgttaatagagcagattgagaattctcttcatctcccagcccctctcccggataagtgtttccaagaccggtcacagcgcagattgttccggccttaacttgttcagctgcatgaaactttgttcctgaatatatccttatttggtccactttttctgaccagttttctccatcagatgttgttccgtccagaagctgctttacctttaaagttccgcctgtaatttttaaatgagttaaacggttaccgttgccgtcgtctgatattttaaaaacttttgccgcaaaatcacttttataatttatactttttgtatacttatctaatcctcttaaaaactcatccacaccactcagcttaagcgctgatccaaagaaacatggaaaaacacagcgttctgatatagcctcctgaatatcagattccttaatttctcccatatttagatactgctccattaatttctcactgcacattgctatattgtcataaaaagcttctgagccaaaatcagacgagaaatcaacacagccatcgtccagtttatctcttaaattcagaattatatctctatggctgctttcagcaatatccatcttattaataaacaaaaaacatggtatttcgtatcttttaagcagcttccacaaggtttctgtatgactttgaaccccctcagagccgctgattactaaaatagcataatcaagaacctgaagggttctttccatctcggttgaaaagtccacatgcccaggggtatcaagcagggtgaattcagtatcattaatgttaaatacggcttgcttaagaaaaatagttattcctctgtcacgctcaatcgggtgtgtatccaaaaatgcattgcgatgatcaacccgtcctaattttcttatttcgcccgcctgatataataggccttctgaaagcgtagttttacctgaatctacatgagccacaatgccaattgcaatttttttcatatactctcctaccttgaaactttgaataatagctattttaaatcactgactttggaaagagaaatattatattgcttgccgcaatcacatataacatgaaagccacaattaatgatttttcttttatcaatataaaataattcttttccacagcgccggcacgatgcaataccatttttaagctctataaaataattttgcgtattatccggattttcatactttgtttgatatacaacttcacatccgcatttgcatataaacacaagatataaatatttatagtctttactaattacatgtccaatccgttctccgcattgagtacaaaagatttgtccatagttttgtctgcccattctaatattacgtttatatgcttctctgtgcaatttaaatcctcctaaataatacaaaaatatttgtttaaataacacaatcttttaccttgtctaacacattaacttgaattatacttaaaaagtcagttatttatattttatttttatttgaaaggcagattaatatgaaaaagcccattggttttactttgaatttccaggcgcagaaatgtgacgatattgttgaatatattcacattcagaatgataacgctgatgatatatcaaatatacatattgaaaacggatgctgtacagacatttatatggaagacttgtatttcaaaaatacaatatttgagaactgtacgtttataaattgtaatcttaaagactgcagctttaataatgttaaattttataaatgcctgtttaaaaattcaaatttatcaaacggatggtataaacaatgctcttttgaaaactcacaatatataagcaccgattttaaaaacagtaattttaataacgcctgtctttatcaaacaacaaccaaatattctaactttaaccgttccgtctttaacaacatcataataaacgactgcgatatgtcagacacttttttctcagattgttcatttaagaatacggagataaaagagtctaaatttgtgcgcactgaattctttcaaaccagtcttgcggggctggacttttcaaattcaatacttgaaagtatcattatgtcagacaatgcaaaggaattatccggagctaaagttaacagttatcaagcagcagagctgtcaaaactgcttggattgattgttgttgactgatacattaataatattatttatatatattattttaaaacattttcccattccttttctttaaagcctattaaaaccttatcatcttttataacaagagggcgttttacaagcataccgtctgttgacaaaagttttaactgttcttcttcagacatatcatttaacttatcttttaatcccatagaacggtacagcattccgctggtgttgaaaaacttttttagctccaatccgctcatatcataccattcttttaattcatcaaaacttggattattttcttttatatcccgaacagtaaaattaactccattttcattaagccatttctctgcctttttacatgttgaacattttggatagcaaataaattttatcataactctgttatacctttctttagtttctatatttttataaaatacttttttatctaataaaccttcaatctctcacatataaaactaataaataatattttaccatacatattaaaaaatgcaagataaatattagaatatatcgcactataccaacataaaattacttcaggaggtgcgacaaaatgaggatatggttcgtcggtaaaaaaactggtatcgccttgggcgctatcgtaattctattttttgcattaattttatttggacatatcaataaaaattctgcagccataagcgctgcaagccctagcgaccgagacttaccaatatactgcgttgaaaaagatgaaaatgacaaaaaaattgccatttcatttgatgctgcctgggataactctgatacggaaacacttaagaacattcttggagaaagaaatgttaaaactactttttttgttgttggcgattgggtggataaatatcctgattctgtaaaatccttatcagacgcaggacacgaggttatgaatcattcatcaaaacatccgcatatgactcaaatatcaaccgacaaaatgaaagctgaacttgacgactgtgcaaacaaaatcgaggcaataacaggcagaagaccaaatctcttcagaccgccatacggagactacaataatgaagttgttaaaacagctagagagtgcggctattacacaatccaatggagtattgacagccttgactggaaagatttaagcgctgatgaaatatataaaagagtagttcctaaagttaaaccgggcgctattgtattattccataatgcggctaagcacacgccggaagcactgcctaaaattttagatgacttaatagcacaaggttatgaaatagttcctatatcggaattaataataaaagataattatcaaattgatgcaaacggaatgcagtacagcacaaataatgaaaaatcggaggtcaacaacaatgtctgaaagcacattcaccgaaagcagctactatgacaataatattgtcacactggtgggaaaaataatttcaccgcctgaactgtcacatgaaatctacggagaaaaatactattctactcagctggccgtcagcaggctcagtgaaaaaatggactatatacccataactatatcagaacgcctattcggtgaatattatcctacacctaacgaccatgttaagattataggtcaataccgttcttataataattattccggcgtcggaaacaggcttatattaacagtttttgttaaagaaatactttatatttcagaagctgacgaagaagattttgaaaagtcaaaatctatgtccaacgtaaacccaaatcaaatatacttaaacgggtttatttgcaaagagccaacctatagaacaaccccatttaaccgcgaaatatctgacgtattgctcgccgtaaaccgttcatacaaaaaatctgattacataccgtgcatcgcatggggcagaaacgcaaaatatgtacagtcgctgtctgtgggtacaaatataaaagtttggggaagaatacagagccgggaatatcaaaaacatataagcgaaaccgaagtagtcaataaaaccgcatacgaagtttcaatctcaaaattagaaatagtagaatagaaaaagggtggctaaacagccaccctttgttgtcattttcatcacactcatcatatccactgacaaagctcaaaactctgcgtcctatatgctttagatttaacttccattgctgcccctgcagcaatcaacatctttcaaatatctaaatacatcgacgaaaacttcaaataatacttttcaaacaataattgccagcaatctgtgagttaattgacgcagccaagacatattaagcaatccgacttgtcaaaccatttgtttatttcaaactttttcggagccctcgcacttgctcaagcgaccaatagttaaataaacatatttacgagtccaaatactcatcctctacaagcgtgcttaactgttatgcttgctcgtattcatctattgagataaatacgagtgcgtcaatctgtgaatcaactgactcttcttgagtcatccacacatcgcatcacctccgtaacagccacttttataaatagccgtgctttgtgtttttaactccccatacgatttatcacagctttgttccgctataaagtttaattaataacgaaaagtttataaactaacataataataaatctttaacctttttatcaacttattaaaatctttcagcattacatttaaattcaagtatcaaaacaatttttataaaactattaaacacacatcatcaaaacttctctgcattgttagttaaaactttcatttttaaacttacatcctcatcataaactcggtaaaacttccagtttaaatgcgagtttgcggaaaccatataagagctataaaaaattcatttgctcttgttcctgataaatctatgagatcgataaataaagaaatataaaaatcattcaatctttttaagattttcctaatcagcattaatattaatttaaatttctaagtcagccatttagtaatacattaaactcaaaatattacaagacgcagccgacaaatagtttctaaaccaaagtccaaatcctcaaccaaaataatatattagatttgaattcaacttttcatttctcttctgaaaagtctgtgtttaaatttcatttcaatacataaacaaatacaaaagaaacaaaataataaacaaatgaaaatcttaaatcagctcattactataaaaatcatctttaaacagtttatcataccagtatcaaaatttgacttagtatgtgtgagcttttagattggtaagctttatatttacttcccttatcttggttttattatacacccgtattcctattttgtcaagatttttaataaaaaatattcaaaaattctaaggccaaaaatctacgttataccaccactttttagctctaaacagacatatgtatatttttataaaaaagaaaataaaattactgcaaaatactatatatatttctaaaaatccaaaaatattactgtattcttgccatataaaaataataatattttaaatcacaaaaataaatattaatatctaattaattgtgcaatataaacaataagtgagtaatataataaaacactatttaatcaaacaaaacaggaatataatcgtttattttcaaactaatttccgttaccatgctgtcaaaagcaataatttttactccggattcagatgctttcttcaaatcctttgaaaaagttaaatctgttcttatattaggtttaaaaaccttaacaccggacatttgtataatgaatacaacataagcgtcatatccgtctcttacagaatcacttaattccataagatgttttcttcctctctcggttggtgcgtccggaaacatcgctgtaccattttcttcaagcgtaaccccttttgtctcaacaaatatttttttgccgtctgcttcaatataaaaatcaaaccttgacgttccatattttgtctccggttttactaacttaatatcattaaataatttgttttcgttaagccattcattaaaaaccttattgggagcttgactgtctatatttatcaaattgtcacccttatatacagaaatcaaatcatacttagtctttcggttaggatttgaagatacctccaaaaaaacagatgcgccgggaacaagcagctcccgacaccttcctgtatttttcacatgacacatctgttcagctccgtcaacatcgacaattgcaataaatctatttggtcttgaaacaaacctgcctgatacaacattattatatatcactatatattcaccttataaattcttatttactcagtaacagtactatcccatatacttaaaattttctctgccgtatttttaaaattatcctcactatttgtctctaatatcgcattaatcaccggagtatattttttagcatacttaaacagatactcataatcaaaaacgccgtctccagccaatcttccttctttttttccgtctattacttcataatctttaaaatgaagaatacctatcctatcaccgtatagactgtatacttcatcaactattttatgctgttcatccctatcattcatatctgaaatatttacaggatcatatataatagtaacattcggagaatctatttcgtcaaggaatctctttgtcattttagggttaaacatactatgttttgttacagtctctaccccgacaatacttcctaagttttcagcacagtcaactatttcgcgcatacttttaaagaatcgctgataattctcttctgtatgagtttcttcaaatgtattataaaaccctgtttctgttccaaccatatcacagcctaaatatttagcaaatttcagatgagctttaaaccactcaacttcttcttttcttttagcttcatccggatgaaccgggtttatgtaacaccccaaaaccgacactctgactccgtgttccgcaagagtgtttttgatatagcacccgagttccggagtaaggatactattctgccaatttatatctttaaaagacttttttaaagccagctgaacgtgagcagcgccggcctcttcaaggatttttgccaggctctcaatatcagttgccttagtatcatgacctctcattccaaaatttaacttattaaacatgttaacacctcaaattcaatattatattttcgccgctattctatgtattttataatactaataactacatataatagatttcggctctcagtattatgaataattatatatcaagattttaattttgtacactgaaattttgttatttataacattttttcagttgtcttacaataaatttcttgtctatttcatatcgttgttataaaatacccattggaaagaattatatattttctcttggaggtttttatattgagtaagcaaagatttttagaaacagctaaaaaaatggcggatactgtcatgaaagataattcacctataataagtaaaaaatggcagtatgactgcggacttaccttgcttggaattggctcggtatatgaagaaacaaacgacagtaaatattttgattatatcaaagagagtatggactattttatcaacgaagacggaactataaatacatataatccaacagtatataacatagaccatataaataacggaaaagactgcttttggctctacaataaaacaggcgaagaaaaatacatcaaggccgttgagttattaaagtcacagctcaaaacccatcctagaacggaatcgggcgcgtatttccacaagttgatttatcctaatcaaatatggcttgacggattatttatgggtgaaccgttctgtgctcaatatgcaaaagagtgcaaccatcctgaaaattttgatgatatagtaaaacagtttgtgattgcggaaaaagctacttacgaaccgcgctgcggcttatatgcacatgcttgcgacgaatcaaaatcagccttttgggcagataaggctaccgggcgttcactcaatgtttggggccgttcatgcggttggttctgtatggctattgttgatgttcttgactttatgcctgaagaccatcccggaagacaaactctaattgatatgtataacaaggttatttcaaatgttgttaaatatcaggacgaaagcggcgtttggtatcaggttcttgacaacagacgcagcgataattataaggaatccacttgcagctgcatgtttgcttattctatgaacaaagctataaaaatgggatatattgatgaagaaacttataaaccttatctcttaaaagctgttgacggaatttttaacgaatttattagaatcgacggcgactatgcttatcttaaaaactgctgtgctgttgctggtttaggaccggatgacaatcacagacgtgacggaagccttgattattatttcagcgagccgattactgaaaacgactgtaaaggtgttggaccattccttctgctcgccacaaattatatttattaattattataaaatagctcaaagacaaatgtctttgtaatggtcatctatattgctgtatatttgtgcaaatccggtgtttttgttgaactaaagcaggagcagttgttcaagactattcctcaaacacatgatttatttgcattgcagtttggttgctgagattttttaacattgatgaccactttttaattaaaattttaatcaacgtaaatattaaaaaaggcatgtattcgcttatgaatacatgccttaaatttttagaaaagtgattttcgagaaaaatttaagcaaaaaagaatggctcactcaatcgaagaagctgccagcgagactgactaatggagttaaaacaagccaaatcccattgagaccaaaaatcagcctcttcacgcattggtggaatgttttaaagcattagttttttgcacaccgccaaatttttcataagcatatctacccatttttccacataactttttgcagagatactatatttgtttgctaaaaacttgtatccaacgctcccatttgaatattcctgaactattttcttttttaattcaaactatattttgctataaaaaaccgacctcctagtcgttagattttcggtctaactttttggggtcggttcaatacaaggtctttttatattattcattgcaagacttagtctttactatatttattacttttaaattaatatctcttttatacgcgaaaatttgatctgccattttcacttaatattatattattcataagaacacatacatctctaatctacagctgttccattggagcgtccgggtcattaatactcatatgttttaccctatctctgacctcagcctttttagcgtcattaaacctatccaatgtacctgccaaataacctgttactcttcttattctttctataccaataacttcaccgttttcatcagtatcaagcgcacttctgccgcacttaggacattcatcgtttataattccggtatatccacacaccggatcacggtcaacagggtgattaatactgccgtatcctataccgcattctttcataaatcggataacattttcaaatgcttctacatttgttgtggggtcgccgtcaagctcaatataagatatatgtcctccatttgttaatggatgatatggagcttccaatcttattttctcatatgcgctgataggataatatacaggaatatggaatgaatttgtataatattctctgtcagttaccccttctataacaccgaatttttctctgtcaatgttgacaaatctgcctgaaaggccttccgccggcgttgctatcaatgaaaagttcattccatacttttctgtggcttcatccattcttttacgcatatgcccaacaatttcaagacctaaattctgagagcgctgagattctccatgatgtttaccggtaagagctttcaaacattctgcaagtccaataaatccggctgtcaaagttccaagtttaagaacttcacccacagtatcatttggaccaagcttttcagaatccagccatatcccctggcccattaaaaacggatagttttttacggtttttgcagcctgaaccttatatctcgctaaaagctggtcgattaccaaatcaatctttctgtcaagctcatcaaaaaaccaatctatactgccgttggcattaatagctatacgcggcaaatttatcgaggtaaaactcaagtttcctctgccatatgttatctctcttgatttgtcatatctattggcaacaactctcgttctgcagcccatatatgttgcttcagtctcaggatgcccctctttataatattgaagattaaaaggagcgtcaaggaaactaaagttagggaataatcgtttggcagatacacgacaggctaatttaaacaggtcgtaattaatatcttctttattaaagtttataccttcttttactttgaaaatatgaatcggaaaaataggcgtttcaccatttccaagacctgcttcctccgccaacagcagatttttcataaccatacggccctcttcggaagtatcggtgccataattaagagaactgaaaggaatctgcgctcccgctctggagtgcattgtattgaggttatggattaaagcttccatagcttgataagttgccctgtcagtctcctttacagaattttctactataaatttaaccgctcttttagcagactcattactcatcttttcttcaagcttcttaagcagaatttctccatactctgcggaaccggctaatgtcggctcaattttctgctcagattttatgtcggaaacgatttgtttagcagtgtcttttgcattttcgtcgccgctaagcattgcaagagcagaagatagatttgaaataaatttcttcttgtaggtttttgcaactcccggagccatacaaaaatcaaagttaggtatactttgtccaccatgctggtcattttggtttgactgtatcgcaatacaagctaaagcggaataacttgcaatatcattcggctcgcgcaaaaaaccgtgaccggttgaaaaaccatttttaaacagtttcagcaaatcaatctgacagcatgttgttgtaagcgttaggaaatccaaatcgtgtatatgaatatcaccgttcctatgagcagcagaatgatgaggatctaatataaacatatcataaaaacgctttgcaccctcgcttccatacctaagcatggttcccatagcagtatcgccgtcaatatttgcattttcacgctttacattgttatcctttgccgatttgaacgtcaaatcctcataaactttcataagctcagtattcatttctctgacgcggcttctttgagcacggtacaaaataaattcctttgcagttctggtatgaccattatcaacaaggactttttcaaccgcgtcctgcagctgttcaacaccgggtctttctacaccaagacaattttcaacataatccacaacctgctcggcaagttcatcggccatactatggtcagtaccaccaagcgcttcggcagctttataaatggcatttgaaatttttacaacatcaaattccgcctcgcggccatcccttttaacaatagttttaatcatttcaatcctccagaaaatataataacaaattaaacataatacaatatatggtatactcgttccaaaaaacggaatatatatagtatatcattctaaataaaagtgtcaatagcaaaataaatattgaaacataaaagtaacaattcaaatttaagtatagaaatattgacctatagtatgaattttttattcatttcaaattataaaaaatacgtgacaataaaaaaactttatgatataatttaatttatgttgcatattgtaaaagaatagttttaaatctataatggagcaaaaatatgattctaaagaatattgagatgcagggctttaaatcctttgccgataaaatctatcttgattttaattcaggtatcacagctatagtcggacctaacggttccggaaaaagtaatatctctgacgctatacgctgggttatgggagagcaaagcattaaatcgctgcgcggaagcaaaatggaagacgttatattttcaggaaccgaaaagcgaaaggctctcggtttcgctgaagtaaccttaacattggataattccagcggaatatttgatattgattttcctgagcttcaggtaacccgccgtatatacaggagcggtgaaagtgaatattacataaataaaacgacatgccgcctaaaggatattcatgaactttttatggataccggtttgggacgtgacggatattctattatcgggcagggtcaaatagataatattttaagcacaaaatcggaggacaggcgccaaatttttgaagaagcctccggtatttcaaaatataaatacagaaaaaatgaagctgaaaagaagctctcccaaaccactgaaaatctaacccgtgttaaagatattttgagcgaacttgaaagtcagcttgaaccgttgaaaaagcaatctgagaaagcaaaaaaatatcttgttcttcacgaagaaatgaaagggcttgaaataaacgtttcagttataaatatagacaaaaaaagagaaatactagaaaaactaaaagaagatatagaaatatatgaaaatcaaataaatgatatacaaactcagataacagaaaatgatgaaaaaatttctttgatgtttaaggaatcggaagaaatagatttaaaatgtgagaactgccgcactgaggacaggagtattacagaacttattcatgagcacacaaataatctgaatttatctgaaagcgatataaaacattccgaagatactataagcagatttatctctgaaatagatgattataccaaacgtatggccgaacttgacagcgaatctaaaagtttaaaagacagtcttctttcactgacatctcaaaacgacgcgtttgaaaaaagttcattagagctgcaggattcagcaaatcgcgcaggagttgatgtgtctgaaaagagtaaagaaatcgaagcgctgcattctgaaatacttaaaaatactgcaagcgttaagaatatagagaattcaattgaaaatcaaaaaatacttattgataactttagctcacgttctgatattataaagcgggaattaagccaaaaagaatcagacattaataatacagccaatcagttaaataaacttgaaaaagatacagctgaaaaagaaaataatatcaatgacttaaaaaacaaaataaatcagcttgaagaaaaatacggttccaaaaatgttgaattgcagaaagaggtatcaacaaaaaacaaaaataatattaaattgggtcaaataacctcaaaacaaaaaatgctcatcgacatggaacgcgatttagaaggatacagccgaggcgttaagaatattataaaatcttaccaacagaagaaattatcagggataacaatacacggtccgctatcacagcttataaaagttgataaaaaatatattaccgcagttgaaacggctcttggaaacactgctcaaaacattgttaccgatacccctgaagatgctaaaactgcaataaaatatttaaagcaaaataatttgggcagagcaacttttcttcctatatccacaataaaagcaaaaaatataaacaactcatcagcccaaagttatgatggatacattggtactgctgactctctttgcagctgctccgatatatataagccaataataagcagcgtactttcttccacagttgtagtcgacacaattgacaacgcagtgaaaatggggaagggctgttcacaccgtttcagaatagtaactctcggcggtgatattatacaggcaggcggtgcaatgacaggcggcagcgtagctaagtcaatcggttcgctctcaagagcaaatgaaattgaaaatttagccgacgaaattttaaaggtagaaaaaataatagaaacaagcagctcaaaaattaaaatgctttctgttgaaacaaatgatttgatggatgatataaaaaacaacaatgaaaagttaatggcatataatgaaacactgataaaacttgtatcagataaacatcatttaaatgatgtattaaatactatgagcagtgataaaagtaaactttcagaagaattaagtgatttgaccaataaaattaataacatatcaaacgaaatatctgaaaataaaactaaaattctttctattaataaaattgttgatgaattaaaaataaaggctgataaagaggaaaaaacgtttgcagaattgtcgggcaaaaacgaaaagcttactcatacaatgcttgacctcagtattaagaaaaatacaattttaaaagacattgaacaaacaaatgaaaagatccagagagttatctcggagaaggaacaaatattgtcatcaatttcaaacagacaatctgaaattgagaagctaaaaaatacaattgaggatttgcgtaaaaataaacttgattttgaaaaaaatattgagaaaaataaaaaacttttgcttgataccagaacatcactggaatcttatattaaaaagagacaggaaatcgacgacaaaataaaaagccggcaggcttctgtcaacaacataagagaaaccttgtttaatctatccgggcgtcttgcaaaagcacaaacgaaatacgaaaactctgaaactgagcttgaatcaataattaatcatttatgggaagaatatgagttaacctacagcgacgcgtcaaacagagatttgaccgggttcgatttaaacagctcaataaaaaggataacagaacttaaaaaggaaataaaatctctcgggaatataaatattgattctatagaagagtataagactgttagcgaaagggtagattttctgactgaacagacaaacgatttagaaaaatctaaaaaagaattggttcgtataatagacgaaatgcttttaattatgaaagaaagattttcagaacaatttaaaattattaacgaaaacttcagccgggtattctctgagctgtttggcggaggacaagctaatctaagtctgtcagacccggataacgttttagaaagcggaattgaaattgaggctcagccccccgggaaaaaacttcaaaacctaacgctgctgtcaggaggagaaagagcattcactgcaatagctcttctgttttctattttaaacgtacgtcctactccattttgtatattagatgaaatagaagcggcgctggatgatgtaaacgtttaccgatttgccgaatacctaaaacaatacagccaaaacactcaatttattgtagttacacacagaagaggcacaatggaatccgccaatattttatacggcgtaaccatgcaggaaaaaggcgtttcaaaattattaacattaaatattgacgaggtgagtaaataatgggattatttgataaattaaagaaaagtcttgcaaaaacaaaagaaagtataaatgaaaaatttaatacagtcttaaaaacatttaagaagattgacgacgacttatttgacgagcttgaagaggttcttattacatccgatttgggcgtaaacacatcgatggatataattgaaaaactgcgccaagctgcaaaagagaaaaaacttagagacagttatgaattaaaaagtgaactaaataaaataatgagtgatattttaacagaaggcagcggttcaaaaattgaacttcaaggcacgccggctgttataatggtgattggcgttaacggagttggcaaaacaacatccataggcaaaattgcaaatatgtatagaaatcaagggaaatcagttttgatagccgccgcagacactttccgcgccgcagcaatagaacagcttgaagtttggtcagaacgcgccggggttgatataattaaacagcaggaaggttcagacccagctgctgttatatatgacgctgtaaacgcagctaaatcaagaaatattgatattcttttatgtgataccgcaggacggctgcacaataagaaaaacctgatggaagaattgaaaaagatttataagattcttaaccgtgaactgccaaactccagcaaagaagttcttcttgtgctcgatgcaacaacaggtcagaatgcggttcagcaagccatacagtttaaagaggccgcagatataacaggaattattttaacaaaactggacggaacggcaaagggcggtattgtattggcaatcaagaatgattatgacatacccgttaagtttattggcgttggagaaaaaattgacgatatagaaccttttgaccctgttgaatttgtaaacgcaattatagaccctgaaaatgaagaaccggttgaggaaatagttaaataggttttatttaaacataatttactatcattactaactattaaaataaattataagatttttttggcgaattttctcaaaaaatataaatgtttaaaaattacttgcaaatatgatatttttatgctattcttataaagttaataataggtagtcctctgcctgatgtgtggcaagaatatcttaaaaggaaaggatgtaaaaatggatattttacaacaaattacacaagaacaaatcagaaaagatttacctgaaattgctattggtgacactttgagagtgtatgtcaaggtaaaagaaggaagcagagaaagagttcagatgtttgagggaaccgttatcaagaagaatcatggcggtattcaggaaacatttactgtaagacgtctttcttatggagttggcgtggaaagaactttccctgttaattctcctaaaatcgaccgcattgaggttgttagacatggtaaggtaagacgtgctaagctttattatctacgtgatagagttggtaaagcagcaaaggttaaagagaaactttaatagttaaaaaatgcagtggtggttaatctttaatcaccactctttagcattttgtagttattttaggagtgtttattatgaataataaaaatcaaaagccgaacaatcagaacaatggaaatattgatgaaactgttgaaaaagctaaatctgaaataaatgctcaaactgactctatgcttcgtgaaatcgaagaaagacgccagcggcgtttagcaagacaaagagaaatggaacagcaaatacaagctgaagaagaggctaaggcaagacggttagcaagactaaaagcccaggaagctgccaacgctgatttaaaaatggcttcatcacgcagaaatactgccgatgttcaaaaacctgtaccgactgtatcttcatcagacagtgttttcagcaacgcccacagacagcagcctgacgcgatagagaatttttcatcagctccgtctgcttctaaaaatacacagtctcgtccccagcgcaatgaaagcgttttaaacgcctcttcctcttctgcaaatacacgcagacgaacaataatgtcttcaggagaaacgcaggttatgcctaaaatttctgaagctgtacctccgtctcagaagagacaaaatactgctccatcaagtcaaaaaagagcttcagagcagaattcttctaaaccaagtgattccgcacatgtatccagagcttctaagagtaatgagcaagcatttaaaagaagacaagttcagaataccgtgtctgcaaactcacaggcggccggacgcgcacctgtaaaaagaggaaatatctcagcggcaaaaccaaaaaattcacataaggaagtaaacatgatgaaagaaatcagagattgggttattgcgatagttattgctgttgccgttgccctgcttataagaaattttgtattcactttggttaaagttcaaggtgagtctatgcagccaacactgcaggaaaacgatagattatatgttaacagattattctatacaccaaaaaagggcgacgttgttatctttaaaccatcatctgaccctaaaaggccatatgttaaaagagttattgcaaccgagggcgacactgtttatattgattttgaaacaggcgatgtatatgttaatgaccaggttattgacgagccttatatcaaagctaaaacaacacgctccggcagttatatagctgaacaaattgcatcaggaaattatagcaaagataatccaattgttatagaaaagggtaaaatctttgttatgggggataataggaataacagcagagacagccgtgaaattggtcaggttccgaaaagtgaattaataggcggagcagtatttagattttggccattaaataaatttggttctgtctcttataaagctactacctcttatttaatcgaagatgaaaacatgaatttcaaatttgttgcataataagtgtgaatatatcggtattgccgtcggcaataccgtttactttatagagatttaaaaaggagatatatatgaacaataaatatcagcttcaatggttccccggtcatatggcaaaaacccgccgtatgatacaagataaccttaaactagtagatgtagtaatcgaactcgtagacgcgcgccttcctctttcttcacgcaatcctgacgttgataaaattattggttcaaaaccgcgtattgttgttttaaataaagccgatatagccgataactcattgactatgaaatggttgaattattttaaagataaaaatatagaagcgatttcagcaaacagccaaaccggcaaaggattgaaaaaagagcttgataacgctatagaaattgttctggctgacaaatttaaaagagatgagacaaaaggtatacaaaggcacgctgttaaaatgatggtaataggcattccaaatgtcggaaaatcttcatttataaaccgcctgtcagggcgtgcagcggcaaagaccggtgacagacccggaataacacagaccaaacagtggataagaatagcaggaaaatatgaactcttagatacacccggaatcctttggccaaaatttgagaatgaggacgacgctaaaaaaattgcctttacaggcggaattaaagatgaaattttggatattgaggatttagcatatgaacttttaggatatttaaagcaatcttatatggacagccttttaaaaacatataacttaaatgattcagacagcgaacttaataagtatgaactcttagaaagtatcggccgcaagaggggctgtgttatatccggcggagaagtggatacatttagaacagcaaacattattatatctgattttcgctctgccaaactaggcaggataactcttgaagaacccaaaagaaatgaggaaaactgatatggaaattgatttattgcaatatgaaaaagatttaatatcccgcggatacgaatatatatgcggaatagatgaagccggcagaggtcctcttgcaggaccggtatgcgccgccgcagtaatactgcccaacggacttgttattgacggcgttaatgattcaaaaaaattatctgagaaaaaacgtgaaaagttatataatgaaataatagaatcagctttagcatattctgttcaatttgtctttcaagatgtcattgatgaaataaatatccgtcaagctacccatgctgcaatgcaaaatgcagttaatggtttaaaaatacatcccgatattttaatcgttgacggaaatgataatattgattttgataacattgaaactctatatattaaaaaaggcgattccttatcccaaagtattgccgccgcgtctattctggcaaaagtcacaagggacagatatatcgttgagctatcaaaggattatcctgaatacggtcttgaaaagcataaaggttatgctactaaagctcatatggaggcaataagaaaatacggcgttcagcctatacatagaaagacttttatgactgataaagttcttggaataaataaaacaaattaaaacggtgatacttttatgtataatactaaagaaaccggtaattatggagaaatacaggcatctaattacctagttaaaaaaggatatacaatcattgccaaaaactactatggcaagcatggagagatagacatcatagctgtgacaccggataacactactttggtgtttgttgaagtcaaaacaagaaaatcaaagttatttggttatgctgccgaagctatagataaaaagaaaattcaaagtattataaaaactgcagaaaattttatgtttgaaaacccatctgaacgccaaattagatttgatgttattgaagtttattataaaataagaaataacgatgaactcatattggatgaaattaatcatattgaaaacgcattttatgatataagcaattatatatagcgatattaatttttaattcaataccaattaagtatacttatatgaactgacttgcaataatgctctatttgtctgcaaatattattatactgtttgtacataatcaattaacgtcactataatatatttatatataacatatctgcctgatcatattaatttttttatacagcataaatcatataaaataaaaatttattataatgataaaacacaacgattatacattgcgtgatacagaatttatattatataaaaatacattaaaactataacattagataactggttcaaattttgctaagtttaatgaaattagaaaagcactttatacaaaagtatattttgcggttcctctctccttggaagagaggttgaaataaaaatataaatgggattttactattattttttaaaacagattttattttagaattctaaaagatagagagtcaaacaaaatcgttaaactatttacatacacacctatgtttaaacctgattttacctgatgagatttttgctgcacttgtcaatctaccggaatccgcaaatttatattaaattattaaaacaaacgattattttacagactttataaaattaatatttaatttttatatatgaatatctatgatagtgacttaaaaatttgtcaaattcaatattgcaatttgttctgtcttatattacaatattatacaatagttctaatccataaatatcttattgtagattatatagctgaaatttattatttatttttcaaacaaattaaattattgtttatacaaataatttataagattttggaaatttatctatattatttaagataataaaaattttagtcaaatagaaattttaaataaatctgaaaggaacaatactatgaataaagatgtatatgaaagcccgctaaactcccgttatgcgagtaaagaaatgaaatatattttctctcccgataaaaaatttaaaacttggagaaaattatgggtcgcactggctgaatccgaaatggagcttggtcttaatgtaacaaaggaacaagttgaagaattacgtgcaaacgtggacaacataaactatgacgttgccgaagcccgtgaaaaagaggtacgtcacgacgttatgtctcatgtatacgcatatgggcagcaatgtccgaatgctaaaggaattattcatctcggcgccacttcatgttatgttggcgataacactgacctaataattatgaatgaagctttggaacttataaaaacaaagcttctcaaagtaattgctttattaagagattttgctcttaaatacaaagacttgccgacattaggatttacccattttcaggcagctcagctgactactgtcggaaaaagagcaacgctttggatatgggaactgttgatggatcttgaaaatatagacttccagctaagccgcgcggctctgcttgggtgcaaaggcacaacaggaacgcaggcaagctttatggaactttttgataatgatattgaaaaagttaaagctcttgataaaaaaatctgtgaaaagatgggatattcaaaattttatcctgtttccggacaaacatattcaagaaaaattgattatcaaatgctgtcagtattgagtgatgttgctcaaagtgcgtataagtttgcaaatgacatacgcctgcttcagcatcttaaagaaatagaagaaccgtttgaaaaatctcagattggttcctctgctatggcttacaagcgtaatcctatgagaagcgaacgcatttgttctttagccagatatgttattgtcgacgcagtaaatccagccataacctcttctactcaatggtttgaaagaacacttgacgactcggcaaacaaaagaatcagcgtagctgaagcatttttaaccgttgacgctatactgaatatttatatgaatgttgcttccggattggttgtatacccgaaagttattaataaacgtattatgtctgagcttccatttatggccaccgaaaatatcatgatggacgctgttaaaaacggcggcgaccgccaggaacttcacgagcgtatacgcaagcattctatggacgccggaaaagtagttaaagagcaaggcggagagaatgacttaattgaaagaatagttgctgatgattcgtttaatttgagtcacgaagaaatagacaaaatattaaaacctgaaaactttataggaagaagcgtaagtcaagttgaagaattcatagacgaatacgtaaatcctgttttagataataatgatttagctgaagaagtggaacttactgtttaattaaccaaaagattggagcgcagaattatgactataggatttattggcggaggaaatatggccactgcattgatttccggacttatttcatcccaaaaatttaaaccggcggaaataactgtttatgatattgacgcagtaaaattaaaagaactttcaaacaaattaggaattgttccgtcaaattcaataactgagcttgaggagcgggttgatataatcgttttatctgtcaagccaaatataatgccgcaaattttaaataacttaaacggctataatgaaaaaatttatatttctatcgccgccggaataacacttgacgccctggcaaacggtcttggctcagataaaaagattataagaaccatgccaaatactcctgctctcgttaaatgcggtatgaccgttataaccccgaaccaaaatgtcgatgaaggcgaaatcaggttagtcgaggatttattgtccggagttggagaaaccgtaagacttgaagaaaaatatatgaacgcagctatcgcgctgcatagcagcagccctgcatatatatatatgcttatagacgcaatggcagacagcggtgttaagtatggaatccccaaagcgctatcacaaaaattagccgctaaggctgtcgaaggaagtgctaaaatggtattggaaagcagcgaacatccgatgaggttaaaagataatgtttgttcccccggaggaacaactattgcagccgtatgtgatttagaaaaaaccggattcagaagttcaatccagagtgctattgattcatgcgtgaataaagcggaagaaatgtctaaatagataaaaaattaacgcctgataatcaatatcaggcgttaattttattttatagcggctgttatttcatcttccttcatatcaattagaacagttttgccatgtattagttcaccttttataagcatctgcgctaacttatcttcgatattcttttcaataaatctccgcattggtcttgcgccatattgtctgttataggatttatccaaaataaattcttttgctttctttgaaacttcaagagttatatccttttctttcaatccgtcagacaaatcatgcagcatcaaatctattattttaattaactcttctttttcaagttccttaaatataataatctcatcaacgcgattaagaaattcaggtctgaataactctttaagcgctctgtcaattttaatatgagtggcttcttcatcttcattaaaacctacaacgtttgattttttatcacttccggcatttgaagtcataattataatagtattttcaaatgacactactttaccgtggctatcagttattcttccgtcatctaaaatttgaagcagcatattaaatacatcagcatgtgctttctcaatctcatcaagaagaattacgctgtatggttttcttcttattttttcagtcagctgaccggcttcatcatatccaacataacccggaggcgaaccaatcagttttgaaaccgaatgtttttccatatattcagacatatcaagcctaatcaatgcgtcttcaccgtcaaaaacttctctggcaatttgctttgcaagttccgttttaccaactcctgttggacccacaaaaataaatgacaccggtcttctttttaagctaatacctgctctttttctccttatagcactcgctacgccatttacagcctcattttgaccgattactcccttatgaagtctgtcttctaaccctactaaacgttcagactcgtattcactaatatgtttaacaggtattttagtccaattttcaattactgaagctacatcctctgcttccaaatattttatcgacgctttctcaacttcagaaatttttgattgcagctgtatttcctgaacttttaaatcagctgcttttttatagtcatcttccgcagcggctttatctttcgcatcctgggtttctttaagttcttgctgtagtttaaccagttcaatcaattcgttattatttaaattaactttcgaagcagcttcatcaataacatctatcgctttgtcaggcaaaaatctatcctgaatatatctttcagcaagaactgttgctgttcttataatatcatcagtaatttttacattatgataatcttcataatagcctttgataccttttaaaatctctattgtttcctcaaccgttggctcttcaaccataaccatctgaaaacggcgctccaaagcagaatccttctcaatatattttctgtattcatcaatggtagtcgccccaataacctgaatctcacccttagaaagagccggtttcaaaatattgccggcattcatccctccctcagcatctccggctgaagcaatggtgtgaatttcatcaataacaagaatgatattgcccgcttttttaacctcttctattatattacgaagtctggattcaaactgtcctctaaactgagttccagctataaccgacgtcatatctaaaagataaatctcataattaagcaatttctgaggtacttccccctcaacaattttaagagctaaaccttcagcaattgcagttttaccaacaccgggctcaccaatcaaacaagggttattctttgtgcgcctattaagtatctgtattgtcctctctatttcacgctctctgccaattacagcgtcaatttcaccttttttcgctttttcagtcaaattaaccccataagtatcaagcattttcttttttgaattctttttttctttagttcttctaggtccagcttttcctggttcaccgctctgactctcactgtttgaattcataaatctgctcataaactcaaacggattacgctgaatactgcggctcattttttcctcgctgtcaggagtattattttcttccttagtgttatcggaatcatcagaaacttcctgatcatcttcctgagcttcctctctatcatctgcttcagttagtgaaattatatctgcgtcgccaccaagttcttgtctaagcaaatctatactctcgccaaggtcaaaatcatcacccatttcatcaaacatactcttcatttctgtatttaagcggtccatttcttcagggtcaacccccattttgtctaagatggactcaacagggcctaaattcaattccttagcgcaagatagacaataaccttcattattctgcgtaccgtccggattcaattttgaaatatatacaactgctaagttttttttacatctgcaacatagcatattatcccctcctagttcggaacatgtcttaatattataccacataaatattaatttagcaacactttgacacaaaaatgaaccaacaaattgaaagaccgtccgatatcggacggtctctcattgggaagaaatctataaattaattttactacctaaataaattttgaatacagattattcaaattctgtatattcaactgttatatccttaattatgaacttatttggatcagctgaaccaggataaacagcaaggcaaagattatctctgtctatattagaggcttccgggaatccagtaaacatattatactcattccagctatccgctccagcaaccttagccttagcagtcaaaactcctgttttgaagttagcagttatactaacaatttgatctgcataatttgtagccgggaattttcctcccgcacagttaagccactgatgttcagtatttgaagaaccgcttcgtcttccaaccccaacgtcaagcatattcatttgatcccaacgtccataacttgttctagcgatacgtattttattttcatcgctattatatgttccaggaattccgcttaagagatctaccgtagcacaatcatcagatgtactatagcccttttccattgttactgtaaatgttacagtaactgcgtctgtagattttattccatcagataatgatgataaattccaatatgcaccgtctgaggtttttgagctgctagaaactgtatattcaccattgttatttgcaactgttgcaccgcttcccaaattcgttgggataccggttaccgagtaagtcttattaacaagtttagcaactgatgcatccgatgttacagattcacctttagctccagtaatagtagtttttccattttcaggattaagaatcttatatccgtctgttaaagtatcaaaaactacatcgtactcacctaccggaataccctcggcagtatatacagcgctggtggttcccttagcaatctgtgcagatgtttgcttgattacagcatttcctttatagaaattaaccgtgaagtcaacatcaacatcaggagctgcaccgtttagtgaaatagttcctgtagctgtaaacacattttcagtatccgttgtcggattaattgttacaggaataaccgcctttgtacctatagctttatctgatgattccctaatatagagtacaagtgttgtttcgattggcgtctcgccattagccggtcttattacagttacctttgtaccatcattgtttactatggcatattctgatgctgattcccacttaaattcgtaaccgtcaggagcctgaggcagatcaacttctgtacttgttccttccggaataacaaatgttgtctcacttgcaactttattaactccggcatatttttctgtcatgttcatgggatcccaattatctgtccacttatatctagctttaaaataatttataggattaaactctaaaatctgccaatcatcaagaacagaaccaaaaccattagtgcattttactctcttagaaaaatctactgcttctccactcttatttgtggttccgtattcatagaaacgagcgtcttccttcatattgcctgacatatctctccagccttctgctgttattcctgccgggcttgctcctgtagttgcattgtcgtctataactgtattatagaatgtaatctgcgcgtcctgtctccatggtcttccatacattgaatttgttatattatttcgggtattatagagttcgcagttatagaacagatatccataatcattattaccatcagtatttgccgcagttattgttgcgccgtaatccttatcagtcattccagctgctccaagcttacagttatcaaacactgccgttgcattaccatagatatagtctgttccgcctattaaatcacaatttttaaaatatattcttccttcactaatatatactgaatcctgattacctcttgcgcgaatgttttcaagtatacatctatcgccatttattgaaactgcatgacctctttcattgaatcctgatgaacgagctaaatatgcgctttcttcaggggtaaatgtatagtttccatcttttgttttttctatatattttgctttacttacggttttatcagaattcaacactgattcaggtgcaacttcggctgtgtcttcataacaaatgctcaaactatcacgctccggaagcatatcttttaactcattatccgttttgccgggaataagttttctatctgcctgaggctttactcctgcttccttttcaccttttgttaccataacaggtatactatttattatattaaaatctttaactgttatgtcgcttgcagactttcttactacaagcggagccatatcactaaagtttcctaaatgagaaactctaactgatacatccttatgagcaactccgtctaaatcataatatgaaatagttgaaacaccatttaacacctgacctacttcatatttggtaaacttttcatcagtatctttataaccgttccaggtttcttcttttgaccagttaattttaggatcatagtttccgtttaaatctgctgtgcctgcgcaataacctgtacaataataccatgaaagatttactttaccattagtaccgggagtctgctgaagagttacatactttacattatcaaataatacctgctcttcatagaatcctggatctacattaattacaacacgttcagcctcagactgtggatttaattcagtcgctttagctacagcgtctcttattgtagaaaactcaaagttagctccgctgctttcctgcgtcagcgttgctttattaacggtcggttcacttgttggaccgggtgttgctgacggtgattcagtaggtcttaaaacgtcttcaacctcaaaagtttttgacaaaggatttaaggtatcaacaccgttccaaatataaagtttaacaattcctttatcaggcttgctgtaatcaagtccttcaaccgttgttccctttatgtcatagctctttgcatccagcattatctcgctgtctgcttcgtcatatgctgctgcaagaagttttcctgttgggttttcttctgttccgttgtactttaactcaacgttcagctttccatcatcaccataatatgcttctgttatttcataagcatatcctaacggctcggtcgttggtacaacttcaggtgttggtacaacatcgggtgttgctgacggttcagtttctcctccgcttgtaaaacttacatctatcgttacattttcctccggcatcacaaaagttccttgatttgctccggccatcgttacatctaccgcgcttcctgatgctcctattacgctcattccctttgttgtcattcctgcttccggaactgcgtctatctgcacggtctctcccggtcttgcttttacagataccactggtgctcccgacatatacgatattccgacaaatcttcccttagatcccagtactcccatataataggtctttcctgcttctactggtatgcttgcgcatacattctcttttgccgttgctatatggtaatacgcagagtctgtcttcgttgctgttccttcttctgtaattgctacttccttaccgcttcctacatctactacgtataacgaaagcactcctgaagccggtgctacgaatttcattgccgcaccagttatcattccgttttcaaattttccgtttgtttcaccatgtgaaacatattttgtaaacgactctccttctattgtcgcttttgtgctccctgttacatccaatgtcatcatcggcgtcaaacttccgcccatagctgccagctcaggcataagttcctgaccttcttttacagctccgtttgctctccaccatacttctcctgcactgctcaactctgctgattccagttctgctgtttcagctgaaatttctcctaagtttgtcagagctactgttccgccttgaattccggctgctgtttctgccgtatacttctttgcaggtattactacatttgtgcattctgcggttctttcaacactcagctttgttgaatcagcgtcacttgttaccacatacatgttaactgattcgccgaactcaagcttcatatcaagtccgcttacttttccgctgccgcttacatcatacttctttgtctctgttaccgttccctctgatgattttctctcaaccaccagtttgtttgacggtgttccttctccattatacttcagctctacactcagcattccgtcatagtctatatccactgcgctgaactcataatccattgctgtatagtttactgccttatacactaccggatttttgtccgttccgccatagttggtcggtactgtcggctcctgattttctgtctttatgttctgctgtaatccgaacaggaaaaacagttcttttgcagccttagctctcgtcacttctgcctttggctccaactctgttccgttcatcatctttgttctgctaagtcctttttcacttctcattaagcccaaattatatacttcatagaacttttctaagtactctcttgatatatctttagtatctgtaagatttccccagcctaccaacggataatactgtgcgctctctcctgttaaattcggatcatactccggatcatcaggagatacactcgaaccattgtaatccgtcatatacttcggcttgttccattctcctgtttcagcgtttctgccgaattttaatgaatatgcgtcatatactattcccgccattgtttcacggttcagcgttccgctgttcatatactttgcaaaatctgctgtttctaaattccaaattgtgcatattcctgctataaagtcatttgtgcttattgacttctcaggattaaacagattattattatctgtatccatagctcctatttgaagcattttttctatttgatttctatactttgaatttgaagctgaatatccgtttacttttgcttcagttacatcctttgctctgttttcgggatatacttcgttccaatttccgcttgtgcatgctgcctttactttgtcgttcaggtatcctgctaattcttttatctttgcactgccagccgcgctctgagcataaatatcctctgcaatcagtttgctgaacatctttcctgccgcttctttatagtgcgttccatctattttgttatcaggatgtccgtttgcatatgagccgctgtttgtttttcccggtgactctccggcttcaagactttggtatatatccattgtctctgctgagcctatcttttcaaaatatgcctttgcctttgcaaacaaatctacaaactctactttattatcagcctttgccttatcttccataaactgcggtgagtttggattaaagccccttggtttctcactgcttaccgatgcaacaccattacttgttctcggcattcctgacaccaatatcggagttactcctctctcttccattgcagcacaatacatatccagccattttggatacgtcactttacttgaacctcttccaaatctcatagctgaatcatcagtttcatcattatgtgcagaatgaatcagtacaaaatctccttcttttgcattatacagaacattgttaaatcttccttctgtatagttcgctctcattgaacgtccacccattgaataatttacaacgtttaccttgtccaaatcaaacattttaaaaatattctgcccccatgaactcatgctgtcttcctcaaatgtataagtcttctgtgttgagtctcccagcacaaacactgtcggctttcctgacgcagtattattttctattctgctcagcgaaattgattctattcctatagtagttcctgctgccgttggctgtttgtttggctcaatttctatctctatgtacggccagcctgtcacatagtcatacttccacgttgaaccttcccatgacgcataattattatgtgccacaagtccagcagtatcccaagcacttgaactcgttattctgcttgcctgcattcctgtcggagctatccatgtattacttgatgttgtttcacttgtacagttaactgttattccataacctccaagtttatctacatcaacacggaatattaatccaccgaaattatcattatttccatccttgctttttaccgttgttgcgtctgtctcagttatgctgcagccgttttcatcctgctttattttactgggatctacggttcttgcaggcatcgcactgtttattttcacaaatccatatccctttgacgcgtcatacatgtctgtatttttaacatttatggctccgtctacttctgccgatttaaagttaaatgtcttgtatacttctcccatcagttcagatgttccctcttgtccggcaccttgctcagccgctgtcgccaatgtcatacccgacaacatcgtgagcagcatcattatcgccactgccaaacttatacatctttttctcatcctttttcctccttaaacttttagttattttttaatgtatttttaatcttttctctttaattatatataaaataaccaaaagaaacaatagccagaaaaaaatattttaaataccaaaagacaaaaagtattgaattactactgatattatgttataatgttgcaataattaggaggagtttattatgtctatatatagttttataaaaaagaataatggtatacccctttatgtgcaagttaaacaagcctttataaatgacataaataccggaaagctcgaaaatatgcaaaaacttccatcaagaagaaaccttgcaaaagatttaaatttaagtaccacaacaattaataacgcataccaggcattagtagatgaaggttatgtaataacaattgaccgaagcggtttttatgtaaagtctaatgatatacaatacggtgaatatgatgatgttccatgggaaagcaacacagactatacttataattttagttataataattgtgaaatatccaacttagatgacacatattcaaaaatgctcacaaaatatattcaagcaaatgatttttccagcttttacatgcatggaaataaacgaggggaattagaatttaggtctgcaatttcaagatttttatataataggcggaatatagattgctccgtaagtgatatatttttaggtgcgggtattcaatatcttcttactgttgtagtgatgatacttggaactgataaagtttatggatttgaaaatcctactgattataaaatgtttatatggttaaaaaatcttggtttagatataagactggttgatatagacttagacaacggatttaaatgtgacaaactggatgagctcggtattgacgttatgtttgtcatgccggaaaatcaacttccaaccggacattgcatgtctaaaaagcagcgcagagaacttgcccagtggtgcagcggaaaaaacagcagcaaatacgtaatagaagttgcaactgacggaaatttaaattataccaataatactcctaatccaatttattcaatatataaaggagaaaatgtaatttttattgattcattcgacttaactatttctcccaacgtaaagacttcgtttatggttcttccacacggtttggtcgaatcagtaataaaaaaaattgaaacatattcgcctctcataacaattcttgaacaaaaaatatatcaagacatgattaacagcggccaactggaacgtttaataaaacgcaacaataaaactatgaaagacaaacgcaattatcttatttcttctatacaaaaatctaaacttggcccacgatttaagtttattaattatgatacgggaatgaatttgcttggaatatttgacagccaaatgaatggaacagaattaacaaaacttgcatttaataatggagtaaagatttttgaaatgacaaaatttttattaaaaccaaataatattatgaccaaaaatgcttttgtatttggttacgccggattaactattcctgaaattgaaagcgccgtgcaaaatctcgaaaatgtttggtacaaattaaaataataaaaaatttcaagtccatggtattaattaaagacataagttaaatatgaatataaaagtaatttttaaacacatttatgattttataaacaccaacaaatttatataaaatacatctttatagctaaaataaaaactggaaaactttaagttttccagttttggcggacagggtgggattcgaacccacgtgccggagttaccgacaaactgatttcgagtcagccccgttatgaccacttcgatacctgtccatacgatgtatatttaacttactgcataaacaaaataattttagcttatgtccattagaacatatttattattatctcagtcatgcacaacaaaaaatattatagcatatttaatttatatttgcaatagtttttaattattttttattttctaagcagaacttataatgatatcacttacatattaataaaatatttatcacgtacatttattttaccaactataaaaaatataactatttttattaattggcgtcatataatctttttttatatctcattttataaacgtttaaatatattgtcaaaatcaaaaaataaataatattgaccgctttaaactttgatttaaatatttaattaaacagaacaataaaagcggcgtgcagtaagaaagaatcctcaaaagaaaaaatataactaaagttttagtcaaaaaattatttataaataattgtatcgcaaaaaccacaaaaccaggacaaggtatataaacagttcggatataataaaaatcacataacacgatttacaaatgttattaattctcgacaggttattttattgacaatcaaaaaattataatataacaatatcaaaaaattcttcacggtattaaaaacaaattttattataaaattaacaccatagaaattattgatgagtataactattttatatccaaaaacatacagttaaaataaaactgacaccgatgtaataccgatgtcagtatattattaaaaattatggtttaccattgtcacttttttacactgcgcatacatttttgacaactttataattcatattatacttcttgtaacacaaattatattatcgtcttacttattagcacctgcaaacggcaataagtcctcaatagtcataacgtgtattgaacgcttgcctgtcagcggatgacctatcgtttcaatctcgtcacaccaccattgtgatatcatctgcgcaccgtaatattgaatatgtgtgttatctgaacctccggatttatactgtgaatttgcaaaatcaccaatctgatcaattgtactctttcccagtgaattcttaaatgattccggaagtgaagctccttttacaaatctagaatcattattatttataaatgcaaatatatcttttgatttctcagttccaacatcatttatatatttatttgttttggcatataaatcaaagtatggcaatcccagttcctgagctaaatcttttgcagcatttacatatgcctcatgccctgcatcacttagtttatttcggcttattgatgtggttataagcggataggcgcctttttcaagtgcaggctttacataatattcatatagagaatttttgtatgagccatcggtaaatctatctcctttataatcggtatgtctatctgcctcagacttttcatcattatgaccaaactgaattatgaaataatcacccggcttcataccattaattattgttttataattagcttcacttctgaaacttaaagaacttctgccgctgagcgctaaattgtttactgaaactccatctgtgaaaaagttacctaaaacctgagcccatccggttcttggaaaatcatttttttcgccggatgttttataattacatgctgtagaatcaccggcaacaaatatagtagcattattagcaactgtctgaccatatgtataaggcgatttcattaaaggttcaacagaatttgtgctttcaaaagcaaacacttttatttccgaattactgtcgaccggcacatcttccggattcagatagagtattgtctcttcgcctgctttctcagtcgtttcctttaagttaaacaacttacatgctgtaagcgctccatcattactcttatcatataccgcaacaaccagtgtttcttcaccggttctgtctgcttcagaaatactgtcagtatatacaatatgacttacatatccaccgtccataggagacataacaactcggccctcagcatttgaaatggcaaccctgctaatttctacagcagtataacccggtacaaacacttctatttcctttgtatcttttgcctctcctcttgaaattgttgctgtcaatacgactttactgtcagttcctttttgacgatttacgacaccatctgctgaaacgacgttaggattgctgcttatccaagtaattgttgttccgcgtctgcctttagcaggtaattcaatatttgacttaaccatactagtatcgcctatattgagagcttctttcgcaacagctactgcgccctcatcatcagtatcagcaggaacttttaaattaaaatctttagtaatcctcaagtttggataatcctgaaatgtacaaacagctatcattttgacatcatgattatccttatcagtattaacatcaccactaatcgatattacatcgggatttgatgactcccacgctacatctgcgtatccaattgaaaaaccaaaacctgaaatcaaatccaaatcatcagtaatattattttcagttgtattaacgcctttaatcatattaaaagtgattccgtcggtttcattctgaactgacttatttataaaatcaacgcttacatcaacattcttctccggcattacaaaactgcactctgtgtaatcactatttatatttagtgaaatatcagaatcatcaagtgaaatattcccaatccatgcattattgtttggagttgacttaacagttaccatatcacctggttttgcattatatatttgcttctcgctaaaattcataccacatagcgtgccggttgtacctaccgcccacataatatattcatcacctgctgtgagctctatagattgattacacaatccaaaactgccgtcatcactgaacacggttattttaccagtcatcggagtataagttccatcggcatttttcttagaaattttaagatccttaccatcgcctgaattatattcaccatttgcaatctgacgtctgtaagcatatgttagcgtaccgcttttatttgcctttatcactaatgcagtagaaccggctttttcagccaaatcgctgccggccggagcactgtcaagcctaatctgaatataatgtgtataatttactccgtttatattatactttgcagacttcaaagtagtattaaacacggatgacacatttaaattattgtcatcaatatacacagaaccggcctttgtgggtgttgacgaattaacagaccaatcggtaaccgcctcaagatttgcattcgactgaccggttgaaacttctaccgcacctaaatccgaatcataaagaacaccaacctcatattcaccctctgccgcaaatactcctgccattggtaatatacaaaataccataacgcaagcaactgcaaaacttacagtcctttttaataaattttccatagtcaactctccttattaattaattttcattattaccacatatatgcttttattataatactaatttgtatattttgcaataataaaattataattttttacatctcaagcatataaaataatatattgttataaattcaggatataattctatcaaaagtttataaaattcttatccaacttaaatcattacgtttatgttataattttgtgttttgataaatctgctgtttaaaataatgtaggattttaattatattttttgttaaaacaaagtcagaatttaaaccatgaaggttcaattctgactttttataattatctgaagtaattaatttttatattttttaatttataaatttaataatatatttttttcaagacgaataccatacaaattaacttcaaaatcaccatatatttattgtttttgcatttcctgcgtaagtactttacactcatcttttcatttaactcatatttgttttcttttccatcattcataaccgcgcttcttacgccgtctgaactctgaattcaccgtaaactataaaaaatgctgtaatgtttgctcataatttaaagataattctgatatataatcaatacaataatatgttatagtattaatttattcgcagttcaccacacaatgggacttgactttcattccaaagaagcgctttggatttctcgccgcttggaatatcatattccttagtctcacctttatttatgctataatttgtgctgttttttagtgatccgtcaagattgtattccgcaatccataattctgcgtcttcaaacggtctatcgacaatgagtttgccgctgtctaaatacattagttctctcatagatacgctgacattgtcgatatatgttctatatacaccaagacgctgaaagcttatgcttgaaagctttattgttgtatcaaattcaaattcatattcaaatacggctgaggaccaattcataagaataatgccatagttaaaaatttcccaccgcgccgacaataagtctattgagaagagaatctatcactgcaaatctttctttgtcttttaatacttttgcaagtctttttgcctgctttaaagtatatataaaactgcctgcgctccagcctgtttattcagttcatcagtccaatctataaagtgccaccaaaggtcacagcatattttttattcgatttttcacaatccaatacaaaaaattttctcctcatccgatattctgttttatagtctgaattatatcgctgtttactgtaaaagatttattatattcagtaattaataaaatattataactcagttttaactcctaaaaatattatttaaagttacatagccgaattctaataataaacaccaaaaaatataaatccaacgtataatgaattacaaaaaaataagaccgtatgctaaacaccacatacggtcttgcttatatttagaaattaaaaattagcttatacaccagcttttcgctttttcatcgtatccaaataaaccgcaaatacaattactacacctttcagcaaaagctgataataaaatgggatttgaagtaaattcattccattgttcaaaacaccaattatcaaaacaccaatcattgtaccgccaatgctgccgctgcctccggtaaacgaagtgcctcccagcacaacggcggcaatggcgtccatttcaaacccctgacctactgttggcagtgctgaatacattctggctgaaagcattatacccgttacggaagccaataatccgcttataacataagcgagcacctctgctttaaaaatcttgatgccagaaaattgagccgcattacggtttccgccgattgcatatatgtgtctgccaaatctgctttttgaaagcaacaaaccattaaatatcatcagcaccagcattataaaaacaggaaccggaaaaaagccgccaatataaccatttcctataaagctatataaaggatcattaaagtttatcggcaaacctcctgtatagatatacgctattccacgcgcaatattcatcattgcaagggtcacgatgaaagcaggcatatgagtttttgcgattaccaaaccatttataagtccaagagctgtaccggcgacaattcctataaaaatagaaataataaccggtagtcctgaaacactcaaaccaattgcaaatgtacccgatactgcaactattgagccaatagataagtcaattcctcccgaaatcattacaagcgtcataccaaaagccagcaatgcgttggttgatacctgccttaaaatgttcattccattactgactgtaaaaaacttatctgttaaaagcgttacaataatacaaatagcaatcaaaccaataaaaatatacatattccttttaaaaaaggaataaatactatgcccgatatacctaaaaaaatcttttatccggctgttattttccgctaaagacttactatttgtcatcatttcacacctccaactgcataatgcataatattaatttgatttatctgctctttttcctttatatccgcagttattctgccctcatacatgactaaaacccgagtgcataaattaacaatttccggcagttccgacgatatcattaaaatagcgattccttcatcagccaaactttgaatcatacggtacagctcagcctttgttgccacatctattcctctggttggttcatctaaaatgagtattcttggattggttgcaagccattttcctaatactaccttttgctgatttccgccgctcatattaacacagatagtatcctcacctgaatatttgattgcaagatcatttatcaatcggttaattatctgccgctccacttttttatttatcttaaacctttttatatactgttttaaaatagtaagcgtcatattgaatcttaccgtattaatcaaaatcaacccttgttccttcctgtcttcaggaaccaacgcaatcccttcagcaattgcttgagatggattttttatctctgtttttttaccataaagaaaaagctctccgcagctgatacggtcaataccaaaaattgccctcacaagctccgtacggcctgcacccactaatcctgacagtcctaaaatttctcccttatgcagctgaaagctaatatcttgaaatgcgttttttctgctgaatccctttacctccagcaccacttcttttgaaatattatgtttatctgctttatagaattcagaaaccggacgccctgccattaatgtaataagttcatccctttcagtacttttcacatcttttgtagtgatatatcctccgtctctaaaaactgttactcggtctccgatttcaaatatttcctccaatctgtgtgagatatagataatagatattccttttccttttagttcactaataaactcaaataaattttcaacttcattgtcagttagagaagatgtcggttcatccataatgataatacgcgcttccattgaaagtgcctttgcaatttcaaccatctgccggcttgatgtttttaactcagaaatcaatgtctgaggcttgatatgctcgattttcagccgtttaaaaagctcggcggtatcacggttcattttctcatcattcattatatgtatgccggaataaaccggttctcttcccaagtaaacattttgggcaacacttaaattatccgctaaacacaattcctgatgtataatactaattcccaatttcttagaatccgtaacatcgcgaatcataacctctttattatcaattgtaatttttccactatccgcatgatagataccgcccaaaatttttataaaagaagattttccagctccattttcacccaaaagacaatgtacctctccctctgctagatcaaaatggatatcatgcaatatcttaacacctgaaaaggataaattaactccttccgcttctaaaactgttttttttaagcgcatactattcacctctatttccagtcgcagcctaaaaaacaaaactctactttaaaaactcatccacattagatgaatctacaaaatccacatccaataatatctccttagggtattcttctccgttaagaacgccaaagcctacctcagctgccttcactcccattttttcagggaactgtgcggcgcttccaagatactcattgtttttaatcagttcacaaacacgctccgatccatcaactgaaacgattttcacatctccaatcttatttgcactttttgcagccgcatatattccaagaccaatagcatcatttgttccaaaggcgccgtttatatcaggatgtgcctgcagcatattttccatcaatccaagtgcatcctccgtgctgcaagtttgcgcatcctgatattgtacaatattgataccgggataatttttcataacctctttaaatccggtagatctgtcacgggccggacgaatcacatccgttgtaataacaattatatttcctgaaccgtttaaagcttttgccatcgcctctccgcaaagttttcctaacttaatacaatcagaagctacctgggtaactacaagatcagggtcatccaccatagtatccacatccaccaccggaatacctgccgctttacacgattccaaagccggtttaatcccttttgaatcaacaggaacaacaaaaataagatccacttgctgctgaattaaatcctcaatatctgaattttgtttgttctgatcaaattttgcatccagttctattagttctccgcccagttcttcaatctttggcttaattccattactcattgatacatagaaaggatcgttcatcgtcatatatgtaatcccaaaagttttcttttttgtctcattcctgccgccaaagcaggaactcagtgaaacaacgcttgcaaacataaacaaacaagcgatgataagacacacagcacggcttgctttaattttctttttcatgatttttctcctttctttgtgcaccacagttaattctgtgtgacaaacgtaattctgttaggcagtccttccagtttttcagtgcttttaaaacgtgtcggccaagctagatcgtgagcggggattacattattaatatttccatctgccagcattaatatcttttcaaaagactgaagctgatccagctggtcaattccatatcccataggcgtcatggtaataatattctccaaagtataggctgcgtctccggtgactacataccttccatttttagttttaactctcacaacttgcgtaccgtatgaatgcccctttgccaaatacaaatcaattcccggaaaaatgttttccataccgtcctctgacaatataagccggccttcctttttcacctgctcaagcttttttaaatcctccggatccaaataacagttaagtaatttataatcctctgacagacctgcagaccactgccacccctcaagctctgtcctttgcacatatactttagcatttttaaagcaatcaatatttcccacatggtcataatgcaaatgagataacagcactgcatctatttggtcaggatgcaaatttaaaggcttaagataagtctccggtttcaatacattttctgcgttataagcttctataaattgaggatttttaaatcctgtatctacgagaatattgtatccgccgccttgaagtatcgttacattacctggctgatcctctggaaaatctgcatttttctgattatgtgcaccataaaatgtctgtccgcgtccaacatctttaaaaatacagtgctccacaacagtgattttccaacaaatttctttcatttttttcacacctttccatacataattcatcctgtttcaatcctgttcttccaatagatagtagtataaaataaacgacaaatcttgtctgtgtgctcaatctcaaaattatcagcaacagaacatcattatatctgcagatagttattccagcgcttacctaatcccatagcagaaaacattacttctatagaaaatcacaaatatgtattaatagattaacttgtatacgttaccgcaatgttcttcagatgctcataacacacccataaaacaatcctgcattatgtcttaaatatttgccattccatcaaatcataatttctaactgaatccccttgaacgtatcatatcaatcatgtgctttttcatcattgctatcctccttccttcgttgtaatttaataattttattttgtcagccaatcagcaagattacaccaaaacgtatcataatatttccaactcataaaatcaggtgatgcccaatgaggagaacagtctgatgtaaatgcagccgactttcccataccaaaagaacctactgatataaatggatctccgtctatcttagcaatcgttttgcatgccggcaagcatctagcaacagtcttgttgtatcccaggaaacacggccactcctcgttaataccttgcattaccggatgcgtatcatttgacacagtcggaaaaactccttcaggatgttcacatctatcatcataaggcaatatctttaccggaagtacatctgcaacagccgtcttcccatatcttgctctagcatctattcctgaaaaagaaagataacctcctatcatacaaagtgaccctccggcaagcacataatctcttatcgccgtacatttgttattctgcgtatcaccatatgaaaacactctatccgataaaagtaacgtgtttgagccaatgtctgataaaaacacagcgtcatatccgcgcagcttttctactgtgtcaggaaaatgttctcccgcataatgattagggcaaaaatccacttcatatccgccatttttaagagcttttatcagtctgtctcccccctcctcataacgtgaagttgtaaaaatatcaaatcctttaatatgtgttgtaacgcttgtccaagattcacctgcaagcaaaatttttttcattatgaagtctcccttcatttactctttgtaaatatacttcaaactacagcgcatgtactttctcttactactaacagcggcttaaaaactatcttattctgataatcacttttttgtattttatgaaccaacattttagctgccgcttctcccattttctgattcggctgtaaaacagatgttaatgttggaaataaaatctgagtataatctgtatcatcatatccaatcacatttagctgatttggtatttcaattcccatttcctgtgccgctcgataagcaccgcatgccattaaatcattctgtactactaacgccgtaatattattttttaacagtttgtgtgttgccttatatccaccctgatacttataatctgcctgacaaattaattctgactgaaatggaatagaagcctgagctaaagcgtttttaaagcctataaacctgtcatgcgcgcttttatttaacaacggtcctgtaacacagccaatttttttatgtccataatcagttagatgttttaccgctatatatcctcctaaaatattatcaaaagaaacactgtctatttgtgtgttttcctttgaaaatattctgtctaaaataacaaatgggattcctttgagtattgttgtatacgtaatgtctacacttgaacttaacaccggaattaaaataatgccgtctacacatttttgcctcataatatcaatataggctttttcgcgttcgtctgaatcattgcaattgcatagtatcatattatattccatatgccttaacgcaatctctataccttttgccatttcagcaaaatataaatttgaaatatccggcaggattaatcctattaaacctgtttttttagtaaccatactcctggcaactatattcggcgcataccccatttcttttataattttttgtacccgatccacggtttcctttcggaaattttttgtctccttattaataatttttgaaacagtagaaaccgacacatttgctcttgaagcaatgtccttcatctttggattcatcctaaccatctcttttttattagataattaaagttagtaaaacgttttactaaaattatagtatcactcttatatgagtttgtcaatagtgatttgtgtaattttaccaaaaaaaattcccaataaaatcaaaatatattttgattttattgggattttttactgtgtttttatcattaccggatgagccgtactgcttcttactttcaaactgggattcataaccacatgttcatatcttttttcattgattaattccaaagcgcaggatactattttttcgctaagttcatctatcggttgtactatggtcgtcagaggcggctccagtgctccggtcaaatatacattatcaaacccaactaccgacagctgctcaggaatttgaaaattcatttttctgctttgcacatatactcccaaagccatcatatcattacatgcaaataccgccgtaataccgtatttgagtaattcctcaatacctcttgaaccgctttcaatatcaaactccccatgatacactaactgcgaatcataagaaattcccgcattatttagagtctctttatatcccttaagccgttcctgtgaaatttttgaatcatgcggtccacatatacatccaatacgagtatgccccaactcaattaaatgttttaccgccaaacatccacccattttctgattaactgaaactacgctttcttcttttcttaataatccacggtctatccataaaacaggcgtatttgaaaaatcaaaaaatgaattcagcctttttttctgtgcttctgtcatagcataatcaggatatacgattacaatcgtatctacattacgcttttgaaaaatatgcagatattccatacatgtgtcaaaacaagataaggtattaccataaatcacattataattcttctcgctaaacttcctttcaatttctttagcaaaacttgaataaaaaagatcacttatatccggaagtatcagaccaatcgtattagtccgcttcgttaccatacttactgccacctggtttggctgataatttaattcctctactgccttgtatattttatttttcgtctcttttgaaatgtgttcgcccttatggttaagcaccagcgataccgttgtaatagaaattccacatttttttgcaatatcttttattgttactcccatgttatctcctactcattttttattaaaacaataatacaattattaataagttttatattattaatcttttaaatttctaattctatgttgacttttccactttattaggtcataataaaaccaagtaaaacgttttattgacaatcttataaagaaaggatatttattatgaaaattttgaattttggttctctaaactttgattatgtatatcaaatacagcattttccttcacctggcgaaacaatatccgctctgaatagaaaaagattctttggcggaaagggacttaaccaatcgattgcagtacaaagcagcggctatccaatatttcacgccggtcaaatcggacaggacggaaatgatttaataaatgtattaaaaaaacataaaatagacacttctttaatcaatatatgtgatattcccacaggacatgcagttatccttatagattcctccggtgaaaactgcatcgtattggacggcggagcaaatcaaaaaattaccaaggattacgctgattcagtattagagcattttgaaaaaggtgatatactgcttctccaaaatgagatcaattgtcttgaccatattattaaccagtcagcaaaacatggacttaatatagtttttaatccggcgccattcaataaaaatgtattaaaattaccactggagaaaatacagtacctctgtatgaatacaactgagtgtcttggcatttccggaaaaaaagatattaaaagcgcaatttcatggcttttaactaattttccggaaacacatcttttaattacattaggaaagcatggatgtatatatatatacaaaaatacagttctttcgtatggcatttataatgtgccggtagtagatacgactgcagccggtgatacttttatcggttattttattggtcggcttgctcttggtgattctattaaaaaatctcttgaaaccgccagccgagcctcctctttagttgtttcaaaagccggcgcctcaaactcaattcctacaatagaagaagttttcagctctgatattaaatatcaaaaacccgatatactgccttttaatttttaataaatccatgatacacaatttagcattgtatttataacttaacaaataagtttcccctccataattttatatcaaaaatactcgtacagattatctatacgagtactttttatgctttaattataatttaataaaattatttcagagatactattaagcaaactcttccttacttctactctttaccggagtatatcacatctttcattttatgtcaacagatttctgcagattgatttcaattaaatggtatgaattcctttaatctttatctaatttcttatcctatcatccttttgaatcaagttcaaatctacgtgacaatatcctcccggattcttatctagataattctgatgatattcctccgccggataataacataataaaggcaaaacctcggtcacgattggtctgctgtattcacgctgcttattttcaataaattcttgaatagtattaatgtctgcatcgtcaacataataaataccgcttctatattggcttcctatatcatttccctgacgatttttggtcgttggatttatagttttaaagaattcagtaagcagcttatcaagtttaatcatcgaatcatcatattctatcataactgtttccgcatgtcccgtattccctcggcacacatcttcataagtaggatttttcgctgttccatttgcatatccgcattgagtatttacaacacctctcagcaaggagaaataggcttgtgtcccccaaaagcatccgcctgcaaaataaattttcttcttcatgattatttcaccgtcctgatcttagtatagcaataataggaatttactattccttgatatgtgacctgtaaaaaacaccgtaaagacacataaatattgatataataaatgacatagtaaaaatccaaaactcaatgcttcagattcttactatgtcacaaattcattccaattttaaatctcaaatccgccctcgagaataaattgtctaagtaatttatccatctttatatttactttcggaggaacgatttttttgccctcttgttcctcaaaatacaactttgctttctccttattaaatgttttaaataactcatcaaaacgtccgaactcattaatatcactcaatgtaagacctaacgacatcatgttgcggagttttttctcatctaaatcgaatgtggctgcaaactgatgaacttgagcgttcttcgcacgatatagatattcggttatataatctcttaacgattttccttcctcaacggaaacatcacctctttgaatatcatgcaaaaagatatttgcatatttttgttcatcctgcgtgagtgccgcgaacgtcttatgaagctcatttaaggcttcttcctgtgcctcggcggtagcatcatcttgatgaattagtttcatatacttgtcaaagcggctgttcatataatcggcatcaatacgtccggtatctatttctgtaatataaccgaccaaatcataaggaacatcaacttcacctgatcggtcacccggccttctttccgttaattccttatatctttgaactaaaacaagatattgagtttgtgtgaactgaggcatgacatcaagtgttttgcccgtttcttcatctacatacgagtgtttatcccaattaaagccttgaaccttagcagcttccaaacagccgttaaaatccttaaagagtgatgcaaactttgcctttaccgatttttcatccggaagcttttcaaaatcaggaatacccgcatttgtaaataattcggttaactcctgataaatcccgttaagtttttctatgttatgtcccagcttgtcaacaaaaaggtcaaccggtctgtcgccggaataaagcttaacagccgcttctatatttttctccattgtgtgaggttttctgtaatatcttattgtgccgaaaggcttttcgtcttgtctgaaaattcgatttgttcttgaaaatgcctgtattatattttcatactcaagcattttatcaagatataatgtattaacccacttggagtcaaaacctgtaagcatttggtctacaacaatcaataaattaagctgcttttggagtgttttgtcaatcaatttatattgctccttgtgtgccattctgcaggaaatatcctttttgaacgctgcatgcgaagcaatagaaaagtcttgtccaaacgccttgttatagtcctctatgatttcaataagtccattttccttaaaaaaagctattttttcacctttatattctttataatcgccgtcctcattgctgatattcgggtcaaataagcaagtggttttcagctgaggcatttccgacttaataagtctatagtaatctatagcttcaggaatactgcttgtggcaaaaatagcgtgaaatttgctgttacggcttaaatcctgccatttttcttttatatcttctacaactttcttttgatgttcttcggttctgtactgtgaaaagggtatgtaatcctcaatacctttaatatattttccgtcatctgttttatagcctgccataggaacttgtgacgcatccatatatttatagtatatcgctgacttatccgggttattaaaaacctcatcagcgtcttttgcttttgccttctccaatgccacgtgccggcgaatatcggaatctttaaaagtcaagaccttataagggtcaaatcccaacacattaccgtcgcgaataccgtctgcaatgctgtatctgtgcagctcgtttccgaatactgttgatgtagtgttcattttcttttgattttcttttttaataggtgtgcctgtaaaaccaaagaaaatagcgtttggaaatgtttctttaattgtaagcagcatatcgccgaatgttgacctgtgagcttcatcaactataaataccaagcgttttttattgattatatcaatatcatgggcatttgaacaaccatcttcagatttgatgttgctcattttctgaatagatgtaacgataagagtatctgcagaatcaatgcttttcagctttgaaataagcacatatgtattttcggttttttgaacactttcattctcatctgcaaaattgttatactcattatatgactgtgtgcccagctcgattctgtctgtcaagaatataaccttatcggcatctcttgaatttgcaataagctgtgctgatttaaaactcgtcatcgtctttcccgaacctgttgtgtgccatatatatccgccgcgctgattagacttgtcccattttgttttggaaactttatcggatatagcgcttgcggcataatactgatagcttctcattactttcaaaacgccgtctgagttatcggcaacagtgtaaaagcctatcatttgatgagccataggaatggatagcagcgatgaagctattgacttccaattatttatcggttcgttatcaaaatccgcccaattaaaatagtaattcggattgaaactgccgtccggtccgggattggcaaagtatttgctctcctccggcgtcattgcaacaaatatttgcaccaacgaaaatagtccggtaaagacaccctcatgcgaatatttttctatttgccggcaagcttggcttacaggaataccgctctttttcagctcaatatgaataaccggcattccgttaatcaaaagcattaaatcaccacgacgatcattcaatatttttgactttgccggaaaaacaggctgctgtactatctgataacggctttgacctgcggcgatttcccggcggtcataaattttcaagctgatttcttttccgaaatgctgcttatcattgggattatctctgataatagataccgttttaccgtttataaatccgtttagcttaagcggagtacgcaaattattgatttgttccataatctgctgcatttcgccgtttgtcagcggatagttattaagcctatcaattccacggttattttcaaataaaatgtttgcccaattatcaatcaagtcctgttctgtgggatgacttatcacttcattctcccaacccttgtttgaaaggacttttataagggcctcctcaaaatcggcctcttttgtgaacggcataatctttctccttccttaatttaatgaggaattagcaattaggaattatctatattttgtcgattttgtaatactcgatagaagttttaataattctgtgcagtcgctatcaatgctattatattgctctttgctcaagtattcagttttatatagtaactcaagccaatattttgtttccgaacactctttaaatgcaatatacatttttgcaagaaagtcttttttactgaaggcacattccgcctctgcaatatttgcaccaatgctcgttccgcttcttaaaatctattttgacattacaaactcttttttattttcatacatatatttataaagttgaatgattctaacagcaaaagcctttgatttttcaacaactacattttctttcattactaattcctcactcctcattcctaattatcaaacgaacatcttttcaagacaagatttcttgatattttgcagcttttctaacttacgctgatgaagggcgatgagattgtcaaagtttttaaaaaatctgcctattttcctttgtatatcaaccgaacgaggaatgagaagtgagtaattagcaatgttttcttttgacaaactcggtacaccggttgactcatcaagcttcttccaatcaatcgtttgaaaaactgcatatataaaatttaagtcaatgttgttttgcggaatgcaataaaatagcgtatctaccgtccaaaatggtgcttttaatacatatggtctatcaattgtgcctttcctgccaatccctattgcatcatcatatgacaatgcttcactaacactaagcatatatccgcctgttccataaacaggaatattcccatctgaaagatgtttgtagtccttaccattgccaatgcttactatatcgccaatgcttactatataccattcctcactcctaatttctaattcctcattatcattacgctgttcccaatcatcagtaaatccggcaaaacgaatttcgggcactttgcgtccatttttaggaaacatcttttcgagcatggatttttttacattcttcaacttatcacacttacgatgatgaagggtgataagttggtcaagttgcttaaaatatgtgccaattgcttcttgttctttgcgtccaggaactacaactacctttgtaagaagttcatctttggtaagcccttttatagaagttccttgtacggaattgagttcgctttgcagttttttatagagcaagtaggaagtaaaaactatatcagttttcagcttgcttaatgacaaaaaatcctggcttgtagcataagaaaacggcattacagcaagctttccaacgaccactcgagtaataatagcaatggagttctctggtacaattttggttgccgaacttagtactgcctcatttgaaatatactttctaggagtcaccccaaagacttgatgttcggacaggtcggatgattggatccacggtattgtaccattccaaaatctgtcgtttgatgtggttggagtaccgcctccatatgtatcagaagctaattcgccaaccttacgctgctcccaatcaccggtaaatccggcaaatctgacaaccggtttctttttttctgacatcttattcacctagaagcagcgatttgaactcgctgagccctttcatgtcaaattcatttcccacaagttcgtcaatcatttctgccagtgttgactctgtttccttgatttgtgcctcaatctcgtcaagtgtagtatcatatttggtctgtaatgcagagattttacttacaagtgtgtctacaagtgtgtccggtaatccttttagcccctcaataagcggttcaatccacttcttttcaagcaacatatacacctgttcatcgctcagattttcaatagttatctttgttttcttctgcagttctgctgacttcttttttattgaggattttaattctttttcttcctttgcgagcttttcatatgttttaagtttttcgataaatttagctgtttcggtcgttttctcctcatttttcaatgccttgagctttttggttacttcctttgcgacaaagctgtcaccggattcattaagaatatcactttccttttcctcttcagtcaggctttcgagcagctcctcatattcagatggaatttctgaaagacgattctcatcggctacaagctcagcatagtcatcactgagtaaagtttctccgacaagctcaaaaggaataacatgacctgtccaaccgtcctgtatttcttcatccttgccatttttcttttttattatcagctttgggtcaaccttttttgctgcttcaaagccttcagtctgaatgatttccaagtcgacagagatgcctgaccaattatcatcaagaatttgatatgcttcataacggtcaatcaaaggaatatttttaagcctgtcaaaaatattttcgctcaaatcaccttcagtctttgttatggcaagcactgtcatttttgataagagttcatcttttagaaagtcagagaagttcgcaaaggtgtctccgaaagctttttcaaactcaataacatcagcatgattttttatttgcgatttaatatcattcgctgcaagtgttacatatggactgccgttatcgttaaacagagtctgtttcaaattcgggaacgctttccaatactcacacaatttgtctatttcggacttcggtattcctccgaacatagaagcataaatatcccaagactctgcactttcggaactatcaacataacgtgggatattaagattataatcattttttcgtatttcatcttgagttacaactcttgaaaatttcggataatcagctcttgcagcaacagcgtccgatatacgtttaatatcagatgcacgaagcttgttgtttttgccctctttaataaaaccctttgaagcgtcaattatcaagacatcggtattttctcttttttgtttaagtaccattattatcgtcggaatacctgttccgaaaaatatatttgcaggaagtccgattattgcgtcaatatggttgttttcaataagatttttgcggatttcgccctcctcaccgccacggaataacacaccgtgaggaagtacaatagtcataattccgtcaggctttatatggaacaagtcatgcagcaaaaaggcatagtctgcttttcctttcggtgcaagaccgaagcgtgaatatcttgcgtcagactctttattggacggatcccaggcctgcgaatacggcggatttgataccaccgcatccacatacaatgtctcgtatgtattaaccgggtcgttttcatcaaaaaacggccaatcttcttcaagcgtatcagcacatcttgtcgtgatgttggacggattaattcctctcataacaaggttcatacgggtaagattatatgtattttcttttagctcctgtgcataatactttatattatcggaatttggcatatactttgaaacactcttgccaatattaatcagcagcgaacctgaaccgctagtcgaatcatagatttcaatttcatttttgccttttaaatggtttgcaacgatttcggacatcaataaagaaacctcgtgaggtgtataaaactctcctgctttctttccggcattggctgcaaacttttcaattaagtattcataaataaaacctaaaacatcataatcctgtttgccgtccatgggaatatccttgataagctgcaaaagaccgctgatagcttttgttcttgcacctgaactgtcgccaagctttgataagcctgtttcaagcgtttgaaaaatcttctcaaatacttttttatgcgagctgctgatatttctgttgaaagccgaaagtgcatccgtcacatttgatacatcaaaatctctgccgatagatatccaagtagagaaaagattattataagatataaagtatccgaggttctgctgaacccatctgaccgtttcgtcatcatcttcagtcaccgtaggcagcagctcatccgtgtagtcgttttctattaaaaactttacttccttatcagataagtatttataaaaaataaagcccaagatataatctttatattcgttggcttcaattttagagcgcattttgtttgctgattcccaaatacggtttgcaagctgttgtttattcatctaaaagtccctttctgattgtatttctactatgatatgtcatttttactatcctaaaaaatagactttgctgtattgtccgcagcttttttgtcgggaataaactccataatatcatccgtagtgcaattcaaaaccccgcatatttttccgagaacctctgttgtcacattctcgtcccgtccaagctttaacattgcatatcccgataatccggcagcctcctgcaaatcttttttcttcatatctctgtcaagcaacatatgccatagctttttataactaacagtcattttgtcaaccctttctctctgtatgagtataagtgattataactatattatagcatataattctcggtatttcaatgattttgtcgaaaaagcaaaactgttttgttcgctctattaacttttcttaatgattattaacatgctatgacatcaacttagtacagcgtaataataatgaggaattaaaaattaggagtgaggaatggtattgagtaagcataggcactgataaggactgcaaataactttcagaagagaatattcctgtttattaacaggtggatatatgcttagtgttagtgaaacattgtcatatagattccctttccttgaaattaatggcgtttgatatccttgatatatccttttttaatacagcataaccatgcacaaaaacgaccatcattttttatacatagtccaaagggggttacttttaaccgaaacgatttaggaaataaaaaccacagaaaataaaaaaaccgaagccaaaactgactccgattttttctcctaaaacgcaaaaaatgatagtagctatccttgaaaatcggcgtataaatgcggacattttagcagagtatgtagtggaatagacacaaaaatatagggtttgagaaaccgcataaaacctcacttttttaacactcaaaacggttaaaactcaagggggtgcgtatagcatcattccaaccatcgaaaaactacttccatttttccacgcacaattatcaaattattctttttgacatttcgggcaatacacgctgcttctgccgccaattacaatgcggcaaagcgtttcaccgcatttgaggcaaggctcgccatcgtgcccatagacttgcaggaacggagtattgcgatattctttgcctttggtttcgatatattcctctgacgttaattcattcttttctataaaatatgaaagacgctcggaaataatcgtcgccagccgttcccactccttggttgtcaagctgcttgcgctcttagcaggataaatttccgccgtaaatagtatttcatcagaatatatattgccaatgcccgctataacgctctgttcgagcaaacattccttaatcgttttttttcgtttttcaaaatgcatacttagatattcagcgttcagcttatcagaaaatggctctatgcctaaattatcaattccgctgtatatatcaggttcgccatttttaatcagccaaaaccgcccgaaacggcgcgtatcagaaaagcgaagttccattccgttatttaatgcaaagacaatatgcgtatgcttttccggcggtaaatccggcggggcgagaagcaagcagcctgtcattcgtaaatgcaaaactatataatcgccgctgtccattgtaaaaatcaaaaactttccgcgccgtcccattgatgaaaagatttgtcctgtaagctgttcgcaaaatttactcgcagtggggtgcgctattacgtcgcggtttacgattatgttttcaatcgtcagaccttgtatttgcggctcaatcacattttttattgtttccacttctggcaattcaggcattttgtatttttcctttctttgcagattttttgatttcctcgtgataaaagaaatttacgacaacaggcggcgcgtcaaacggatttttcatactatcatcatctctgacgtacttcaaaccgttggttttagcataagaacggatttgatcgtccaaatttctccaatataaacgactgcctctaatataaatatcctcatatagcggaagtaaatccgcgtgcttctctttgataaagtccattataactgatttataactgcctcgcaaattcaggttttcaatccatacgagattacaatgcttctttactctgtctattatctcctttacgtcagtaattcccggaaagattggcgaaataaagcaagtggtgcggataccctcactgtgcaatttttccatggctgatagtcggcgcttaatactaacagcggtatccatatcatttttaaagccttcatcaagcgtatttatgctgaaaccgactcttgcgtcaggaaaagtttttatcaggtcaatatcccgcaaaacaaggtcggattttgtttgaatactcagctttgctccgctcccctgtaattcttggagtaaagtgcgcgtccgtccgtactgttcttcgagtggctgataggggtctgttaccgagccgataaacaattccttgccagcgtatttttcaggcttttttaaggcattccaatacttcacatctacaaaatctccccacgcttccgcatggttggtaaaacgcttcataaaacaggcgtagcagtatttacaagcgtgttcgcagccgacatagggatttacggaataatcgctgacaggcaaatttgattttgttaatacgctttttgtttcgatttcctgtattatcatagctgatattactccaatatcaccatttgcctgtgtgaatatgactgtcgggcgtactgtcatactgctccaaaacaaactcgtcctctttaggatatccaataccgataaaacaaggcgtcatccagcctttgggaacgccgagcttgtcaagcacaacgtcgtgttctctgttcagcggaatacgcatggagtaaccaagtccttcgttaatgacggcaagcataatattttccgcaacgcaccacgcggtagtaagcggatttagtttgctgacccattcggcattgagctttgaacacttaaacaggggaacgattacgtacggacaatcggtaagcattgtgtactgacgcggcatagcatatgcgtacatttcctgcgctaaattcagctttctgttttcatatctccctatgtcaaacctgtttaccacctgtcttgcatagctaaaagcattctctttttcctctttggtatgcaaaatgataaactgccaattccggtagtgatcccacgacggcgctttcatacccgctccgacaattctttttatggcttcaaaatcaacctctctatccgtccattctctgcttgtttttcttttatttataacctcgttaaattccatttttaatgctcctttataaacgatttctgtgcgccctgttgtacggtgtcggtttcttttaactctcccaacaataacggcgatgcgggattgtgatatttataattctcaaacgccttttggggatttttatttgcgtaacaatatttacaaccgttcatacaagtgtcatacgcacctatgtcgcgtgtttcaatgcaatgacagccctgacgcatacccttatgtttcagatttctgaaagtgatgccgtttgcgttacctaaaatatcaagcgtcatacagcctgattgttgaataccatagcgcgtaaaatcaccgtttgtgccgcaagtctgaattgtcataccgtatttagccgcgatttttcctaagccttgcgctaaaatatccatatcctcaaccgacatcataataatctcaggcatatttgcctgcagttttttatacatctccacaaagctgaaaatacagcggtcaatatgcggcgcaagggttttcgacattctttcaaatttttcaaaatgacgctctattgtgtaatcctttgttaaaagcaccgggtcatacctccacgcaacgcgctgcgccccgacctgctccgagagcttaatcagtgtttccatacttttctctatcgacggtacgcccggctcaatatccttgccataggcggtaattgtatagtgaaaatatgtattgaatttatctgtgatctcactaagacgcggcagtatcggcttataatttttcgagcagaaaacaaccgtgtcaaccctgtcaggcgtcagctcgtatcgagttaccttattcggaaacagtggattgcgcgagagaacataaccctccttaaaacgcgttaaaagccaatcggtataatattggacagtatcagtccgtccgcctgtgtttataatcattgtactacctcactatattttcctctattaacttcccgccgtcatagtaaatatcatcgtcagatgttatctctcttttgataaccgccggagttcccattgcgattacattagcaggaatatccttcgttaccacagagcctgcgccgatgatggagttgtcgcctatatgtactcccggcattaccgtaacatttgacgcaagccagacatttttgcctctatatacaggcttgttacagccataaccctcgcagcgcagcttgggcgacacggggtgcgacgcggaagtgattgttacattcggcgaaatcattgtgttgttgcctatgtaaatattcgcgtcgtccacaaaaatgcagttgaaatttatgtacacgtctttacccaaatgaacgtgctgtcccgcgcacattgcgtgaaacggaacctgaatgtatgcaccgtcgcctacctccgcaaacagcttttgcagatttttctattttttcttttcaccgcgcttagtgtagcctgccgcattgtacttttccattagtcgcagcctttttagataatcggtattatcgcttgtgagcgtccacacattatatatttttcccgaatttaaaatttcctcatattccatcattcatttttcctccgatattattaaatctctctttcatacaataagcaaaaagtgttgtaatgcgtaccaattccgcaatatccgtatcagacaattcacccatagcatctatttccgcattagctgcgggcggtatgattttctttgcgtattccctaccctcatctgtaaaacaaacaattttgtttcggcggtctgtttctgactccgtcagcgacagataaccctgcttccaaaacttttttataatcgcgcttatagtctgctttgtcgcggacagtctttcgcaaatttcagattgcagacagccatcgggtgcgaaccatattatgtccaacacaaacagttcttttgcagtcagattgtgcttccttgcatataattcataagcggaaaattgaatatcccgcagaacgcagtattgatttacatagcttcgtacttcttcgcgtttcataaaagcctccataaaatatttgatagtctaatattgtacttattgtaaaatagatgacatgttttgtcaatggcgagtatagaaattattattctaaatcaatgataaaattgatattaaatatattgcacaaaaaaatgtgaagctacctacttcacatttttgttctttcgtctgttatatcctcaaatatttggtctttatcaaataccaaactatcatatatcagcttaactccgagccgaaaaacgagcttaaaattttctaaacttccgactgcggttatttcatcgtgagcgtttataaggtcgataaatatttttgcctctttatcctctaacagctcattcagtttattttcgcaagcgtaaaatcgtttaagcgcttttacgtattgagaatttctgttatattgcttttgattaggttgtatattccgataatacaattcctctataaaattcatcttgtgtcctcaaacaacagttttcttgcaatcgttaattccgcattgtcaacactcggtacgtcccaatagcaaaagtcgcccacacggtcaacggcgagattctaattcggatttacagattgatgaatccttgtatacgcttcatcaagagctgtgttgcagttattgtcgttctgtacatctgtaattatatacaagctgaattgaaacagcaaggagagcaatccgaaaacttggaacgctttattgaaaagatacataaatattttgatttgcaagaactgatgccggccatattaaatgatatagaaaaatgtgttcacgtccacgcgtccaaaaaaattgacgaacatagaacgcaaaaaattgatatttattatgacttggtggactttttgcctttactgaatttgtattacggtacaagtcaatctcaatatttccgtttaaaacagcatataattatacacaaaaaatgaccataattttttgtacatagtgcaaaggggtatacttttaaccgaaatgcaaaaaggggtaaaaatcactgaaaactaaaaaactgaagctaaaactgactccgaattttctcctaaaacgcaaaaaaggcttgaaaccaagcctttttcattgtatcaactttatagttgaaatatggctcctccagttggactcgaaccaacgaccctgcggttaacagccgcatgctctaccagctgagctatagaggaatatatcaaactcaacggataatagtatactattttttttatccattgtcaatactttttttaaaattttttaaatttttttgtaggattacaatagatgtgttacaaagagaaaaaaagaatacggaaaactcataaattgtgttatagttatatcaccataatatcacatacgtgcgggttacaccgttctggatatatcttgtggcaacgttttggcaacacctgcaacataaattgtattgttccataaatatagagctaactgatttgatttatcagttagctctttttgttggggtctttagacgtggaaaaaaaccttcggttctaccggaggaagataaaaagctttagcataagaaaaatctccatgatataatagtaaatggtttggcgaccgcattacaaaaaatatatcatggaggtttttaataatgttaaagaagagcacaaatgaaataaagagcacagcacactcaaaatacaggtgtcaatatcacatagtatttgcaccgaaatatcggagaaaagaaatatatggtcagttgaaaagagatataggagaaatactccgaaagctttgtaaacaaaaaggagtagaaataatggaagcagaagcctgcctagaccatatacatatgcttgttagtatcccaccatatataagtatagcacagtttatgggatatctcaaggggaaaagttcattaatgatattcgatagacacgccaatttgaaatataagtatggttcaagaaatttttggtgtagaggatattatgttgatacagtggggagaaataaaaaaataatatccgaatatatcaggaatcaacttgaggaggattatgcatcggatcaaataagcatgaaagagtatttaaacccgtttacgggtagcaagaataagtaggcaaaaaatacagccgcacgtgagcggctgcctgtgatagtaatgcggtgtcaaacttctgtgctccttacaggggttaagcctgtattagccccttataggggctgtgcaagccaccagtttactggtggtcttgacttaccaaaataaggaggtggaacagcatggagaaaataatatttgattattactatggtaatcaggcggagcagtacagcttttaccgtataccaaaaattctttttaaggataagacgtttaaatcactatcaaccgatgcaaaggtattatacggatttatgcttgaccgaatgggattatcagttaaaaacagatggtttgacgatgaaaacaaggtatatataatctataccttaaaaaatattatggaggatttcgggtgtgccgataataaggcaacaaaattattgaatgagcttgataaggaaacaggaataggcttgatagaacggagacgtcagggattggggaagactgatattatatatgttaaaagctttgttataacgccggagaaccagcacgaatccggaatcgtgaaaatcacgagcaattaatactaatattaataatactgagtataacaatactgataataataaaactgagtatataaatcatcaatcttatctatcgtgtaatacagcaagtgaaactttttcaatggataggattgaggattatgaaaaatacagagagcttgtaaaaagaaatatagagtatgagggattaattctgcatgaggaaaaagaggtaattgacaacattgtggatattatggcggatgttctgacttttccggctgaaagctattatattaaccatgtacagtatacggctcctgtggtaaaaagtattttcatgaaaataaattacacacatatcagcaatatgcttttggcaatgaatgaaaactgtacgaagatacgaaatgtacgcagctatctgatagctgctatttttaattcatacagcacctcagatgtatatattgactggcgtgtgcgctatgatatgaaaaaatgagagagtaggtgatagctattatggagaataaaatattaaaaaccggaaatggagacaatacagaaataatacagactgtaaacatatcagaactaaagccgtatgagcagcagccgtttaaggtattgattgatgaaagtatggaggagattatggagagtataaaacaaaatggggtattatcgcctattattgcaagacctcatagagaaggcggatatgaaattctttcagggcacagacgtataaaagcatgtgagcttacgggaattacatagattccggttgtagtaaaaaatcttgacgatgatacagcggcaattttactggtagacagcaatttacaaagagaaaatatcctgccgagccaaaaggcttttgcgtatcggctgaagctggaagctatgaaacgtcaaggtgaaagaacagatttaacatctgcacaatttgtgccaaagttaacagcacgggaacaatttgctcaagaagctggagtaaatcttatggaaattacaagttacatacgccttacgaatctaattgacccgttacttgaaatggttgacgaaaagaaaatagccttaaatgcagctgttgggttatcctatttaggcaccaaaggaacaggcagaggttctaaattcaatcgaaaaggaggaggcttcaccatctattgcacaggctgcaaaaatgcggcgtttttcacagaatggtaagctaaatcccaatgttatagattctattatgcaggaacagaagccggaaaagattaaaataacattggcaggtgataaggttaaaaagtatttcccggaagattatactgaaaagcagatagaggatgttatgataaaactattagacgactggtataaaaagcggcagcgtaaaaaggaatatgaacgttaaagcggtatctcatgatattaagggataccgcttttatagtggaggattttatggatatccaaagaataaactcaggatatttaattataaatcaaattaaggttggcgaaatagaaattgtgctggatgttcaccccaaattgcctaatagctttgttacatggaaatgtaaaaacggtgactattactattgggggaactatcatacaagcctgttgtcggcccaaaaagatttctgtaagcgtgctctatcagaaataagaaacattgaacagatatataaaaaacaaaagcaaatagaaaacgagaggttaaggcatgattaatagacctgttagcattccgctgttcaattgtatatatcaataataacttaaatataagaaaatcacatttgtgtgcgattcttttgtgcgatagaacgatatacgttgacatttatggtgattattgatataatattttgtaagattaaacaatgtttcggaggtgtcttaaatgaggacacacttcttccggtatttgcggagggaaaaattgatgtgtatccttattaggttgcagccgcgctatttgctgttcgcaacccttatcaaaaaggcgtgattctgtgcgatgaagcatgtatgggaaaaagccatagcaatgtttattatttctcaaagttggtatgagggagaaaataatatcttaatagctatcccaaatcctgatttacttgttcagtgggctgaaatgatttctgaaaaatacagtataccattttgtattgcatttgagaatgattcttttgtctatgatggaattgtccttactatatatgaatacttaaccccaaatattgaaaatgctgataaaataaaatgggatattattatttttgaagaagcaaattctctttcatctgtgtatcaagatgaaaatacatttggttgcaatccgtgaaagtgtatataaatcatttgaaataacaaaagaacattttatgaatcaatacgacaatgtgccgtgcagatattttatatacaactccgcaaagctgtccgatgtaaagcagtttgcaacaagcagcaatattgaaattatgataataaatatagatgtttttaaaaagagccaaaatattataaatcaggcacaggataagctgaacggcgaaacagctatgcggtacattcaagacacaaatcctattgttataattgatgagcgcagagcgttgacaacacgccaaaggcaaaagaagtaactttctattttaacgcttgtgacaaattcaccttagtaagagcaaaggtgtccatatccagcatatattcgccggattcatatacgcttcttactcccataagtgaattgggtattgccttgcttctttcgccggaaaagcagagatatttcccatcggatgaaaaactcatatcggttattgagatgccgtctttcatgatagaagcgataaaaccgtattctttcaatgcattttctgcattgaaagtacgaccactcttataaaatcgaatagcattgcatccatcataattagaggtatcacggtatataccttttactgcatattgtgtataagagttatttttagattcagatattacagtaaaaagtccgttggacacgcttattccttttgtaaaatcagtgatattattattgtaaatattatgatctgttatatctgaaaaaagatacaatgctctagaagtatcatcataattgtagcgaatgaagtaggcaggatattcaaaacctaaattacgaatagtgacaacagtgtccatattagccaagtcttctgcacatactgcgagtcggccattgatgttttctgaagaaatctcctgtccatttatataagctcgtatatccgattcataagtgtatccggtaatatctccaactttgccgcgttctattgccggattaaagccattaattgcttcactgtgtttatttacaaatagtgcgcgtgcgtcgtcgttgtaatacacgctgaaaccgtaatctgaaagatcctcaagacagatcatggtttttccatctattgcatatccttggagtgggatgccgtccatatatgtgagtatatctgtagaatatattggacgtataacatcacctggcatcgctgccacaatacatatgctgctcattatgaaccctgtaactgcgaaagagagtatagtttttttcatataaatcacatcctgttatcgtattttactataattatattatactttaccatgtaaatcaatcaattttcatgagcatatgattggagttcgtgttttttgatttatactgacataggtggcgcttatgatatgacacagtataacactataggtaaggttgttaaataattatattataataaaaaccatccatacttgagtagagtataacttgtttttggggatttatgcgtacttgaaattgaataacagtataacaagtatggcgaaatgaaaaatgtagtaggatacaggtggtaaaattattttaccacgtgcatcctaaacagtctagaattatactataatgcaattagatgtgcatataaaatttgattctaaaatataaatctatgataatgtatgaggtattaaaacatacctaatttttgtatcaaaggaagatgtcaatgcaactgatactgatgcttaatctttatggagtcagcattggatgcacttcctgatagtgttgagatgtttagttcaagtattttgctccctgtactgaccatgcatagtcaatttgtgcagctgttcaatttgatgagtttagttttaaattactaatgcctgcatttagatacgaattatttgcattatcatttgttcttgttgtggggacaagagatataaaacgtgtaaatctcatttttaatgttccatcttcgaagaaatcaccagctgcaaaattgaatttattggtacacgttccaagtgtggtgccacctgcatcttcgtatgtttatgtataggttacagtatctgtattacctgagcgagccacttcaattttcgttgtacagtatctagttgatggataatttttttgaaaaattattaagaggtacgttattaccgaccgtaattggagtaggagttgtatatccgtaattcgagtgtgtcatcacacagggaacccatgatgaattcttcttatcataagtcattcctatatcaaaactgctatactttgttcctacagcgataatacccaatgaaatatatgcagttatgttagctgttatactatgtgatacagagttgaagtttattctgtcactggcagaagtatagcttttatatggagtgtgtacataataatgagcaccgttattagcttctacatatggttttatatgatccttaaaaagagctggagcaccgtaaatactttcgtatgacttatatacatatccacctaaattattgtatacaaagtatgtagcggatgtaatgttatcatattgctttgagtattgagatgtttcaatgtaagttgatataaattaaactttcttttttcaaatttttattttttgttttaagtgtaatgtaaaacgttttcataaataaaagagaatgaaacaatttaaaatgtaaacctaacataaaaaatattttaaaattttgttctatcaaggacatatggcagtggaatagcctgggtggtaaaccgttttccttgcacattcactttagtcagtacgaaagtatcaatatcacgcatgtacgctccatcctcataggcatcgttcattcccataagaaaatattcgtgtgacttgctacgttgccgcttgaataaaattatttggcattatctgaaaagttgtgtcatatatcgtggttccctctctatgcaaagttataagctgatcccaagaatatgttccgtatccagtatatggtcggcttaaagtcgttgtcaactttttctttttgtgtaccaacagagccatattgtcttgtcattttagtaaaagctgcaatcgtgattttctaagttttcaaggcatatatagttgatttatttgcaaataaatagtaaaaataaaactaaaggcacttatgtattttaaatacgtcttttgcattcagaatataaatttgcttcaaacagggaatagttttgttattagcagcattgttttatgcattaaaatactgaatcaaaagtttttgattattttgtttgttgtttacgccttatttttatgtgtatgtatagttacttggtgaaattttgttgataaattacaaatgtattgttataatatatataacatataacgaaatggttatttaagagacttataaaaatggactttaatgataaagtaaaaatgggaaagaaatgcatgttatgaaaaaggcaatgatgatgttattaagtacattaatgattatacaaggaaacgtttatgcaagcagcagtgatattaagaacacaatctataatacagatattgtaacatatttggatggcaaaatgatgatctgtgcggaagatttgcgtaactatggttatacggtaggatatgacgatagtatacgagcattatttgtaaataaaacaggaagacctgcagaagacttttatccttgttatgaaagaggcagtataggtggaatttccgggaatacttatgaaacagatatacgtgtatttatcaatggtatagaaacatcggcagaaaacatgggaggaaaaatgcttgttgtagctgaggacatatcagatacagaagtgcaggaaagcaataagacttcatcttataatccatatgccgaatatggaattaaggcatgcgtataacgatagtgaaagagctttatacatagaaactgttgaggatggcgttttgtcatacgaacagcaattatcggatttcttaacaggtaaaacgaatttgcctataggcgatgccgcaacggcaggacaaccgcagattttggaaagaaaagatacagaggaatgcacaatgcttttgttcaagtggcagtggatgacaagtattgcaaagttttatagaaatggtattcagatgaatatgagtgatgctatttttactgcatataaatttaaaaatcagatgaccacaacaatagataatggagaattttcagaagatggcagtaaatgttatgtttacggacaacgaaataagttctccggtatggtcgtctatgaaatgtttgagagtggaacttatgagatcgacacgagcagttttgttataagaagtaaagataaagagtactaaacttataccccagtcaaaaagatgtttttgtctctttgacgacagggttcatttatcatttcagtgggaggtgtacactgaaatgataatgatctgccggttggcaatgttctaaactttatttcaaacaaagcttcatacagacgctggtagtatgaacatttatattttattaatagtcaaattgatttattttgtgtaagctctattatagaatattaactgctaaaaattctaacggaacctatgatatctatacatattatgattcatttaatgaaaaagaacgattcgaagaaggcagtgttacaattgataagggtataactgatataaatataatggcttataaggcgaactatgattccggcaatttcaattgggaaggcgatgcttcttatgttttcgaaaatcatcataaaggggtagctgattcattaccggaagtaaattcggaagtatggtttgaaatttctgatagtatggcagatggtacatatttagaaggtagtgtattcaatgaaaaaaatccatttggcaaaaagttatcaaatttgtacgaagaccaacagaatagatggtctacacatattaacccgcaaagtgatccaacgataatgggaataggtaatggtgcggaatacgatatgctggctctaaaatataaagataacaataagcttaatttttacggcagtaatattcctgatgaagaaaaggataatatttggcacttcgatacagtacatacgcaaatacgaacaaataatttaacagcttataaaaatagtgcagattttatgcttttaaaagaaaatgatggtgaaattgatcctaattttaaaccgagtgattatatttcaagcacagatttgaatatgtttgaagattctattaaaaatgaatattcgtatttattagccgcttctcttgctaattatggtgttgtagagaagtacacagtaaatattgtatcctaatgttatctattaagttcaatcatcttgtttatttgaaactaatggactttgtttccgcaagaggatttaaagaattgaatttatcccaaataaacgtttttatttcccctatttcgcctagtgaagctgggatgttaaagccaaatgaacagtcataatttggtgcaaaatttgcttttacataatcaagattcagcagtattccattcttggcatatatggcaacgaatatataatcctttgtattattgtcctttttcttgttaacactagtttcaacaataaaactagcattttccggaggggtttcaagtttatctcctgaaattgaaagaatggacaagtcttttatatcataaagatagttaggagaagctgtgggttgctctgtatttattggcgttgaatttatattattaatatttatatatataaatgtcttattgttatttatatcttctgcacatataatatattcaccgttttgatttactttaaaagaattgtttttaatagttattgtattcccgttatcattcggatatccggcatttatataatagtcataaataacagcagcattttcgctttctcctgttaattcactatattggtcaaaatctgaaagtaaaagattaatatccgtattgtagtctgccgatgtaatatgtccatttgatattatgttcgaaggatttattttttgaactactctaacatagctcacatttttaatttcattatttgacataatttccaactgtacagcgacggattgatctgtattttctgtttcagatattgtaatatttacatttggagcctgagctggttttggttctgttattataccgccgttaatcttatccggagcactgtttttatcatcttctaaaattttatttccgtttatagtaaaatcattataacgatagcattttgaaatactgctttcttcatctaagtaacctgatatggctccaaagtgttcgccttttgtttcttcaatacttcctccagcatagcaattgcttatactattgaaattctgaaaatatggtgggcttatttgtgcgccaaccaagcctccggcataatcactagctgctgttacgttacttgatgaataacaattgctgatgccgcttagtccaccttgcttacccactaatccgcctacgtagatatttccctgcactttgccggtgctgcatgaatttgctaggcttccatcgtataaatatccgattagacctccggcgagatcatcagaacttatgacatcacctgtagcatagcagttattagcagttgccataccctcaaggctccctaacaatccaccgcagcagcgttttcctttaacattgcctgaggcataacaatatataaccgagccgctcgcaattccaatcagaccaccgatatttccgtttaagatactatctttttcagatataacgtttgtttttgtgtaacagttaactgtagtgccaagtacattttggtttccaatcaaacctccgacattttttgcaccgcttacgctgcttcctgttacatagcaatttctgactttatcttgtgtagcataaacaccaattaaactgccgacattgctgttgccggatataccgttttcagcaatttttatgccaagattttatatgcatgtatcattattataggaatttacaccaccgaagagacctatattatcagaatcagttcggtttatccataaacctgatataatatgatatgctccttcaaagcttccggtaaaatatccgtttctagaaccgtctggttttcctataggctcccagccttctttgttccatttagcataaccttcaccgacgtcgctaagatattcagttaaatcaatatcgtttcctagtttgtaatgagctgataaattgttacgtatttcatcaagttcacgagctgaagtaataatatacggattttctaaggtgccgttaccggctagccttatgcttttatcattttggtttatattcaaaaaatctgcataaacataggaaaaggttgctggtaatgctattaaaaatattaaaaataaatttcttcatcattttcaaccttttttatagaattaattttttataattatgttattttgatattataagataattattgtattttaaaatttattcagaaaactattcaacccagaagtcaattagttgttcttgctcaagtgtattactgcataatgattgaatgttgttactaaaaaccaatgtataatacatttgcggagtatatccatcatagtgttgttctaactgtttagtaagtttgagatttctattcagtttgacaccttcgtctattttatcgaaaatattttcgtttgcatatacaattgagttacacattttatttgagattataatcaataaatatagaaaaatacttaaaaattttttataaataattatccacttgtaaattataaaaaatactaaatttatttcgaataaaatgttttgtatgacaacctttcaaataaattatattttatattattatttagtgtataatcaccacccatgtattatatgttgtaatataatatattgtaaaattcaagtaaattatcataatattactatgtttttttggtttaaaatataattattatttcaaaaaagtataattgataaataaagctgttctatattttttatatttattttatattttaagaaaactataaaatacaattttgataaaaagcaaaagaataagtttattaaaattttaaatattttttattaaaggattatttaaaatagattctgttgggaagttacttaatctaagcagtgacagaaagtgtaatattttatcaaagaatatttttaatatatttatcagttcatactcactttgatgtttatatatagaattaataattttatgaaaggaatacaaaatgaagagcacacagaaccttatggattaaggtatatatgtaacataatttacaaattcaagaataccattaaatgttatatcaggctgggtagggcataaaaatgttgaaatcacacaagactataatcacattttaaagactcaaatagataagggcgtaacattattggaaaattggtaattagaagcagaatggtgtcaaaatggtgaaaataataaaatgatgatttataattaacgttattacggaaacatatgtataatataaaatttattacaaaattcctcaaaatgtaggtttgtcaatgatgtgttacaaaaaagattaaaagagttcaccgaaattgataaaagagttgatgtagtcaatgggagctttccataaagaataatgacgtagatgttttggtaatggatttggtgctgccgaccatagacggaataggagttcttgagagaatcaacagaatgcagctgaataaacgtcctcatgttctgatagtaagctcagtcttgaacgagactgtaacgtcatattccaattcatacggcgttgaatattgtatgttgaagcctgtcaactatgatgcgctgattgacagaatcacaatgatggcggctccgataaccacaggcgaagatgtaatgcagaactggaaggtgaacacaaaaaagtttgactatgcacaggtagaagcaatggtgacaaacgttatacatgagataggcataccggcgcatataaagggataccaatacataagaagggcaataatgatggcgatatatgatttggatataatgaactctgtaaccaaagaattatatccaaccatagcggagaacttcagcacaacgtcgagcagagttgaaagagcgataagacatgcgatagagctagcgtgggatagaggtgacatggacactctgaacaacgtgttcggttacacagtatcacaaataaaaggaaagccgacaaattcagaatttatagcaatgatagcagataagttaagacttcagcttaagaatgcttcttaagattttataattaatttttgtataatataggtatataataattaaaaaataaaatacaagaatttatatattcttgtattttatttcaaatcgtgatttaatttctttaaaagcaatagtttttagaattgtttataattaggtcttattcaatagaagttgctcctacttaagttatgataaaaagtataaatatttgagtgaatcaaattagaatctcatttgataaaaagaaattcaataatagttaaatttaattcaaaatgcaaaaaaagtaataaagtcaattaagtgattcttataatattattttttgcgactgcgcatatattgggatgagtataaatttatgactggcatataaatattgattatgtctaagaattaataaaataaattatttatattattaatactccaaagcctgtcacagacattctaagattactatcatattaattttataaatacatgttttggatatagtacattgtaagttgataaaataagttaatatatacgtcttatgctatgattaaattatgaaataaaacattaaatatttccttatcaatacttatcatagcatttttataaaaacttataaaaatatttgttataagtttaaatatttatttcggtttgcatttgccacagggttgatagcctgattttatggcttcatctatagtcatatatattatatttggcttatcttttatataactgcagttaaggtcatgatattttgttccgcttttggtcactccgactttttcttgattgacactaattgacggtgaaggggatgtttcagatatactcaatgtaggtgtgggagaagattcataatcatcagcttcatttgcttggatacttataggggatggataaaactgagataaaaatataaataaaacggtaacaataattattgttaaaacacttgttgatataattaattttatatttttatatttcccgggcgatttaattgccttaaattttttgcagagttcaatttcagcattactatatttattatgattatcaatctttgttaatatttcataacaatgttttttatcaagtaaagaaaacatagaaatatcttcaactgttgatatacgatttacagataaaacgcatattggggcaaggaattcaagagcgaattcgtttgcttcgcgttcttggttatcatcaagaagtccattttcctgaaaacctaatattccatgcttagaaaaatgccccattatatcgtgaccgagttcgtgagctaatgcgaaacgttttcctgcatttgataaattgttgcgataaaaaagtatcatattattatccgttttaatgctgaatgcaggtgaatatttggctatatcaagtacacccattcttttaaaaatatctatataatcagaagaattaatatcataactttttattatccagcctctgtcaagcagtatggactcaatgtcgtcaacgagtatgggaaattctttaatattatattgtaataaagtttgaattgcataatattgtgctgtcatcattatcctcccattttgtataatgataacgacaaaaagtatttaaataaaattaaatttattataaattaatctatattgtcaatgttttcatcaatcttattagattttaaatttttgaccgactgtcctttagcagcaatttctccgtattcagtatcaatttttaatatttcatttatgcctttgtctagttcatctttttgtttatttaatgcgtattcttcaattataggtttaatttgttcgataaatttagttttaagtttttcatcagagattaaatttactagttccaaaagttctttttcattttttgttaatttattatttaattctgaattgtcttctatagattcatcgctgggaattttattgtcaatacccagtatatcgtcggcagaaactttaaaatattctgctattactgttattttttcccatgcgggatattttattttattttctaaatcataaatatagtttctattaattccacagtcttttaaaacttttttgattgatttattgttttttaatgctagttctttaattttttttgcaaattcggatccagttatcatttccataatatcagcttcttccaattcacacttgtttatagtaagactttataaataaaatccgacaaagttagaaaaagtttaaccttctttgtcataaattaacaaattacagataaaatctgcatttttgttgactacagaaatattctgtattataatattaataacttatttataaagttagacaaataaaagaaaacttgcgcatatacaatggcaaatttattcgacaaaattattataatatatttttcatgagtatgcaatagttttttattaaagtgaggtgattatggtggtaaatgaaatcaaaattagattactaagactggaaaaaagacaagtggatttattggatgctatcagaaagaggggattcaagaacttacagccatcaacacttagtcaatatatcagcggaactattacaggcccgcaagccgaaacggtaataaaaattatatatgaaatattagaaagctgggaagaagaaaagtctacttatgttagataactgttttctaattataaaataataaaaatcgagtggaagataaataactccactcgatttaacaaagtttgtaatataacaaacaaaattagctaaacttattcgccgtcagattctcttgaattgtttgaaccactatttcttcttcctgaattattttcggtgttcttagactttgaaactcctgatgacacactgacgctatagtctatatctatacttctatttttcttttttattgtcgaatgtactttgtccataacatttttccatacaggaatacaagggtttgatgacatttctattgaagccggcgtatcatatccataccatactgaagctacataatatggagaatagccgataaaccatctgtcaaagttttctgatgttgtacctgtttttccggcagtaaaggttccgtctgacaatgccgctccgcgtccggtgccgctggtcacaacactgttaagatatctgttcattattgcggcggtctccggctttattgcttcccaggtagtatcgctgtctctgccggtcaagattgtttcaccgctttcatttttaatttcagtaaatgtgtaaggtttattatatacaccttgatttgggaaaatgcagtatgcagcagtcatttcaatatttgtagcgccgtgagttaaaccgccgagcgccaattgtgcatatccaagatctgtgtaaatttcaccgtttatttcttctgcttcaacaagagtagtaaatccaagtttctgcgtcataaaatcgaacgaagtctgaatgcccatgtccgacattatttctacaggcactgtattcaaagactgctgaagagcatagtcaagtccaacttctgaattactgtaagtgtaactatagtttcttggtacccagccatcataggattttcttttatccattactcttgtacttgtgtttattgttccattatccagtgcgggtgcgtatacagctaatggctttattgttgagcccggctgcctgggactttgtgctgcacggttcagagtaaaactggcttctttttcaccaattccgcctgccattgctacaactctgccgtctgatgggtcaataataacaattgaagactgggctgaggaatctgggaaattatttgtattataatagtattcttcaactattgattgaatttccgggtcataagcacagtaaattttaagaccgccggaatataccatttttgttgcaagactttcagaatagcctttttcctgcaatcttgatattgcatcacgtactacttggtcaacataatatgatgttattatttcctcttttttagtagcagccgtatctttactgaatgtaagaggatagttaactgcttcatcatattcttcctgagttatataaccaagtgaaagcatctttgctaaaaccaattcttgtttttctttatttttatccggatttatgaatgggtcatataatgccggattttgagtaatagatgcaatagaagcgcattctgccagatttaattgacttacatccttatcaaaatacaaatttgcagctgtttgaactccatgacagttttgggataaaaatatacaatttaaataaagttctaaaatctgatctttagataattttttttctaagtcaatagcttttgaaatttctgaaatttttctggaaattgtttgttcgtcatcaccggttatattttttataagctgctgcgtaatagtactgccgccaagagaagcttggccgcctttaccggttagtttatctaaaaaatatgttaaagtagctttaagtgttctttttatatctactccattgtgaataggaaaacgttcgtcctcaatagcaataaaggcattttgaagatttttaggagttgcgtccagatctacccaaatcctgttttcatcagaagataatgttaagagattcttttcttctcctgtattgtgatcaagatatactatgtttgaattgctgtccattgtcagtgaatccaaatcaatgccgtcagtatttccccacatgcccattacagcagtgagcacagctcctccggcaacagctcctccaataataattgtaattaaaaatattaaaataaattttccaacgtattttcccattattttttccccttataaaatatcaatcatcaaaatactacatattatactatataattatatcacataaacaggtataataaactataaatctgttaataatctattaaattagtgttacagcaaatatgataacacaagatatgggggtactaattatgtataaaaagttagtcaaaagtattatcatttgtgtttcagttgtgttctttactttgatgattggttatataacatattttgcaactgtaaacgttataaacaggtctgtcactaaaaatttaaattctgctgaagcagttgcatcgcaaacaacaccgggaatgcaggaagcaattccaagcagtacacccggaaatgagcagtattatctcgcacgccttaatggaaacagcattgaaatatatttgtgcagtaatacagattcagcaaaagcagctgaaaaatttttatactcatttaaggtatatgcgtcagatatccctgacgatgatattttaaatttaacgcgcggaataatttttaaaactaaagaagaattagcgtcttttgaagaagattacaatagttaaactttaaaaggttactaatgtttcattattatgtttgttcagacgtttctaaatacttctctaaagtataatataattcatctgcatcaacaggtttaatcacatgtgaattaaaaccattatttaagattttttccacatcatcctcatatacgtcttgcgacatagctattatggggatagtagaggagttagcgtgcttgctttttctgatagtatttgccgcttcatacccgtccattataggcatatctacatccataagtattacatcaatatccttatattgagctttattaaaagtatatactgcttcacggccatttttagctatcatagttttaaaattaacagttttaagaacatcgtcgagtatagcaagattaagttcgttatcttctgctataagtattgttttaccggaaaaattatattcttcaggtgatttatatacacgaacttgtttgccgtccttttcacaaatttcaagaggtatcgtaacagtgattgacgttccttcaccttcagtgcttatagcagaaatatttccgttcatcatagaaatatacttttttgtcattgataaaccaagaccgctgccattttgtgcagaatcattgttgtaattattgctaaatactttatccagtttatccttgctcataccaataccggtatcacttacaacaaattcaaggatagcataatttttgtcgccggatggtttttgtgttgattttaagtcaatagtatttccattttctgtgtatttaagcgcattagtaagcaaatttgatagtagtagacctagcttatatgaatcaccataataattattttcagtaatatcatacctgttttcagaaaaagtaatatttctctcattacaaagataagaaaaagtctgtcttagatcatttagaacgcggcttagtttaaatggctcatgatttatttctaaagtctgtatatctagattagaaatattaagcaattcatttacagagttaaagagagtgtgtgctgtatcatcaattgcattaatattttgtttagttttttcagaatcattaagttctttttttgttctgttaattaaagaaataagagtactcataggttgttttatttcatttgacacacaattcaaatattcagattttgcaattccgtttctttcagaaatttttaacgcttctttcagtgtagaagtagatatttccaattttctgtttttcattctcgattcaaaccatttaattacaaattgtatcaaaagaagaagtatcattattaggatagagccaatagcaagaagcttaccatatttctctctaaatgatttctcataattaacatatatagaatttgaaggcaaagacgaactgcttatatgatattttttcattactttaaaatcaaatttatattttgaacttgaattttccgataaaggtatttcggatatattttgtctattaattattgaatttacagtatttgctgcaattatacctgactgctttgaagacaacactgctccacccaaataaccgttaccaatatttaaatcagttaaacaaaaggttggaattgttgtattttctgttattagcttgcacacttcataatcggagtattgctttttatcaatagtttcattcatatttaaatagaacagtatactgtcattattaagtttagaaagagcggatacaaattcttcttcatttaattcagaagaattaatatctttgaaaatgatattagaaaattgttcctgctcagcataaaactgatctctgtcaccgatacctgttaatgtattatcagaaatagcaataatattttttgcgtcaggataaagatttagtgctgtatgaatattgttttcaatatttaatttttctatagaaccagtaattaacggatccattgctgctttttcagcaataaatttgttttcaattccttcaaagattatgggtgtattaggaaatagaacatttttgtattttaaaactaagtcaagcgcttcatcgtctccaacgataactatatcgaaattgtttttatatgaagaaatatgatagttaagaatatcataaaataatgcgtcgtttttattatcatttattatatttgaattcaaaaattcactttcaagtgtaactgagccgtcaagtgtttcgcgtataccttcgagttgtttaagaaccgatgtgtttgagggcgagtatgaacttataaataaaacttgtatgtttttatctgaactaacattgttattttcctcgctaaaaccattagtataactagtagagaaaataataaaaattatggtaaaaaacataaagtattttaacttttgcatgtgttttgttttgaaaataaacattgtagttgcccctttaatttacatatatggtatcattatgatagcataaaaaggtgtgtcgcgcaaggtttatttttttcgctaaaaagcattataatggtgagttctcttttgagcatattttttaaaaaatgtgttgaattataggtttcaaatgtggtacaatgtgagataagtgttattaataaatacattattatctgaaggaattattttatagcacggaggtgtgttatggattttaaagttgtatcaaaatattcgccggccggcgatcagcctaaagctattaaaacattagctgacggtattttaaatggtgataaatttcaaacgcttttaggagttaccggaagcggtaaaacttttacaatggcaaatgtgattgaaaaggtgcaaaaacctacgttagttttagctcataataaaacattggcggcgcagctttgcagcgaattcaaagaaatattccctgaaaatgcggttgaatatttcgtatcatattatgattactatcagcctgaggcgtatattccttactctgatacctatattgagaaggacgctcagacgaatgatgaaattgataagcttcgtcacagcgctactgcggcattatttgaaagaaaagatgttattattgtagccagtgtttcatgtatctatggattgggtgacccaatagactataataatatggttatatcactgagaccgggaatgataaaagacagggacgaagttattgcaaaacttatagaaattaaatatgaaagaaacgatattgatttttcaagaaataagtttcgcgtaagaggagatgttttagatatatttccttctgacgcatataatacggcagtaagagtagagtttttcggagatgaagttgaacgtattacagaaataaacactgtaacaggtgaagttattggtgaaagaaagcatattgcggtatatcctgcatcacattatgttactacgcctgagaagcgtgacaatgctataataagtattgaaaaagaattagaagaacgcttaaaagaactcagaaataataataagttggttgaagctcaacgactagaacagcgcactaaatatgatatggaaatgctgagagaaaccggattttgtaatggaatagaaaattactccagacatatcagcggcagagaaccggggagtcctccgtttacacttattgattatttaccgaaagattttttattgtttgttgacgaaagccatgttacgctgccgcaggttagagcaatgtatgcaggtgaccgtgccagaaaagaaaatttggtcaaatacggatttagattaccatctgcttttgataacagacctctcaattttgatgagttttggggaaagctgaatcaagcagtttttgtatctgcaacaccggcagattttgaaaaagagcaatcgactcgtattgtagaacaggtaatcagacctaccggtttgcttgatcctgaggttgaagtcagaccgatagatgggcaagtagatgacctttacacagaaattgtcgaaaggacaaaaaataatgaaagggtcttagttactactcttacaaagaaaatggcggaaagacttactgaatattttgacgaccttggtgtaaaggtaagatatttacactcagatgttaagactattgaacgtatggaaattatcagagatttaagacttggcgagtttgatgtattagtcggaataaatcttttgcgtgaagggttagatatacctgaagtttctcttgttgctatactggacgctgataaggaaggttttttaagaagcgagacatcgttggttcaaacaataggtagagcagcaagaaacgcaaaaggaaaagttataatgtatgcatacacaattactggttcaatgagatatgctatagatgaaactaatagaaggcgcggtatacagattgcctttaataaagagcataatataattccacagacaataaaaaaagaagtatatgaagttattgaagctaccactgaattaagcaggtcagaaaaaggaaagacagcaaagaagaatgaacaaaaattaattgataaggaacgagcaattgcagaattaactgttgatatgaaaaaagctgcagagcttcttcagtttgaattagcggctcagatacgtgatgaaattagaagaatgcaggaagaataagcgttataataggagttgacataaatatgaacaaaaatataattgtaaaaggtgcaaaggaaaataatttaaaagatattgatttggaaataccaagagataaacttgtagtttttaccggtttaagcggctccggaaagtcttcacttgcttttgacactatctatgctgaaggtcagcggagatatgttgaatctttatcagcttatgccagacaatttttaggtcaaatgagcaagccagatgttgaatcaatagatggtttgtctccggctatatcaattgaccaaaagacaacggcgagaaatccgcgttcaacagtaggaacagtgacagagatatatgattatatcagattgttatatgcgagaataggtgtgccacactgtcctaattgcggaaaagagatttcgccccagtccattgaccaaattgttgactctgttcgtaatctgcctgagcgtactaaaatacaaataatggctcctgttgccagaggacgaaaaggcgaatatgtaaagacgtttgaagacgcaaggaaaaatggatttgtaagggcaagaatagacggaaaaactgttgaaatttctgatatggatattcgtcttgataaacagaaaaaacataatatagacatagttgttgataggcttattataaaagagggtattgataaaaggttggctgattcattggaaacagctttaaacatggcacatgggcttgtgattgttgatataatagatggagaagagttaatgttttcacaaaattatgcttgtgaggactgcggtataagcatagaagaactcacacctagaatgttttcttttaacactccttatggtgcgtgtccggaatgcgcaggtttaggacatattattgaaatcgacccaaaccttattatacctgataaagaattatctataaaccaaggtgcaatagccgcaagcggttggaacggaactgacaaaaattcgatttcgtatatgtattacagaggtttatctgaactttatgaatttagtcttgatgagccgattaaaaatctccccaaaaaaatacttgatgttatcttatacggaaccggtgaccaaaaaataaagctgacctatgacaggaaattttcaaaaggagttcagtatgcaagatttgaaggaataattaataatcttgaaagaagacataaagagacaaattctgactggatgaaagctgaaatagaaacctttatggtggatatgccctgtccaaaatgtgaaggagccagattaaagccggaatctttggcggtcactattggaggtttaaatataaatcaagtaagtgatatgtctataactgaagcttacgattttttctctaatataaaaatcagtttatcaaaaaaagacataataatttccgaaaatatatttaaagaaataaaagagcgattgaaatttttaaaaaatgttggattggaatatctgacgctttctagaagtgcgggaacgttaagcggaggtgaagcacagagaatacgtttggcaactcaaataggttcaagcttaatgggtgtcgtgtatattctggacgagcccagtatcggacttcatcagagagataatgataaactgattgagactttgaaacggttaagagatttaggaaatactttgatagtggttgaacatgatgaagatacaatgcttgctgcggattatatagtggatataggacccggcgcaggaatacatggcggagaagtcgtggcaacaggaaccgccaaggatattatgaaatgtgaaacttctttaacaggtcaatatttgtcaggcaaaaaattgatacctgttccggaaacacgaagaaaaggaaatggatttaacttagaaattaaaggctgtcaagagaataatttaaagaatgtcaacatcaaaatacctcttggaacttttacttgtataaccggcgtatcaggaagcggaaagagctcatttgtaaacgagatattatacaaacacttatcaaatgtattaaatggttcaaaaaagaaacccggcaagtttaagagtataaagggtgaagaaaatttagataaggttattgatattgatcagtctcctatcggccgtactccaagaagtaatcctgcaacatatacaggtctgttttcagatataagagagttgtttgcggcaacccaggaggcaaaatcccgaggctacaagtcaggaagatttagttttaatataaagggcggaagatgcgaggcctgtaccggagacggaataattaaaattgaaatgcacttcttacctgacgtatatgtgccttgtgaagtttgtgatggaaaacggtataatagagaaacacttgaagttaaatataagggtaagaatatttatgaagtactggagatgacagttgaggaagggtgcagcttttttgaaaatgttcctaaaataagcagaaagcttcaaactttatatgatgttggactgggttatataaaaataggtcagccatccacaactctgtccggaggtgaggctcaaagagttaaacttgccactgagctcagcagaagaagcacaggcaaaacaatatatatattggatgaaccgacaacaggactgcacactgcggatgttcatatgcttataaatgttttgcaaaagcttgtagatgcaggaaatacggttgtggttattgaacataatttggatgttattaaaactgctgattatattattgatttaggtccggaaggcggagacggcggcggaactattgtcgctaaaggtactccggaaaaagtggcaaaaaacagcgcatcatatacaggtcaatatttaaaaaaatatttagagaaaaagaacgaaaaagctaaaatataagtgtaggtttgtcaatgatgtgttacaaaaaagattaaaagagttcaccgaaattgataaaagagttgatgtagtcaatgggagctttccaattacatcttttgtgtattaaggatgttcaggactatacagggacttgttatgattttgcaaaacgcacatttttgggtggtaaaaaatatatttcggctgagacgtttgcaaaaaacttgagtgaataaaaaaactaactattaaatgttaaatggtagttaaaaaaattaaatttgacctgatatagaaagaggtgattgaggatgtataattttttgattaaatataggctaaagaccggggcgcctgcaactaaatatataactgtaaaatctgtatcggcaaagctggcaaaacagcaatttaatgaaatgtatggttctgccagttttgaaatactgggagtatataaggaggtgagatcaattgtataactggattatacgaatatcgggagcggtggttggcgttgtattgttagttatggttaggtcgcttgagtggtatcccatattttacgcagctccgcttatgatgatacttttggcattttttaattgcgcagaggacacagctgaagaacaacccatagctgacgatgtgcgtaaggtcgtaatcaagccggataatcggcggtgggacttttcggacgcggagtgcagcagggattataaaaataacagtagcaaaagaatacataaaattgtaatgtgaggtgattattataaaaccaatagttatatgtggaaattcaaagtttgacaggcttgttatggactgcaattttgcggctatggcatatatggacaaggacatcaatgaacagtacagagaatttaggctggaggatataaaagtaaagtccggctgtgcggaaccacaaaccggactaaaaaatatatataacaagaaatctatatcaatataacatataataaaagaattgtcaagctgagagaaggagaaaagatgaataagatacaaaatttatcaactaaagaaataatagagcctgatgacagacttacatatgcgctgaaccgctgtggaattgggataatcaacgaaaattctcctgactttgactggtttattaaggagattattcctgagtttttagagcttttttacagcggtaattatgctgaggctgatgagccggaggaagaactgccggactatggatattatgacaagctggacgaagaatatgagaataagcgattaggaggaatataaaatgtcacaagaaaaattgaatactgtagatataaaaggcaagccgtatgtgcttgttaatgagcgagtaaaggcgttcaggaaaaattatcctaattatggattgataacaactatcgtggaattatcggaaaagcgtgttgttatgtgtgcaacaattaacaaccctgacggttttccgattgctacgggttatgcttacgaggacgcaggaagttcttttattaacaaaacttcatacatagaaaattgcgaaacgtccgcctggggcagagcattagccaatctcgggataggtattgatggtagtatgtgcagtgctgaagaattgggaaatgcacttttaaaccaaagtaaaccagcaaaacgtacgaatgaatctatcgcaaaacagattgatgatatgattgatgatgagccgcttaagacaataaatatagcggctgtaaacaccttaaaagcaaagttagatgaatataacaccgtgtgcggtagaaatgctactgaacaggaaatttctaaattttataaatgctccaattttaatgaattcgattacactaattttaaaaattgcataacaatgcttgatgggtcaatcaaaaaagttggagcggataagaaatgagattaaccggaacgattaaagatataagcatgggttttttagacggcgagtgcaaattaacactcgccgtcaatgaaaaaaatgacttaaaacttgcttatgacgaattgtcacaatgtgagttattggacattgaactcaaaaaacaccgtaaaaaaaggtcgctgaatgctaacgcttatctatgggtgttatgtggtaagttggccgataaaataggcgttgataaagaatctgtataccgtcagcatatcctaaatgctaacgtatatcgtgttgcggaaattaacgaaagtgccgctgatacgttaatcaaaggctggcagatgaacggtgttggctggatagccgaaagggttgacaaatctaataaagacggttttgtaatcgtcaatctatattacggcagcagcacatataacactaggcagatgtcaagattattagacagcgtaattgaggattgcagagaccagggcatacaaacaatgaccccggacgaaattgcaaaattaaaatcattatggaaagctgaaagttaaatgaaaagtattatgcaacaagacaaatcgcattgttatatatgcgaaatgagcgaatgcggagaccatttagacaagcaccatatatttggcggtgcactgcgtgatacgtcggaaaaatatggtttgacggtttatttgcaccacaataaatgtcatatattcggggaatacagtgcacaccaaaactattatatcagagttaaattgcaagaaatagcccaaataagggctatggaagtatatggttggagcgagaacgattttagaaaaattttcggttgtagttatatataaaaaaatctcaaaaggagaataaaaatgattaataaagtaatattaatgggtcggttaaccagggacccggaactcagatacacgagcacaaataagccagtatgcagttttgacgtggctgtcgccagcggttatggcgacagccaaaagacggattttataaattgcatagcgtggaacaaggcggctgagttcctcggtaaatatttcaataaaggtatgatggtgattgttggtggtcgaatttcaactcgcacatgggaagggaaagacggcaaaaagaattatgttactgaggttatagcgaatgaactagactttggtgaaacaaaaaaggcgagagatgaatataacggttacagtcgccctaaacaacaaaattcaacacctcaaaaggcggctgatgattttgaggtgcttgacgacttacctaatgacttgccattttaagggagtgtagaaaatggaagaacaaaaagcgtattatgctatcattccggcagatgtgaggtatgatgataagttgccagccaacgcgaagctattgtatggagaaataacggctctgacaaacgaaaaaggctattgttgggctggaaacagatattttgctgatttatataacgtaacaaccgttacggtctctaggtggataaaaatgctttgtgataaggggtatttaacaagcaatattttttataaaagcgggacaaaagaaattgaatgcagacaattgtcaatcactggaaacaagacaattgttcagcaaaaatgctatgaccctattattaaaaatgataataccccaccaatagaaatgttaaggggtgttaacaaaaatgttaagacccctatacaaaaaagtgcgccacctattaacaaaaatgttaaagagaataatacatataataatacatttaatattacatctaataaaaagaaagaaagaagaaagaaaaccgggtatgatgagataatagattctcttgttgaaaatgaagaattaaaagatacattgcgagaatttataaaaatgcgaaagatgattaaggcacctatgacggacaaagcattaaaattactcatcactaaagtttctaaaatgggggacgtagaaacacagattgaaatacttaatcaatcaattgaaaatagctggaagtcagtctatccgcttaaaaataatacgactaatactgtcagcgtagctaaaagcaagtttaataattatacggatactaacaagactaattatgaggaaatagaaaagaaattatatgataacatgttaggggaatattgatgataaaatttacgataagcggcaggctgccgagccttaatgattatatcaacgtatgcaggcacaacaaatataaggcggcggcatttaagaagcggattgacactcagataatttctgagatacgaaaacagcggataggtaaagcaaaaacgccggtatacatagaatttttatggattgaaaaggacagaaggagagaccttgacaatatatactccggtaaaaagtatatactggacgcattgcagaccgccggagttataccaaacgacagtcagaagtacgttataggtttggtggatatggttgcttttgacaaagcaaaccccagggtagaggttacgatttgcgaagaataataaaaaggagaataaaaaatgatagatttaaaaggcaaaaaagtaatagcaagaggaattaattcaggagtattttttggaacattggtagacaaaaatggacaagaagtagaattaaaagaatgtcgtaatatatggaattggacgggggctactaacctaaatgaaatggcaaaatccgggataaaagatatagaaaacagtaaaatatccgtaaaagttgatagtctaatattaacagatatttgtgaaattatcccttgcacggaaaaatctattaagattatagaaggtgcgccagaatggaaatgttaagtgacaaaattaagatattcataaatgatttagactgtgattttagtattggccatgattatggcaacggaaacggaaacggaaacggttgtggtaatggtcatggcaacagcaacggaatcggaaacggaatcggttgtggcagtggcgatggttatggcagtggaaacggtattggcaacggaaacggctatggcagtggcgattgctgtaacaatggtcatggtgatggcaagggatatggacagggctatggctgttattatgtcaaaggcattaaaactataaacggacatgacctgcatattatagataacactctaacaatgattaccaaagtcagaaataatatagccaaaggattcatagttactagagaactacaattaagaccgtgctacatagccaaaggagaaggctattttgcacacggtggcacgttaagaaaagcgtgtgaagaattagaatataaaataatatgtaatttagatacagatgataaaataaatctttttaaagaaaaatttaaattaaatattaaatatcccgtaaaagatttttacgaatggcaccataaactaacaggtagttgtgctatgggacgggataattttgcagaatataacaacattgatgttaaaaacgacaaaatgacggtgcaagaatttataaagttaacccaaaatagttttgggggagacgtaataaaacagcttgcaaaggagatgaaagttaaaattgaaaactaaatgcactaagccgccgaaagtgccgagccctacgttgtgcggcaaggcacctgacgggatagattgttttgtttgtaagtggtatgcaaaaaatgggattgaaaaggaggatacaaaagatgataagtgataaaatagctgattttttatcatacatagaagagcaatgccaaatgtatgatattgccaaagatatgttaaaagaatgcgatgaagctacgcaagatatattacataacatggaaatagacccggttaaatataaagagcgtgcgagactagctactaaattacaatctgtacgccgccaaagaagaaccgcgaaggatatgacagaaacaacaaaaataatatcaatatgggtaaaagataataaatcaattatagggtcattacaacgattattaggagatataaggaaagcagagaaaaaacagcaaaatagaacctatatacccaggacgaatgttatagaggagataaggagaatatgaaaatgaacaaaaaaattatagggatagtaatatcaatagtcttagttatgttaattgcagggtgcacagaagcatcacgtgtgtcctacaatttgtcgcaacaagccgacaattttaacgatgtgcgccaacttacagttattaactgcattcaaggcgatgtattgttccaaatgacgggcaaaatgtcgattaaagcggatataactgacaatcaacttgaagttgttgttgaagaaaatggagagtataaaaagcatttcattggacttagcgacaatgtaacatatgtcgtagaggatataacctccggtgatgtagataagtataaatatacacttaattttaaccctaagatgtggattccaataggtgtagattctattgattgatacagacagtaaataggagaatagatatggaagcaatactgaatatattaacaacagaagatatgacagagttaagacaaggtattaagaatttaattttaaacgctgtagaaagcgaccttaatatgcgagatgaatatatagtatcacctaattttgtcattgatatagtagatgatgttgttgaatatatgcgacctaaacttgaaagaaaagcagaaaaggtaatgactaaaagaataaatgattatttaaatgcaatacagcagacaaaggagaatgaaaaataatgttacatgcagtaaaaatcgaaccggaatattttaataaaataatagaaggtaaaaaaacatatgaaattagaaaaaatgacatggattatgtagccggagattgcattgcactaaatgaatataagcgtggagaatatacaggacgttttatattaactggcattgttagtattgatgaatatcctctatacttagatacaggatatgttattttacaattaagcccgttaggacttgaagataacataaatcatttcgaaagttatgtaaatccagaaagatttaagggggaaaattaaatgaagaaaaaatatattaaaagattaattgaaagagatacgccaaagaaaccatatttagatactgacacattaagagcggttaaacctgccgttagatgtccgatgtgtgattatattttagttctacaaatggaacagttttgtccttgttgtggacaaaggtttgtagagaaaaagaataaataatattatttaaacaaaaaaacgccctgcatatgcgaggacgctcgaaaaataataaacatattatatcacataatagtgataaagtcaaggagtgttaattaatatgcagggtgtgactatagaagaaacaaaacagtggttaaatcgtggttataaactacgagagacgataagaattttagaaaaagcgcaaatgcgcgcttatgacatagtgacgggtacgacaataacactatcggaaagggtacaggaaagtcacgggaatggaacagagaataaattaattacatacgcagattactgcaggcagatagactgtcataagacagatttatttgaaatcttgaaacaaataacaaatgcaataatgaaagttgaaaacaacatctataaaaacatactcatatcaagatacattaatttcgagacatgggagaatatatcacaaaatattggatattcatacagacaaatactgagattgcatgaaaaagcgctacgaaaagttaaagatgtccttgaatgtcacattgaaagtgtgatatagtgtataatgtaggaaataaaaaatttctcctttttaaatttttttctatgagccgttaccttatggggacggctttttatattgcgattttaggtcttgtgggaatgatacatcataaataaatgctgaggggtgggcggctgtgatgttaatggaggtaattaattgtggaaataatatataaatcaacaaaagaaattaagccatatgaaaataatccgagaaataataatgaagctgttgagaaagtagcagttagcataacagattacggatttagggtgccaattattattgatagtaataatgtaatagtcgcaggccatacaaggtataaagccgcgttaaaaataggctgtgaatctgtaccatgtatagttattgatgacttaacaccggagcagataagagcatatagattggtagacaataagacggcagaatattcaagttgggattttgaaatgcttgaaaaagaattaaaaagtttagatatagatatttcagaatttgaatttcctgatttgggagaaacattggatatttcagatgatgatttttatacagatgagacagtaaaaaatgttaaagtgaaatctattaaatgtccgcattgtggagaaacttttgaactatgaaaatatatcttgctacatcaagtagtggtgtgaaaaaagaacaaagaaaagaaatgataaaatgttgtagaccattatatttactagagactttttattcaggcgaaaaatgttgcgcaatggttcagaatgatgttggcacggataattttcttcttgacagtggagcattttcatatatgaatggaaagtctataacagaaaaacaaatggaggaatatatagaaaagtacatctgccatataaaaaaatacaatgtaaaatacttttttgagatggatgttgattgtatatttggtcttgaaaaagttgaaatttggcgcaaaaaaattgagaaccaaactggtattaagtctatacctgtgtggcataagtcaagaggtatagactatttcaaacgaatggtcgatgaatatgattatatagctataggtggtttcgcaaatggtgatataaaaaagacagaatatccattaataaacaaaatgattaaatatgcaaatgtgagaggaacaaaagttcatggtctcggctttacgcgaatgaagtatatatatgattatccgttttatagcgtggatagttcagcatggtgcacaggtgctgtaagaggaggacatttatattattttgacggtaagataatgaaatatgacataataaaaaatgggaaaaaattaaatctatctataatggctatgcggtcattttcagaatgggtgaaatttcaaaaatatctaaacacaaggagagtagtatgagaaaaacagaaaagaatttatcaatattaacaatattgtttgtagtatcattaataatttcaaatgtaataacaggtaaaatcattaataccggtattccgttttggggttcagtgataacgataccctgtgcggttttatgctatcctataacatttttaattacagatgtagtcggtgaggtttgggggaaaaatgaagcaaatcatatagtaagattaggacttatttcacagatagctgctacgattataattattattgggaaatatttaccttttattgacgcagaaatgcaacaagcatatataaaaatattaggacaaaattggatattcgtgattggttctttaactgcttatctagtaagtcagaatcttgatgttcatatatttcatagattgcgagataagtatattaaaaaacatggcagtacaaaaggtggtcgctggatatggaataatgcaagtacaatgacaagccaatttgtagacacattaatttttataacgatagcttttggatttggatttggttggatatttaacaatcagattactctaataggtatgttgatagggcagtatctaattaagttgataatagcggcacttgatacgccgtttttttattttctgacaaaaaatataaaagaaataaattaggcagtgtggggtgctggtaacgccccacacttacgctagagcacctacctctaacgcagatagcccttctcggccgagattgctacctgcaccattatacatgatttagaggtgcgatgtcaaatggaaatagataccaaaataaaagaagcgttagaaaaacgtgcttatggttttgaaattgaagaaaaagagtttataaaaaataagaataatgaaaatactgggagaataaaagtaacaaaaaaatatattcccccggatgtaactgctttaagaacgattttgcaattaaagcaggcagggaaatggtgaggttatggcaaagggcaaatataaaaaatggttgaaacctgaaaatttattattaatagagggctgggctagagatggattggttgatgagcaaatagcgcataacatgggtatagcgtgttgtaccctgtatgagtggaaaaataaatatgcagagatagacgagaccttaaaaaagggtaaagaggtagtagatttagaggttgagaatgcactgcttaaacgagcgctaggttacatagtagaagaaaagaagattgaggagaatggtataggtggagaaaaaactataactactataaagcatatacctggagatactacagcacaaatattttggcttaaaaatcgtaagccaaataagtggagagataaaccaacaacagaagacaatacacaagaccaaaacataattattaatattagtccggctacaacaaacgatatggaagatagttatggagattaatttaaaagtcaataaggtatatataccttatttacaaaaaccacaatttacacagatatattacggcggttcctcaagcggaaagtcgttttttttatgtcaaaaaattattattgataatatgaatggttgtaattggcttatatgtagagcggtcggcaaaagtattaaacgttcagtttttaatgaaatctataaagctattaattatatggaacttagtaatttatatagctttaatttttcggatatggttattacaaacaaggtaaatcaagcgcaaatagtctttgccggattagatgacgttgagaaattaaagagtataacaccacgaaagggcgttatagaacgaatatttattgaggaagctacagaagtcaaaagaaatgattatttgcaactcaagaagcgtttgcgtggaccgtctaaaataagcaaatgtattgttatggctttcaaccctattttcaaattacattggatttataatgattttttcgacaataaggttgaagacggttgcaagaaatatgaagataaaaaagtatctattttaaagactacatataaagataatatatttcttacaactcaggatatagaagcgttagaagacgaaagtgacccatattttcacaatgtatatacattaggcaattggggagttcttcaaggtctcgtatataagaaatttgtagagaaattctttaatgtttacgaaattagcaaaagacctggagtagtatcggcgtttggacttgattttgggtacacaaacgacccttcagctttattctgcggattggtagacgaaaaaaataaggagatatatgtatttgacgagttatacgaaaggggactgaccaacatggaattggctccaaaaatacaactaatgggttacggcaaagaaaaaataataggtgacagtgctgtacctcaaacgattgaagaattaaggcaattaggattatcaaggatagagggagcgtacaaacatgaggttatgtacggaatacaaaaacttatgaatttcacctttattatacaccctaaatgcagaaactttataaacgaaattaataattactcatacgccgaaaaagacggagagagtatcaataaaccaatagataagtttaaccacttaatggacgctatgcgatatgcggttatcccgaaattagagggagatgtatttagctttaagtagcaggaggataaaatgtttaatttttacgaagaaacgcagagaattattaatattatatcaaaaggcgcaaataaagcgccaactatgaaaagaatagcggaaatagaattaaataaatataagcagagcaaaaagcgtaaaaaaatgcttacaggaataaattattatgatggaaaacatgagatactcaaaaaaaagcgacttgccattgaagagggcggtcaggcttccgaacagcactatttgcctaattctaaaataattaataatcaatatcgcaaagctgtagaccaaaagtctaattttctttgcggtcgccctatagcaattgacacggataacgataaatataccgacgaacttaataagatatttgacgaaaattttcatgcaatacttaaacagacggcaaaaaacgctttaaattgtggtatatcatggctatatccgtatatcaacgatagaggagagttttccgtcaaaatattctcaggtattgagatattaccattttggcaagatgaagagcacagatatatagatatggcttgcagattatatgttatcccaacatatgagggggaaaacgaaaaagatgtggagcatgttgatatattcttgcctgaggggattgaatattatatatatgaaaatggaaaattagtgattgattctgagcgtgaacctgaaccatatcttacatacaaagataaagatgataatgttatatctctgagttgggataaaataccgctcataccatttaaatataactacgaggaacaaccgcttatagaaagggtacaatcaatacaagacgcaataaatctaataatgtcaaattttgaagataacatgcttcaagacccttataatactatatatgtattgcttaattatgacggtgcggatttagaagaatttcgacataatattgcgcagtatggagcggtaaaaataaggtccgttaatggtattgatggaaatgtaagcactatagaagtaaaggtggacagcgaaaattataaagctatcctagaccaattaaaaaaagcgttaatagaaaacgcaatgagttatgatgcaaaagacgacaggcttggcggtaatgcaaaccaaatgaatatacagagcatatataatgatattgaccttgatgctaatggtatggagttagaatttcaaagagcgttaaaagaattattgtggtttgctgatatgtatttatacaatactacaggtcaggattttacgaacgaaaaagtaaaatttgtattcaaccgcgatatgatgatgaacgaaagtgaaataatgacaatgcttcaaaatttaggagtgcaaatttcacaaaaaacattaatttctcaagtgccttggatagatgacgttgaaaaggaattgagaagagttgaagaggaatacaatacaacgaacaacgatgagtataataacttagtcaatcagatgagaggtgaaagcggtgatttaggaaatgccgaagaatgaaaaaatagaaaagttacttaaacgcaacggcgaatattggtcggggcgttttttgtatcttgaaaaagtacaaagtaataaaaatatagaatactttcacaatcttgaaaaacagtacaatgaagctgtgcagacggtaacaaacgatataaataactggtatatgcgatttgctgaaaacaataaaataacatttacagaagcaaaaagattattaaatgcaaaagaacttaaagaatttaaatggactgtggaagagtatatacagaaaggcaaagaaaacgccctaaataaacagtgggtaaaacagcttgaaaatgttagtgctagggtacatattaatcgtctagagagccttagaatacaaatgcagaatcaggttgaggtattaatgggtaatgagttagatgatataagcaatcttataactgacatatatcaagatacctattatcgttctatttttgaaatacaaaagggttttggagtagggagcagctttgcaaaattagatacaaaattaattgaaaactatatacataagccctggacacccgacggcaaaaatttcagtgaaagaatttggggtactcatagaccccagcttgtgagagaacttgaaacaacgttaacacagtcagttatcagaggggagcagcctaaaaaaatagccgctaagatagcaaaacgatttgaggtgaagaaacatcaagccgaaaatcttgtattgacagaaacagcatttttcaaatcaaaatctacattggacggatttagagaaatgggagttaaagaatatcagaacgacgcaactttagataacaaaacatctgatatatgccaacatatagacgggacacattttttagtatccgagtataagccggggattacggcaccgccttttcataatcgttgccggactgttgcaataccgtattttaacgatgaatttacggtcaatgaaacaagggcggcgagggacaaggatggggatatatactcagtgccgggtgatataaaatatgcagaatggaaaaataaatatgttgaggattctatatcagataatgaccgtaagttatttaataaatatgtaacaattctaggactaaatgcgcctactattgacgaatttgtgaaaatgaggtataataaaaaagagtggggacagtttacatcttattcgagttcaataaaatccggtgaattatctcctttggctacatttgaattatataaaagtatcagcaaaaaattgatgataacttaataggcactattacaagcaatggaataaagataacagataaatctaagcattttatatcaagagtaatagggtcggttgagcagaggcgtaacggcgtaaatgtcaaagatgtattagacgtgcttcaaaatcctgcaagattaggtgatattagaaagttgaagaatggaaaaagccaaagatttattggcgacttattaacggctactgttaatcctgataccggagtgttaatacaggttaacccaacaactagaagaaaggggtttaagtgatgaatattactgaaaaacaaaaagaacttgtgaaaaaatatttgaaaaagtcatatactgaaatatatcaactcctgttagatttagatgataaaataacagaaattggttttgatgagaattacgacattaacgaagagggcatattattgcaaaggctatatgatgacctctattatcaaaattctgaaatataaataagctccgatttatcggagcttttattatgctttaaaacagaggtgaaattatgattaaatgggcgttaccgattttacaagtagtctttattatctgcaaggtgttcaatttattaaattggagttggagtatagttttcataccgagttatatttggctgactgtattctttatattcctagttttctgtttaatatttatatatttggggggcaaaagatgaagtgcccgtataaagataatagatttgaaaatacaacatcaaaatatatctatgacgaagacggaagtctaatagaaaataaaataacgacgtgtaccgcttctacttttggaaagtgtgacggcgaagagtgcgcagcatataaagatggtgtatgtcaatatgtattggtcgaaaagggaggttgagagttaatggcaagagagccaactggaaataaatttaataatgattgagccgcataaggctctttttttatgtgcaaaattcgtctttttggtattgcagacgtaaaagaacaagactgatagccgcggactataccgcgtataaaaaatgtaatcaagaaaggtgtagtgtttaatggataaagcatttttaaaggagcttgggatagaagatgaaaatataacaaaaattatcaaagctcacaatgaggaaataaaggacagttatgtaccgctttcccgatttaacgcagttaatgaggataaaaaggaagcggaacgaaaagcaaaagaattaaagagccagctggacgggttggacaatgtagatgttgcggaattggaaaatacaattgagacattaaagaacgaaaacaaaaccgcacaggaaaatcacgaaaaagaacttaggaatataaaaattgattatgctcttgataaagctttgatagacgctaaagctaaaaatattaaggctgtaaaggcgttttttaatttagatgaactagaacttgataatgacaatatcaaggatatagacgataaaatcaaagcgttagcagaagatgatacaacaagttttcttttcggttccgacgaatcgagcaagggtaaatttaagggtgttaatcctgtgcaagtaccaggtgccggaagcggtcagtctgacgatgatagtgtaggctcaatgtacgcacaaaaatataatgctaaatttggcgttacaaataacgaaaatgaataggagtgaaagtaatggctttaacaacaataaaaagaacagaaactagacctaactttttagaatcggaagtaggtttggtgcttaaaacggcacaagtagacaacgcaaatattgaagctgatgaatatggatataaaacggtgaaaggcggtacaccttatccagcgaatgattcaaccgcaaaaggtcttatttttgaagatgtagacgtaactgttggctctgacaatggggtaagaccggccagcctaatggttgcaggaagagttttagaaaatagactgcatactccgttgagttcggcggcaaaaacagcacttacagcattggggtttgtttttgttgacgaacctgtaatcatgagagaaccaattgaacccaaagagtatacagcaggaacaaccgcgttcagcggtagcgatatagcctacggaagtggtgagctaacgattactgctattgatgacagcaacactgattcggcagtagctacagttgcattgtcgtcttcaactcataaggttacagcaactaaggtaacggcaggtaatacaacggttgattgcactgtatcagacggcacaaatacagctgtgattactgtaccaatagaattagtataggaggactataaatgaatattttacaattaatttcagacaaagacagattgtcattttcgcaaaatctgtctatacagagaaactatttaggggacactttatttcctgatttgaagacacagcacttagaagctgagtattttagactgactgacggtcttaatctgccaacaatggcgcaagtacatggttttgatacagaagcggcaataggcacaagaccgacgttagaaaaggtaacaattgagaaattattgattaaagaaaagattaatcagtctgaaaaaactcgaatgtatctaaagaccggagtatctgagcaagcattggtttcatatgtatttgacgatatgggtcgtcttgctgataacgtaaaaacaagaactgaagtggcaaaaatggaagcgttatcaactggtaagctgacagttaaggaaaataatcttgattttaccattgattatggagtgcctaaagaaaatagaatgtcagtagattggagttctcccgaagctgatattttaggggacatacggtcaatgattgatattgcgaaagaaaacggtcatactgttaacagatgtgttgcaagtaataagatagtaaccttgatatgcaaaaataaggcagtacagacggctatgtatggtgtaaatggagttggaacttttgtttcgctcggtcagcttaatacaatgctcagtaatatgtttggctttacaataactgtaaacgatgatagatacagatataaaatcacaaaagacaaatacaagacaaagcgttatatagatgaagatgtatttattttatttcaaagtctagacggttctataggtaccggactttggggacccactcccgaagaggaggatatgggaccttatacagaaaagtcaagtcagcagtatattaccttgacacagtgggagacaccagaccctagagcggtttggacaaaagcgagcggtgtatttattccggttctcccgtcccctgaaagcctgattataagcaaggttaaattagcgtaaacgaaagggggaacggatatgttagaagaaatatatgcagctcttgaaagttatggttacaacgaatttgacggttctgatgagatgattataaatcttattattgataatgctgaacagcatataaaagggttttgcaacatttctcaaatacctaaggacttaaaacatacattcatacatagcgtatgtggtgagttcctatatcaaaaatataatagcggaaatttgccggatagttttgattttgaggtagcgtgttcgtcaattttggaaggagatgtaaaacttgatttcaacattaacggaacatcaacagcagagcaaagatttcttaaaatggtaaacgaactccgttcccctgattacaattgcttgataagacatagaaagctggtgtggtaaatgaggattaaaacgccaacagctatccagattcagaatgcaattacaagcatgtggaacggcagaatgaccgtgtacggaaataaaagcgtgtttaacgaagttaccaaaataaccgaaatagaaaatgatgtagtcttagccaaagatataccatgcaggatatcctttaagacaatttcaaaagtttctgaacaggacggcgcatttaaaactgcacaggaaataaaacttttctgtgcccctgaaatagaaatagcggaggggtcaaggcttgttattacccaaaacgatataacaaacacatacgaaaaaagcggcacaccagcaatgtacacatatcatcaagaaattatattgtctcttgtagaggagtgggtataatgatacgctgtaattttaatgatttaaaagtgtttagggataatctagataaattaacaaatgcagaatatgacagattagcaaaagaatgttgtaatgaaattgccgcacgactgttacgaatgacacaaaaaaatacacctgtagctactggcacattaaaacgtgcttggaatatagagccggcagagaagaaaggtaatgtgtgggtatctgttatatacaatacagctgattatgcaatctatgttgaatatgggcacaggacaaccaatcataaaggctgggtaaccgggcgttttatgctgacaaatgctgaaaaagaaatagaaaggattgtcccacaattgctagaaaaacggttattgcagaaactaggtgaagtatttgactaatgaaacaattgcaggaatatcaaataagttgtatagcttgtttggagaaaattataaaatatatactaaggaaataaaacaggacttgaaaaagccctgtttttatattgtcaatttatctgtcagaaacagggtttcactaggtttgagatataatcacgaacagtcatttgatattcatttctttcctggaaaatcaggcagtcagtctgagatgtcagagattgcggataaattgatgacaaaccttacatttattcaagtacaggataaaagttatttgtatgggtctaatatcaactcccagattgttgaggatgtgttgcatgtttttgtcaattatgacgtgccgatgaaaattgttaagaccgataatgagtatatgaataatttagaaattaatggaggtatgaaatatggcaattaaaaagccggatgaaatggaagtaaaagacaaatataataaatccgttattttgcagtctgcaaaatacaaaaatagacgtgatttgcttgatgtcttattagatgagaagaaatactatacaatttcggaagttgaaaatgcaataaaaaaatatatgaacggaggtagaaaataatgttaggtggaggtactttcacgactatgaacaaagttctgccaggttcatatatcaacgtaatatcaactggcaatgcgacggcggctttgtctgatagaggttatgtagccgtaccaatggagcttgattattctcctgaaggagtttttgaagtaacagctgcggattttcagaagaattctgtaaagttgttcggctacgagtacaactcagaaaaaatgaaaaatatacgagagatattttgcaaggcaaacactgtgtatttttataatatctgcgaaggcggcaaaaaagcaacaaatacatatgctacagctaaatatccgggcgaagctggaaatcaatataaaataaaaattgaagaatcggtagatgatgaaaaccgtcttaatgttttgacaatttataacagtacggttgttgatgttcagcaaatagaaaaaattacatcagcaagcacagaaaacaacggacttgttgataatgattatgttgattttaaaaagaatgttgtaccaaccgtaacatctgggagttctttatccggtggtactaagggaacctcgtcaggagccacaatacaaaaggctttggattcgttagaatcttattcgtttaatattcttatttgcacattgacacagacaacagataagagattgtatgtaaactatgtgaagcgattaagagacgaaaacggtattaaatttcaggttgttatacatgacccagaaaatgaaattccggcagattatgagggctgtattagagtgcctaacaaggtcgctgacggttctgaatctgcgcatgaattagtttactggacaggcggagcagaagcggcgtgccgtgtaaatggctctttaacaaatgttgaatatgacggggaatataccgttgacactaattatacacaaacggagttatctaactttattcagtcggggtttttggcgttccatagagttggaaacgaaacccgtgtgcttgatgatgttaacagtcttgtaactgtaaccgatggtaagtcggaagattttaaacgcaaccaaactatacgggtaacagaccaaatatctaatgacatagctgttctttttaacacaagatatctgggaatatcaccgaatgataatatgggcagagcctcactaaaaaatgacattgtgaaaatacacgaggatttgagaaatataagagcaattgaaaactttgcatcttctgatgttacagtcgaggcaggagataaaaaaggttctgtaatcgttactgatacaattacaacaattgaagctatgagacagttatatatgactgtttacgtttcgtaaggagggaaaataaatggatgaaaaagactataacatagcaaataatgtggtgatgaaagctaaggacagtttgcaagctaatttaggaaaatgcaccataactaatggcactaagcgttataactttatgcaagcaattaatcttgaagccaactttgaaaaaacaaaagaagaaattccgatactcggtaaaacaggtaaagggaataaatctacaggctggaaaggaacagggtcagcaacatttcattataacacttcaatatttagggaaatgatggctgattataagaataccggaaaagatgtctattttgacattacaattgaaaacggtgacccaacgtcagacgctgggtatcaaatagtaacacttaaagactgtaatatagacggtggtattctagcaaaatttgacgctgacggcgggtatcttgatgaggatatggacttcacatttgaggactttgagattactcattcttttactgctttgacaggatttttaataaacgataatagcaacaacaataacaacaataatagcaacaactaataataggaggtaaaaagatgggaacattaaaagggtttttgaatcctaagaaggttgaaaatataaaattcgtggtgagcaacagattcgttgatgatgacggtaatccgttagaatgggaacttagagcactttcggcaaaagaaagcgaattgctgcaaaccgattgtatgataaaaaaagcttccagcagaagaggggtgtcaagtcttgatttagatgctgctttatacacaaagaagatgatggcaaaatgtgttgttaagccggatttgaacgagattgacatacaggacgcttacggcgtttcttgtgcggaagatgttttgggaaacatgttgacaagcggagagtacacagccctttctaacaaattattagatgtaaacggttttaatgaaatatttgaagatgaggtaaaagaagcaaaaaactaataaaaggtggagacgcagacagtaactatgcttattactgtctgcatgaactccaccttttacctagagaatatttaaatttgtcccgaaaagaacaggctttcattgcggcgtgtattgagataaatcaggaggagataaaaaagattaataaaaagaacagtaaaaagaaataaggggtggttattataggaaaaacaatgaaaacagcaatagaaatacaggataaagttaccgcacctattaaatcaatgtataatgctatgaatcttcttatttccggatttgagagaatgcagaatatgcctggaaatcttgtagatacaaagtcaattgccgctgcacgttctgaattaacaaatgtaaaaacggtattgagcggagcagaaaagggcgctaaaaagttgaacacagcgtcaacatctgcaggaaatgctgttaagactattggtcaatcatcagctaacatatccagagtttcaagttctatgaattcagctgtaaactcaaccaaaagattttctacagccacaactcaatctattcaaggattaagaggtcttgtgacaagcctaacaaacgcaaaaaataaaattgtaagcgcaacaactactggtatatctaaatttaaacaacttgcaacatcaatgaaagaaagttcctcttctggtaatggtctggttggtgtgttaggaaaagtagcggcggctgtaggctctgttatgggagtaaaacaaattatcggcttatctgataccatgtctcaaacaaaggctcggcttgatttaatgaatgatggacttcaaagcactaaagaattgcaagatagaatttttgattctgcccaaaagtccagaggttcatatcaagatacggctgacctagtatccaaacttggtctaaatgcaaaagacgcatttgaaaacactgcacaaatcgttgattttgctgaacaagtgaataaacaatttgttatatccggtgcgagtgcggaggaaacaaaaaatgcaacattgcaattaacacaggcgctatcatccggagttcttaggggcgatgaactacgcagtatatttgaacaagcgcctacattgattcaaagtatagcgaattatatgggtgtgccaatagggcgtatcagagatatggcagcagaaggacaaataacagctgaaacggtaaaaaatgcactattagggtgtgctgatgaaacaaacgctaaatttgctagtatgccattaacatttagtcagttgtggacaaattttaaaaatagagctatgcaagcgtttcagccagttcttgaaaaaataaacgagcttgcaaataacggaaagctggaagaatacataggtaaaatagctgaagcaatggcgatggtcagtgatgtaattatgaacgtcataacatgggtattagaccatcaagatatagttaaggcggcttttattgggctttctgttgctattggtgcaatgactgtagctatgtgggcttttaatattgcttcatatgccaatccggtaatctggattgttttggctatcatagcagttgtagccttattagtggctgggatagttttagtcgtcgaacattggaacgaaataaaagatgcggcaagtgcttgctgggaaggtgttaaaagtgcttgggggaatgttacagatttcttcaaaggaatatggaatagtattgtttccagcgtaacaggtctgtggaataatattgtttcgatatttacaacgataaaaaatttttttgtcggcatttggaacagtatgtatactgttgtttctacattttggggtgctatatggaatactatttctccaatagttatggctatatggaatttaatcagtacgatattcactataatatggacaataatttcaaccataatgcagggaatatttcacgtaataagtaatgtgtggaacgtaatatataacgccgtttcaggggtgctaatctctatatggaacattataacaagcatatggaacagtatatacagtgccgtctcaggcgtattgtcctcaatatgggatgcagtgtcgagcatatggaacagtatatataatgcaatttcgggcgtattaagcagtatattcagcactgtttctagtatctggaacagcatattctcagctgtaagaaataaggttgttgaaatatataacaatgtcaaagacaagtttacggaaatacttaattatcttagtggtttgaaagataaatttttacaaaaaggacatgaaatgatagacggtcttataatgggtattgcggataaaataaacggtgttacaagtaagattaaggagttgggagaaaaagcggttggggctataaaacaattctttaacataaattcaccgtcaaaggtaatgcgtgaactcggtaactttacatttgagggatttaatcttggacttgcagaccaaataaacgctatcaaaaacacatcacttaatatgggtgcagtggttacggctaattcaatgcctgaccttaaagcaaatctggactattcaggaaaaaaagatttcagcgcaatgcgtgagactatagctagtaatactactaacagtacatatattcacgctcctgttactgtaacccaaaagaatgatattgttgttcaaaatggcgagagcactgataatcttattaagaaattatcaagaggaatggaagaaaacgcagaaattgtgtggaaaggggtattagcataatggcttattctttttttgtggcaggaacaaaattaccagtgccgccgtcatcctttacaactaaaatcgtaaataaaaatgagacgtatgaactagttgatgacggagaaataaatattattaaaaaagcgggattgaaagagttttcatttgaggttgaattaccgtgtacagaacgtccatacgctaattatgaagatggttttcttccgcctttacattatttagaattatttgcatatttaaaaagcgaattattaccgttccaacttgatatttatagagaactccctagcggtgaagatacatattacacgaacgaaactgtgacactcgaagattatacagttaccgaggaagcgactaacggtcaagacgtaaaagtcgaattgaattttaaaaaatatagacagtattcaaccgctaccgttatgcaagatgaagacggattgcattatactattgtccggggtacagataagcgaataaacagggttgtagatgtgaaagacggtgacactttagccactatagctatgagagaatttggacgggcagaccaaaatttgattgattatctatacgctataaataaagaaaacatagatgctgaatgtgcaaaaaggggagtatctccaccacagatattccccggtatgtctatacgacttactgacgacagtttcgggaatatcgatgaatacaacgccaataacaatgttggcgataataagttacaggttgaagacgtaaacaagataactgaggagggattaacagtgacacaatacgaaagtataatgcagactgttatgggacatcaaaacagattaaacgctatgagcagttatatgatatataactatgttgataagaatatgccgaaagaatttcggccaatagtaagatttttaaattataagggttggttaaaaggagatgacagcggagaactcggtttaactgatgatatgcttagaattttagcggctcttgcccgttccggtgcttttggtaatgactgtcctacccctgaagatgaaaaagactggggggattaatatgagtgtttgcagagtgtacattgaccctctgagagattacagcggcaataatgcaggagcttcatattttggagtgcgtgaacaagacatgaactggtttgtggcaaaaagagtttctgaaacacttgataattacacatttatgaactcacagaaatattcatcttttgaaactcatttaagccgggaaacaaaagaaactacgaaaagtgaagatatgtgggagagcttgcgtatacgtctgaatgagagtgaaaagctatgggacgatggaggagagcagacaccttattacatttatttggggataggctctgaaccgtccgggaataaagagaccagtacagaaagaggtataagctgtcactatgaaaagagaaatgcaccgggtattgataacgatacgtggaacgcatggagctatagtttagctgatactatacttaatacagttgtgaaaaatactgatatgcctgaatataaaatacctataacgctgacaaggtatctgccaataaatgaaaatgaaaaaataatgtgcggtgttacggctcacgtaggacgaataaataatgcaaatgacgctagattattatacaacgaagagacaaggaatgctatagctgacaatatagcggaggctatagcatattgggtagaccaggattacacaagcgggaacgtgcctgataaatataagacaccatatacagccatagataacgccaaagacagggcaaaggcagttcttgccgaaatacagaagaacgaggaattattgtctgaaatagaaagccgaatggtatacaattacatagataaaaatttcccgtcttatgctataggaaccattgaatatttaattgacaatggatttttaattttaaaaggagacgatagcggagaacttgggttgactgatgacatgatacgtcaaatttgtatttttgcccgagctggtattttcggaaaagattgtcctacacctgaaaactatatcccgttatgataaatgtaattgacaatattttcctcatatgatatattaattacaatatattatatgggaggtaattttttgaaaaaatttgtttgcggattattgattggtgtaattataagtggtttagttggagtgtatgcggtaaatcaaatatacgataatccatattcgatatatgttaacggagagcaaaaacagatacagggttataatattgacggttatagctattttaaattaagagatatagcgcaggcaacgaataagttcaatgttgattttcaaaatgataatgtaattattgatacgtcaaaagggtattcagaggagaataagcaaccggaacaattaaaaatagatgaaaagaaaatatattgtgattatttaaataatgttgaaaagattgaagttcttaatcatccggcaggtgatacaactgaatatattagtgtaaatgatttattatattatatgactgatgttaataacgacggggtgcaagatttagcgttttcatcaaagaactatcctaataatgggttaggtattttaactatagataataatagggttaccgaacttataactccttctattattccttatagtgctggttccgaaacatgtactttagctatgtatgataataaatatgggatatttaaacatagggagaattcagctgatgattttgtttttaccactattgttggaaagagtaaatttaatacaactttaagtggctatcatcatgaagatattggttatataattaacaatgaaaatgttggagaattaaattggtggtcgatatttaacaatattattccagtaaaattttatggttttgattctcttgtatctacttcaagtgagtattcaggggaagagccagacgatattatatattatgattatggaaataatagttgggctcctgattatggagcatattctggtttaaaatatgggataaataatttagaatcaatcattgattacaccgaaaaacaattagtttctaacagcagtgttattacgtatgaatatgtatataatgaaaaacaaattaattcatatatagaattattaatgagtattgggtttagtagaagataccttgaaaatgacttgtttgtatatcaagaaaagtttcctattttaatgtataaaaaaagtgatatagtgctatcaaaaaacggtaattatattactataaataattctcctgattatgaaaaggtttttgtttcgacttctcccggtaaaagtccagaagatataataaaagaggctcaaaataatatagataaactttacttataatatatactataaataaatatttttcaagacaccttagagggtgtcttttttattgaaaaaagaggtgaacaaaactggctacggcaaaacagttagtagaaatcgcagaaaaggaaataggatacactgaaaatagcggtgtatacaaagagtatgacagtaccgggcaagcgtggtgtgcatattttgtttcttggtgcttaaaaacagccggaatcagtgtttatggaactcaaggcgcagcggcggcttttgcatacatggcagaaaatgagggaaagggtacatttcacggtaaaggaagtggctattcaccaaaaatcggggatttgtttttaaaagattataacggggttgattgggcttcacatataggaatagtaagaacggacgccgcaaatggaagtttctcaagtgtggagggaaactctagtaatagtgttgcttctaatacccgcaatgtttcagattattgttatgtgacaccgccttttaacggttctagtgttggtgctgctcccttagctccgcaacgtgaaatagttattgagttgcccggcggtcttggaaaaatatatacatatgaaacgtggaaccgggaggaacatggatattctgcatggaattctgattctgcgcaaaagaaattgataaccgtttcaaaacagcgcaatgaatacagttttgacggtgagggatatggatttgtcggcaagcgttatgttgtagcaatgacaagcacattcggggatattggtgattatgtagatatttattgtgccgacggtagggttataaatgctgtaataggtgatgaaaaaagtcaaacatatgaagactgggacaataatccggctaataaatggggacatgaaaacggtcaaattgttgttgaatttttgacaaattggtcagctaatccattgcatgaaaacccgtcgtcaaatggtggggttttaaaagttatcaatctaggaaactattttaattatcccgaatatgctattggatttgacggaacgggcggtgtcgctgacagcaatagcggtaaaagtataacatcaatacagactatgtcatatataggcgccagtgtagattttagagaaaatcctcttaacagcaaaaaaatgttaaatcaaaataatatagagttatatatatcaggagcagaaggagttatatataaaccggttgtagttgatgaaataacgtgggaaacagaagcgtacggaagtccggcacagcttgaatttactattatcaaggatgcgtatatatcttttgaggagggtgaccaggttatatttaaatataagggtgctcctgtattttacggttttatatttcaaaaacagcgaacaaaacaacatcatataaaagtaactgcttatgaccagacaagatattttaagaatagtgactgttttgtatttgagggctgtacagctacagaaatagtaaaatctatttgtaatgattataaaatagcatatggccaacttgaagacacaggcgttaaattgccccttacagtttgcgataatattcaagttttcaaaataatagaggatgcattggattatacggtagcacaaggcggctatcgttttttattgtgggataattttggctctttagttttggctcctaagttttggtacaaaaaaaattatgttgtatgtgattttaccgcccaggattttgattatacaacaaccataaatgaggggacatatacaagagttaagctatattatgacaatgaccaaacaggtacaagagaagtgtatatcagagataaatctgtcgaatatcctaaatttggtgtactgcaatattgcagtactcttgatgagggggaagacggagtaaaaaaagctgaggaaattataaaaattaccaccaataaaataagaaaacttgatataaaaggagcgttaggagatgtaacggtaagaggaggaactcaggtatatgttgagcttaatttaggggacataattcaaaaaaagtggatggaatgttttagtgcaaaacacacatttaaaaatggagagcattttatggatttacatttagtaggagggcaatttatatgattgatataacggaatttacaagggcggtaaaacgtgttgccgttcaggctgttaaagaaacagttccggctaacgctgtgtttggaacagttgtttctgccgagccgttgcaaatagatgttggatatgaaaaacctataagcggaagtcttataatactaccgctatgttttgataaaaaaacatatacaactacaagcagcggtagtccgccgcatagacacacaatagaaattgataacagcctaaaggtaggagacaaagttgcactgcttaaaatgcagggcggtcaaagacatgttgtattgggggttgtgtaatgttaccaattatatctacgcctagagaaaaaattattgatactaaaatagttatatacccctctaaaacatatgaaatagattgggaaaacaaatgtatagctgggtcaattgacggcgtaaaagcgttacagcaatcaatacacttaattttactaactcaaaggtatcgttatccaatatatagttgggattatgctacagatattgaccctctatacggtatgagaaaagattttgttgtgcctgaactgcaatgtagaatacgtgaagcattattacaagatgataggataacggacattatagattttaaaattaaccatatagaaagaggcaaatatgatgttagttttgcggtgaagaacaaaatatcagatacgctctacataaatgaggtgatagaagcatgattactagcaactatgattttggagatataacaaatagaatgttgcaaagagtaccaagtaaaattgataaaagacaaggctcattgatttataacgctgtagccccggcaagtttggaatttgcaaaaatatatcttatgttacaagcaatagaaaaagaagcctttcccgatactgcaagcatagaatatttgaagagacatgccaaaatgaaaaatttatctcttaatgaagccacttatgccattgttaggggtgaatttaacaagaaaatacctgagggaacacgattcagcttacaagacagcgaattaaattatatagtaatgtctgaaagtcccaaatgggatggggacaatgcacggttatattattatttgatgatgtgtgaaacaaccgggagtaaaggcaatcaaaccggaaacttaatacccataaccgacatagaaggattaactgttgctaaaattgttggcattgctacttatggtacagacacagagactacggaaaaatttaggaacagatattttgatactattttaaacccaccttttggcggcaaccgtgctgactacaagagatatatcaggtctataaatggtgtaggagcttgccgattgataagaacgccatcaggcggcggtactgttggcgttattatctgcgacagcgaatataacgagccgtctcacgagttggttggcagtgtgcaaacgttaattgacccggttgttaacagcggcaacggttttggaatggcaccaataggacatagagttactgtatcagctgtagaaacggttggaatagaggttatttccaaaattgagtatcaagagggttatacctggaacgatataactgaaagttatcaaaatactatatcagattattttgctgaattaaacgaatcatggggagatatagaccctgataatatagtcgttagaatgacacaaatagaacaaagaattttgaatttgaatggggttttagacgttgttgatataaaattatatccttatggagagaacgcgactacaaataatttttcggtgcctgacggcaaacttgtctctaattgctctacaggttgggagccgttgtcgttaaatgcaggggtagaagccaaaatatcaaaagacccatcaggaaacggaaatgctgttaagtttttatgcggctcagacgtatatggaaacggttggtcttatgatatagctagacttcttgataaaaagccaacagatttcatagaggcaacgggatatttaactgtctcgtttgaactttttcagcctgaaaacagtaggggattaggtaatttctatattgatttgagcggtaataaaatcattaaaaacagcgacggtggaaacacatatacatacggacggttaagcggttatgaaccaaatacaactgaaataaaaattattggcggtagtgctaagacgagcgacggtgtggataaggtgcacatagcaaatgaaaaagttttgggaaattgggtaactgtagaatttaaaattgattttactacacgtcagaatttcacttgtatatataataatagagaacatattgttacgggattcccgtcaactgttgacccgtcttcattatatcttaatatacagctttctgacaatccacaacataccaatgatatagaaacgtatattaaaaatgtgtctgcggtatatataacggagtaggtgaaaatatggggaaaatatacacattaaaatatttgcctgaattctttcatgacataattgattttgccgaattatgcaaaacgtatgacgttgaatttttgcttctcgaaaaagaaattgaaaagttattaaataactttttctttaattttttaaatgagcaagggtgtaaacgctgggaagacatattaaaaatatctatgcgtgaaactgatacgttagaagacagaagatttagaataaagtctatatattttggagatacgccatacacggaaataacaatgctggaaagattagaaatgcttgtaggcaaaggaaatgttactgttagtatagatgtaaaaaattataaagttacggtcagattgtcattgagcagaaaaaaccaattagcagaaattataaaaatgattgaaaaaatggtgccgcttaatatgattatagatgtcaagctgttatataacacctatgagactttaggattatatacgcatgattatttaggtagatttacacattatgcgctgaaagaaaatgttttgggaggttagacatggctacaactacaaaaatatacggtttaaaaaaaccgtcattaacagatgtttataacattatggattttaataacaattttgataaaattgacactgttttaaatacaaaaacagaaatagaagatatagggacactgaacggcaccgaaagcgtatttaatacacgaataagtccaggtttttataaaggaatatggaataatcagtccatgaagcaaaagggagattttacgctttttgtttttgatgtctcctctactaatacggcagaagatacaaaggaaacagtagtaatgcaagttttatttcatgaaaatcaagtctcggtccgtttgggtgtgttaggtgttccggcgaattggggtaatttctctccgatagcaacaatgtctaatatatcaaacatagaacaaaagataggcaatttatcaaatcttactacaacggctaaaacaaatatcgttacagcgataaatgagttgataacgtcaatatcaaaaaaagcggataaagttacaaataacggatttgtagccggaggagcggaagccggaaaagtcggcagtatatcaattggaagcggtataagctccaccggagaatatggaatagcaattggagccggagcggaaggtacaaatgatagtgtatcaataggacatgggtcaattgcttccgggattgattccgttgcaataggagatgtagcggaaagtttggctcaaaatgctgtgcaaatatgcgaaggcagtaacagcgaaagtgaaagtctgcaatttagaaaatataaaatagttagatatgataccacagacgatgaatattatttgaaagatgttggcaggttgagccgattatatactactaatcggtcaaacatcgttgaagcaattaatgaattagacaatgaagcggaaaataacacaactgaattactatcaaaaataacggaacaaaataatagcttgataatgctgatacaaatgcttgctaatactgggattaacatagttccattactcgaaatgctgggtaacactattaccgttatttctgatactgtaactcaaatgtatcaatactctgacaataataatcctgataataaattaaaaggaattgtttatgcaccaaatcttgaaacagttgaatcacgttcgatagacgataattcaggcatgacaacaataatcatgccaaaagtcaagacaattaaaagtcaaggcttttgggctagttatggacttaaaacggtctttatacctaatgcttgtacatctcttgccactaacgcattttctatgtgtggaaatttaactaacatatatattgataatgtcgaaggtacatttggagatatagcagcagattcaagtttgcctaatttaaaagttacatatttaaaaaagtgaggtgtctaaaatggaatacagactaataaatggtatttgccatatatgcaaatataaaacggttgtaacaaatgagaatggtacaaaacttgaattttatcatttggacgaggttgaaactaatcagtcattggaactacatcagcaactcagcgacttgccagctgagattgttcctcttgatgtatcagactgtatttggcttgacggtaaagagttctcgtttgatacagaaattattcaggcttatgaaatgggggaaacagaatatataaaatatcttttggaaaaatcccgtcttaacaatgcaaatctgcttaatgaaattaaaacattgggtcaggctcagactgatttagagttagaattaatcgaacagggacaatacataacagacctcgaattacaacttttgggagggggtgaaagcaatgtatgaaaagattaaaaacagatacgaaaaaggatatgtaaccaatagtcagcttatgcgttatatatcactcggagtattgacggaaaagcaggcagaaaaaattaaggcgttggagaatgaataattatgataattgattataaagttgattcgcaaattttacgcagaaccagcagaaatttaatagtggcggacagcataaaatatttggctgtccgttttaatttttctgatgaatggaaaggcactaaaaagacagttgtttttttatatgatggatatagctataatgttcttttggatgaaaacgaaatagcgattgtgccgcatgaagttataaaaagtcctggatttaatttatctgcatatggcacgaataacggaatgcgaataacaactaacacatgcaaagtatctgttataaagagtggatattgtgagggagaaacaccacctgaaccaacacaaaacgtatatgagcaaatattagatagattagataatagcggtggaggaacagaaaaaaacggaaaatcagcttatgaaatagccgtagagaatggatttaacggaactgaaagtgaatggttagaaagcctaaaaggtcagccgggcaaagacggaataaacggagcagacggcaaagacggagcagatataacagctataaatgattccgaaacctcatcagagaccacgtggagcagtgcgaaaatcactactgctgatacggagctacagacacaaattaataatacatataatcatcacctgaacgatagtaacaatattggcaatgaggtatacgacggagcggttcttactatagttgatgatgacgggtccattgaattcttaaataattttgtgccgatatataaagataagggtgttaggtgcagttttgcagtcgtagcttgcagagcagaaacaccaacaggtacaacaacaagcggtgacccttacaaggctttaagctggacacaaataaaagaacttgtgcacgatggcttcgacatgcaaagtcacacatacagtcatgatgtgaaagtgtttcggacaggcgaaaacttaaacgaggaacaacttgaacatcaatttggtgacgctgatagattatttagacaaaacggacttgattataactgtatggtgtatccatggggtacggctcaacaaattaagaaaaaagttgcgaagcgatatgccaaatatggaatgacgttgattagcggggatacgggactaaatgatgaaataagcgaacctatggcaatatcaagattcacattgcaaagcggttcaacgagtttggcaagtgctaaatctcaaattgatacagccattgccaacaagcaatggcttattttatgcagtcatgcaaatgcaaatcaacctagtgccgacacgttgggaaatattattgattatgctattagcaaaaaaatacgcatagaaacgttttcgagagccgcaaggctcaaggctcctgtgtattatacaggcgagggagacaatatgtttcgggttatgcccaatggtgatactaaatgcaagcctgatgatgatactgtgagatatatcgtgcaaagggctacagtattaggattatttgaagacacggaagcgagcatatcggcaagttacggaaaaactcaaaacatagcaggtgacacattggataagtcgcttataacagttattgtgacaatgacgagtggtaaaacacattctgtaaccgattatgctgtagaagaaacggatttaacgttggcagagggcgaaaatacgtatcatataaaatataaaggacttagttgcacattaacggtaacagcgatagcggcggcggaagccgcagaaattacacaacagccgcaagatgtaacaacagaggtcggagaaactgcaaatatgtcaataatcgccaaaggtacaggtttaacttataaatggcagtggcttgacgtgagaggtgatgaccccgttggaatatggactaattgtgcagacggcacatcaagcatattgcaatttacagtagagccgtatcataatttacgtaaatacagatgtattgtaacaagtagtatgggggaaacgctaacgtcagatattgcaaccttgcatataggaagcaaatacaatatgttgatagagcacacctctgaatcagaagctatcgaacgaacatggtacagtatccctttatcggcaggtgcgtatcattttcgtgctactgtggaaaaagctgaatacgcttgtacattccagcttaagacagctatcaataatgtagatgataaaaatggtacggttatgtttatcgcgccaacaggcacgtttaacgccgcaagcgcaatatatacgtttgagggtgattttacgttagaatcagacacggaatacctatttttgtacacgaaaggaattactgccgggaaaacaataactattgaatattataaaactaattaggagggcagaacatggacgaaaacgaagcggcaatcagagagcggctgacggcggttgaatcctccgtcaagtctgctcatcataggatagacaacatagaggagttgacccaatcggtaaaaacgcttgcagtggaaacaaaatatctcaaagaagatatttccgatgttaaagaaaaaatagacgttatagccggacgaccgtcacagattctaacggttataataacagcactaataacggcgactataagcggtgtaatgggctttatattatcacatttattaaaataattaaggaggtgaaagagcatgaataataacataacagttggtactatagcaagaacaatagtattaattttagcactggcaaatcaggtgttagcgatgagcggtaagcaggtacttaatattgcagacgatgatatataccaggttgttagtatagtatttacaattagtgcgtctgtttggagttggtggaagaataatagcttttcatatgaagctataaaggtggacaaaataatgtcagagctaaaaggaaatgaaaactagaggttgacaaattgaataaataagtatataataatagcagataagagataaccgttaaacggttgtcaaagatttacgatattaatatagccgcaactttgaccgaggggcggctatatcgcttttatggaaacaatcacaaagaatattatgattgaaacaattacttttaataagtacttccacataagcgacacctcctttcagctgtgagaaacagcatatggagatgacaaccgtccttcaatttcctcttacctgcttgacagtattatacaagaatatacataaaaaatcaagttaaaatagcattacggaatgtcatctaggggcattctttttttgttataatataatagattggaggaataagaatggcaaagatatacatagacccgggacataactgcagcggagcggatacaggagccgtggggtatggattgaaagaacaagatgtatctgtgcagattggagtgatactaagagaattactattggttagcggacaaactgttaagatgagccgtgatagtattaccgatacagtatcaagcagcttaaacggcagtcttgcatacagatataacagtgccaacagctggaatgcagatgtatttgtatcaatacattgcaatgcggcaaacacaaaagcgtatggctgtgagacatattattgcacaggcagcacgcagggcagggcgttagcggaatgtgtacagccgaatatggccgcggagacggaaaggtataacagaggtgttaaatctgctaactttgcggttataaaacacacaaatatgcccatcttttgtgtattaaggatgttcaggactatacagggacttgttatgattttgcaaaacgcacatttttgggtggtaaaaaatatatttcggctgagacgtttgcaaaaaacttgagtgaataaaaaaactaactattaaatgttaaatggtagttaaaaaaattaaatttgacctgatatagaaagaggtgattgaggatgtataattttttgattaaatataggctaaagaccggggcgcctgcaactaaatatataactgtaaaatctgtatcggcaaagctggcaaaacagcaatttaatgaaatgtatggttctgccagttttgaaatactgggagtatataaggaggtgagatcaattgtataactggattatacgaatatcgggagcggtggttggcgttgtattgttagttatggttaggtcgcttgagtggtatcccatattttacgcagctccgcttatgatgatacttttggcattttttaattgcgcagaggacacagctgaagaacaacccatagctgacgatgtgcgtaaggtcgtaatcaagccggataatcggcggtgggacttttcggacgcggagtgcagcagggattataaaaataacagtagcaaaagaatacataaaattgtaatgtgaggtgattattataaaaccaatagttatatgtggaaattcaaagtttgacaggcttgttatggactgcaattttgcggctatggcatatatggacaaggacatcaatgaacagtacagagaatttaggctggaggatataaaagtaaagtccagctgtgcggaaccacaaaccggaccaaaaaatatatataacaagaaatctatatcaatataacatataataaaagaattgtcaagctgagagaaggagaaatttagcatgaaattatatgaaattgacgcagaaattgaacaatgtatcttaattgatgaagaaacaggcgaggttattgggattgatacagaaagagctgataagctgcagatgatgagagatgataaaataaaaaatttggctctctattataaaaatttgatggctgaggttaatgcgtataaatccgaaaaagattattttgcaaagcgtgaaagggtggccaaaaataaagcggagagtattaagaaatttttgaatgaatttcttgcgggtgaaaagtttgaatcaccaaaggttaatattacatatcgtaagagtgaatcagttgttattgatgatattaacaaagtagacaagcagtatttaaaatatacagaaccggcggttgacaaagtggaggccaaaaaagctattaaatcaggtgtattacttgaaggtttacatattgaagaaaatcaaaatattcaaattaagtagaagcaggaggtattcatgaagataattaaaggtatacaaaaaacgcctgaaaaggttgtagtttatggaccggaagggataggtaaatcaacttttttatcttgttttccggagccgttgtttattgatacagaaggaagcacaaaacatatgaatgtatctagattgccaaacccgcaaagttggatggaattgttagaagaaattaattacgttattcaaaatcctggctgctgtaaaacacttacaatagatacaattgattgggctgaacagctttgtacagaaaacatacttgaaaagtacggtaaaaatggaattgaggattttggatatggtaccggatatgtatatgtaaaagaagaatttggaagatttttaaagttgctggataatgttattgaggcaggaataaatgttgctttagctgcacatgcacaaatacgtaaatttgagcagcctgatgaacttggtgcatatgacagatacgaactgaaactcggaaagaaaacttcttcacaaacagcacctcttgtgaaggaatgggctgatatggttctatttgcaaattataaaacaatttctgtagctgttgataaagatggaaaaaaacataaagctcaaggtggaaagcgtgtaatgtatacaactcatcatccatgctgggatgcgaaaaacaggcatggattagaaagcgagctgccatttgattataaatatgttgcaaatatatttgataactttgaaccacagagccaaacacctgttaaacttaatcagacagaacaaatagaaagagaaattgatgctgttattgataaaattccgaaacaagatgaagaaactaaaacaaataaacaacaaatgaagaaaattaatgttgacggaatccctaaagaattagctaaattaatgattgaaaacaatgttactaaagaaatgattcaaaatgttgtgcatcaaaaaggttattatccatcgggtacaccaattgaaaattttgatactgagtttatagaaggggttctgataggcgcctgggatgatgtatataaagtaatagttgaatatgagacacttccttgggaagaaaaataaataataaaatttggaggaaataaaaatgagtaatgaatcagaaagagaatatggctgggatgatgaaatacaaaatgatggaccggaatatgtcgttttgccggatggagactataattttaaagtaacaggttttgaacgcggcagatatgaaggcggagagaaaattccggcttgtaatatggcaattatcactttagaaatagagaatgacaaaggaatttgttttatacaaaacagattatttttacatagtcgttgtgaggggttgttgtgtgcattttttacttgtattggtcagagaaagcatggtgaaaaattgaaaatgaattggaatgaagttgtcggagcaagaggaagagcaaaaattggacatcgtgaatataatggaaatatttataatgatataaaaaggttttacgctcccgatgaatctgcaccaaaaaaatcattcacaccaggtaaattctaatggaattaagaccatatcaacaagaagctgaaaaggcagtatttgccgaatgggaaaaagggaataaaagaactttgctagtattacctacaggcaccggtaaaactattgtatttgcaaagataactgaaagatgtgtaaagaatggcgagcgagtacttatactcgctcatcgagccgaactattagaacaagcagtggataaaattaaaaaagtaaccgggttaagatgtgcggtcgaaaaggcagaagaaagttgtataggcagctggtatcgtatagttgttggttccgttcaaacaatgatgcgtcagaaacgtcttaaccaatttgatacagactattttgatactataattattgatgaggcacatcattgtatatcagacagttatcaaaaagtaatagattatttcagtgaatcaaaattattgggagtaacagctacgcctgacagaggtgatatgaaaaatcttggtaaggtttttgagagcatggcatatgaatattcattatcatcagcaattaaagaaggatttttatcaccaattaaggctcaaacaattcctttaaaacttgatttaacagaagtgggaacacaggctggagactttaaaacgagtgatttaggtacagctcttgaaccatatctatatcagattgcggatgaaatgaaaaaatattgtgatgggcgaaagacagtagtttttttgccgctagtaaaaaccagtcaaaagttttgcaatattttgaatgaaaatggttttaaggctgcagaaataaatggaaatagtgataataggtcagagattttaaacgattttaattcaggcaaatataatgttatttgcaattccatgttgcttacagaaggctgggactgtcccagtgtagattgtgttgttgtattaaggccaactaaggtacgtagtttatattgccaaatggtaggcaggggaacacgtttatcacctgaaaccggtaaaactgaattgttaatacttgattttctttggcacactgaacgacatgaactttgtagaccggctcatctaatatgcgaaaatgaagaagttgctcaaaaaatgactgaaaatcttgaagcttcaggctgtccgattgatatagaagaagcagaagttcaagccagtgaagatgttgttgtgcagcgtgaagaagctcttgctaaacagttgtcggaaatgaaaaagaggaaacgcaaattagtggaccctatacaatttgaaatgagtatacaagcagaagatttatcagggtatgttccggcatttggctgggaaatgtcaccgccaacggacaagcagaaaaacgcactcgaaaagctgggtattatgcctgatgaaattgaaaactccggtaaagctgcgaaaattttagacagacttgagaaacgtaaaaatgaaggactgacaacgccaaaacaaattagatgcttagagcaaaaaggatttaaacatgttggaacatggcagtttgaagctgcaagcaaattgattacgagaatatctgctaatgggtggagagttccaaatggtattaaccccgctacatttaatcccgaattaggagcataggatatggaaaataacattaatttggttgaactgcttgaatatatagaaccatcatttcttgattatcaggattgggttaatgttggaatggcacttaaatatgaaggatatacagtacaggattgggatgattggagcaaacgtgacgctaaccgttatcatgctggggaatgtgagaaaaagtggaatactttttccggttcaagttctcctataacagcaggaaccatagtgaaaatggcacaggataatggttttaaatttcataaagaagatgttgcttttgattggaattctgagataggcaataaagatgatttagttgtaatcgataaagggtggattgaaacaagtgaatttagcataccacaaaaatggaatcctgttgaacaattaactacatatttagaaacactgtttgaagcaaatgaaaacgttggatatgtcactcggagctgggagaaaaacggaaagtacctcccgtctaaaggcttgtgtgacaggacggccggaaggttaattcaggagctttcaaagtgtgaaggagatatatgtaaggttattggtgattatagtgaaaaggcaggagcttggatacgttttaaccctcttgatggtaaaggtataaaaaatgaaaacgttacggattttagatatgctttggttgaatcagatgtaatggatttagggcgtcaaaaagctattattgaggaactggaattacctgttgcatgtcttgtgtacagtgcagggaaaagtctccacgctatagtgaaaattgaggcatataattatagtgaatatagagaaagagttgaatatctatataaggtttgtgaaaagaatggtttaattatagataaacaaaataaaaatccatcacgcttatctagaatgccaggaattataagaaatgggaaaaaacaatatttattatctacaaacattggaaaatccagtttcgaagaatggaaagaatggattgaaacaattaatgatgatttgccggaacctgaaagcattgcaagtatttgggataatctacccgaattgtcaccatctcttattgatggagtattaagacaaggtcataaaatgcttatagctggaccttcaaaagccggaaaatcatatgctctgattgaaatgtgctgtgctatagctgaaggcaagaaatggctgaaatggaattgtactaaaggcagagttttatatgttaatttagaattggacagggcaagctgttttcatagatttaaagatgtttatactgctttaaactggaatcctgataacattaataatattgatatatggaacttaagaggaaaatcagcgccaatggacaagctggcgcctaaactaattcgaagagccgtgaaaaaagactatatagcaataattattgacccaatatataaagttattacaggagatgaaaacagcgcggaccaaatggcaaagttttgtaatcagtttgacaaggtctgtaccgaattgggctgtgcggtaatatattgccatcatcattcaaagggagcacaaggcggcaaaagaagtatggatagggcatccggcagcggagtttttgctcgtgaccctgacgctcttattgatttgatagaattagaattaacagaagatgttttaaaacaacaggaagatgttttagtgtgtaaaacatgctacaaatggataaaacgttttagtaaagataacgaggtttctcaggatgatttatgcagcgctaggactatgttagaactttcagcagaattgttacagagtaatacatataaactgatgattgaagatattaagaaggttaaagatgaaaataaaagccgtacagcatggcgtatagatggaacgttaagagaatttcctaaatttgaaccaattaatttatggttcgattaccctattcacagaatagatgatacaaatattcttaaggatttatcagctgaatctgatactcattcttggaaatctaaatcaaataaaaagaatgttaaacaaagagaaaataaaaaaacaattgaaacggcatatgaagtttgtaaaattgatggtgatgtgacactcaaaatgattgcggaatatatggaaaaatcagaaaaaaccataagaaattatgttaattcaagctctaatctgtatattaaaaacggatttatatatgaaaaataatttaaatctcgagagggaaatcgggaaaaaaagggaaatttccctttttccctcaagggaaattgggaaaaaacaaggaaatttccctttttccctcaagtcttgaaaaccgcgtaaaaatgtgggttagagcgcaatcgggaaatcgggaaggaaatttatatatataaatatataattttccctttccctcacgggtcagtggggtaagtcgttgtgcgaagctcacgcacaacaacgcctccccctgtcactgacaaaaaattttttcaagagtaaaacaaaaactgaggggtgaacaaaaaatatgagaacacaaagaagcaaattgttagatgcagttaaacgaatgcctgaactgagacattcaattccgggcaaagaatttaaaatacaaaatagtgaagttattaaatggcttataatgcaacctgaaattttaaattatatctggaacaatataaaaaattccgaagcgataaaatatgacgctgaatcaggatgttggagtggtgttgattatgacaactgaattttttgttgcaattattccaccaactgttactcatcaagaaaagaaagtcagtgtgataaaaggtaaaccggttttttatgagccgtctaatttaaaagacgcccgcttaaaacttatgtcacatttagctagatttgttccagtaaaaaaatatattggtggagttcggcttattgtaaaatggtgtttcccgagaaaaaatcacagagacggtgagtataaaataactaagccggatacggacaatttacagaagttactcaaggatgtaatgacaaagttggggtattgggcagatgataatttggtggcaagtgaaattgtggaaaaattttgggctgaaaagcccggaatatatatcaggatagaggatttgtaagatggagttaaaacaagttaaacaagcaattatgcaacaaagtatagttcgttataaaaataaaaactatgtcttttatgctagtagatgttttaaaaatattcatgaagatagaatcgaatatgacggagaactatatgacgaaaacgcaaattgtgttattcatgtgcaactaagtgatgtagaacttattgagaaataaatttataacaaggagggacaagatgaaatatgacgaaggaaagccgaaacttaccttgtgcccgacagaaataattacagcggttgccatggtaagagagtatggagcaaaaaagtatggagatagtgacagctggaaagatgttgaaccgcaaaggtacagagacgcggctttcagacactttgtgtcatacataaatgaccctttgggtgcagatgaagaaagcggactgccgcatttgtggcatttggcttgcaatattgcgtttttgtgcgctatggaaaaggactgaaactatatggataaaaaagtaatttaacagacaaagaattattatcaaactggatgtgataaatcttatgacagctgaaagattaaggcagtacaaaagtataaaagcagaaattgaagaattggccgaacagatacaaatgcttgaaagttctgacattgtgcaggggtcagacagggaattcccgtacataaaacataacatgaaagtggaaacaggagagtgcgaccacacacgtgatatgttaaaaaaagagttggggttattaaaagccgaatatcacgcattgaatgaatttattaacaacattgctgacagcgaaacaaggcgaattttcagatacagatatattgaggggtggacattccaaaagattgcttttaaagtaggcaatggtgatgaacaggttccgagaaaaaaacataataattttttaaaaaagtacgaaaaatacgaaaatcacatgttataattgtattatgaaaggtatgcaaagtaatttctccttttatatattttttgtttaagagccgttttcctttttggggcggttcttttagttttaggtcttgtgggaattgtacatcataaatttgctgaggggcgggcggctgtgatgtgatttggaggtgagatatttgactgaaaaacagaaacgtttctgtgatgaatatttgatagatttgaatgggactcgagcatataagaacgcttatcccaatgtaaaaaataatgattcggcggctgtaaatgcttctaaactgctaagaaatactaagattaaagcatatattagtgagcaaattgagaagctgcacaacgaaaagacagcagatgcgcaggaggttgtagagtatctcacgtcagtaatgcggggtaaaagtaaagcggaggtgcttgttgttgagggacggggagatggcttttcgaagacgaagcacattgaaaaatctcctgatgaaaaagaacgtttaaaagcggcagagttgcttggtaagtattacacactgtttacagaacgaacgcaggttgatggaatagcgcaggttcagattttagacaatattccaaagggtgatgatagtggttagtttgacagaccttatcgcgccttctttttatgctcttcaccatgatattaagcgaggcgggcatacacactactggctaaagggcggcagaggaagcacaaaatcttcttttatcagcgtggaaattgtgcttggtataatgagtaatccgagtgctaatgccgttgtagttcgcaaggtgggactttatcttaaagacagtgtatatgaacagcttgtgtgggcgatagaaaaactcggagtatcacacctttggcaattcaagctgtcgccgcttgaactgatatatcttccgacagggcagcggatattattcaggggagcagataagcccaagaaactgaaatctaccaaggtgcacagaggatatattcgttatatttggtatgaggaagtggacgaatttggaggcatggaagagatacgtacgattaatcagtcacttatgcgcggaggtgaaatgtataatgtattttactcttacaaccctccgcaaagtcaacggaattgggtaaatgaagaggtattgacaacgcgaagcgacagagtgatacaccacagcacatatttaagcgttcctcctcagtggctcggcgaacagtttattttggaggcggagcatttaaagaagacgaaaccgagtaattataaccacgagtatttgggagaggttaccggaacgggcggcgaggtgtttacaaaccttgatgttcgcgagataagcgaagaagagattgcggtttttgaccggatcaggcggggaattgactttgggtatgcggttgacccgtttgcgtatctcgtctgccactatgacaagacacggaagcggctgtacctcatggatgaaatatacaaagtcggcttgtcaaatcgtgcggcggcggagttgatccaagggtgcgaggtgtatgacggttacattgtctgcgacagcgcggaacctaaaagcatagcggagttaagaggatatggccttaaagtacgcggagcaaagaaagggcccgatagtattgagtatggtattaagttcctgcagtcgcttgaagtaataattatcgaccctgtgcggtgtccgcatgctgccaacgagttttataactacgagcttgaacgtgacagcagaggtgagtttaaagcttcttaccctgacaaggataaccacacaattgacgcagttaggtatgcgctggaagatgatatgagtaacagaggtattgagataagaagcaggaaggagctgggtatatgatagttgacgctgagacggtaaaagaggttgacggaagaatattgggaaagctgattaataaacgtgctgaagatacggcacggcttatcaagcttaaagattattatttgggaaaacatgatgtgctttatcgaagacctaaaggcaaaggcttgccgaacaacaaaacggtatgtaaccatgcgaagtacatagttgatatgacacaaggttatttgctcggcgcgcctattgcgtacagtgcggcagacggtattgatatcgaaccgttaaagaacgcatattttgaaagcgagatacaaaatacagacagccggattgtacgggatatgtctatttacggacattcatatgagttggtttatgcgaacgaagattccaaaccgaagtctgctgtgcttgaaccgcggcaggcgtttattgtttatgatgatactgtagagcaaagaaaactgttcggtgtgcattactacacgataacagatatagacggtctggaagtgggtaaagtcgctaatgtttatacagaaaacgaggttataaaataccgaagcacagggggagggagcgtttatgaagaaatagagaggacggcgcattcatttggcagggtgccgatgattgagtatatcaacaatgaagacaagcagggcgattttgaacagcttatcggtcttatagacgcatacaacacgttgatgagtgaccgcgttaatgataaggagcagtttgtagacgctatattgttccttaaaaacgtagaggttgacagcgaaaaagccaaagaattattgactgaaaaaataatgatgtctttcacgccggacgcggaagcaaaatatttacaaaaggttctaaacgagactgatgtagagatactgaggaataacatcaaggacgatttacataaattttcattaacgcccgacctcacagacgtgaatttcggcaataacctttccggcgttgctataagatacaagcttttggggtttgaacagcatgttaagaataaggaacggtttttagttcttggacttaaagaaagatttgacctatatgtccactatttatctttactaagccgtatgagtgtagtaagttcgggagatgttgactttgtcttcaatcgaaatcttcctgagaataatttggagctggcacagacgattaattatctgcgcggtcttgtatctgatgaaacactgcttgagcagcttgattttgtgtccgattcagcggaagaaatggagcttgtggaaaagcaggaggaaagccgcgtagagcgcgagataaagcgcgaggaactttacagaaagagcacgggcgcggattatacagcgcttgaagatttaactgatgagaagtgctgattattggctgagagttgcgctaatgcgcgaacttgatgcacacaaccgcggagcatacacaatacaagagcttaggcgtatgtatgacagtatcataaaagatatcgacaaagaaataaaaaagatattcaacacatacaaaaatggtgtacaaatcacagccgaggaagccgaacagcttattaataaagcggcgcagaaccaaatagcagataggctgtctgaaatattaaaagacacggaagatccaaaacagcggcttgaacttatgcgcaagatacacgcgcaggcatacggggcaagaattagccgtttagaagcggttaagcttaatgtatatgcttatttcaaagaaaaggcactaacggagatagagaaaactaagactttatacaatacggttatagaagaaagctattacagaaccgttcacgacatagcaaaaggctgtaatgtaggtgtatacttttctcttatacctaagcgcgcagttaatgaaatgcttgggagtaagtggcatggcgaacaatttagcgatagagtgtggaataacacggcaaaggtcgctgaacagtcgcagaagataattacagaagggataatgagccatgcgggatatacgcaaatggctgcccggcttgctgagataatggaaacatcaaagtataacgcgcagaggctggttaatacgcaggtcagttatttcatgaacatggctgaattgagggcttatgaagaattaggaatagaacaatacaaatatcttgcaacgcttgatgagaggacgtgtgaaagctgttcgccgcttgataataagatatttaaagtcagtgaggcggtaggtggcgtaaattatccgcctatgcacccgcattgcagatgtacaacaacaatgccgacagactatgcaagacgctgggcgcgcgaccctctgacaggcaagggctataaaataaagggtatgagttacaatgaatggattgagagccttaatcctgagcaaaggttagcgtttgacctgcacgtgagacagtataaaaacctgtcaggtgataaaaagcagtatgcaaagtatgttgaagtgttgggaaagaagaatgtgccgaaaacgtttgcattgtttcaggatttgaagtataatgataataagttatgggaatcgttgaaagactattataagtcgagaagcacaaatatgatttcagcatttacatcgtttgaagattataaaaagtataagcagataatatccgacgaattgataggacttacaacagttgacggaattaaaataaaatcacaaagcaagcattttattgaacgagtgtttggaaccaataaagacccaataacaggcagaactagaaacggcgttgaaattaaggatataaaagaggcattgctacatggaagggtaaggaaaaagaaatgtagtaccaagtatgtttctgataaatgtgaggtttcaataaaccaaagaacgggaaatcttatacaaacaaatccacatagcgaaataaggtgaaattagcatgttatataaatttaataaaaaacaatatgacttaataaaaaagtatgttatagaatgttatgaaggcggaaacttagaatttgatgatgagaaatttaatataaagattaacagtaatgatataggagaatttcagtcggcggctgatgaagctataatagtatatggtatggtcaatcaggattatttgactgatttgggttgtgagcttcaatggttatatgatgagatatattatcaaacaactctcaatgtttagtttatttgagcttatttgagagtagcttaacttaaaagcgtcctttggggcgcttttattataccaaaaatgaggtgatgacatgaggtcaagagacccaacaaattaattaaaataaataaagatgatgagcggagacgctctttttttatacccaaaattgaaaggaggattttaaatggcagaaaatacaaaacagacaggcggcgctatggcaacgccccaaacagggcaaaatgttgcagacctggcaacgccgaccgaacctaaagaaccggccgcagggacggctgtcaacactggcggcactgatgacgttcaatccaaaattgatgaagcgttaaaggcggcgcgcaagaagtgggacgcagagcttgaaacaaggttgtcggaagcaataagcgaaagcgaacgccttgccaagctgaacgcggacgaacgagcggaagccgagcggcaaaaggagcaggagaaattcgagaaagaacgcgcgaaatatgagcgtgaaaagcttgaatttgaaacgggtaaatcacttatggacaaagggctttcgcctcaattcgcttcatttttggcgcaggacaacgccgaaaccacaaaggcgaatatagacgcgtttgaaaaggcgtttaacgaagaggtgcaagctgcggttgtcgataagctgaaaggaactgtcccaaaggcggggacagacaaagccgctgcaataacgcaagaggcttttaacaaaatgagttatgcagagcgcgtcaagctgtataacgaggacaaagaaacttatgaaaaattaacaggaggtaatcaataatggcaacaggaacaacgaagcttgaaaacatggtaaatcccgaggttatggcgcctatggtatcggcaaagcttgaggcagctatgaagtttgccccgcttgcgaccattgacagaacattgcagggaaagccgggcgataccgtcacgcttccaaagtatgcgtacataggtgacgcggaggacgtgggcgagggcgaggctattccgattgagaaaatggcgacatcgaccaccaaggtaagcgttaaaaaggcaggcaagggcgttgagcttacggacgagtccgttctaagcggctatggcgaccctatgggcgaggcggtaaatcagcttgggttgtcaatagcaaacaagcttgacaatgatgtgcttgctgtgcttgataatatcatatccgctatgacagtcggagatggcacggcaacgctgacttcaaactttatagcggacgcactcgttaaattcggagaggacatagacggtgaaaaggttctgcttatcgctccggcacagctggcggagcttagaaaatccgaggactggattaaagcgaccgacatcggcgcggatattataattaagggcacggtcggcatgatacacggctgtcaagttgtgctttccaacaagattaaggcggagaacggcgcttatacgaactatatcgttaagcccggtgcgcttgcgatttacctaaagcgcgataccgagattgaaaatgacagagatattgttaataaaaccacggttatcacagccgacaagcactatacaacgcacatcgcggacgacgccaaggccatcaagattagcgcaaaggagtaataccctatgggaatgttattaagcagacacaggaaagcaagaaaagccgtatctgacgataagccgaaggcggaggtgagaaccaatgttaaacaaagcgaacgcgctagaaaccgcaaaaatgcttctagggatagagggggactgcagggataacctgctgtcctttttaattgaggataacataaatctgattttaaactattgcagaatatcagattttccgcaagagcttgaaagccttttgccggttatgaccgccgaccgatataggcgcgcaagctatgggcaggaaaaagcagacaaggttgtgaagtcggaaacacagggctctgtaagcaaaagctatgaggacagtacggctaacgacagtcattttctcaataattaccgcgagagattaaagccgtttattaatcgtaaagggagggttccgagtgattttgatgaacctgaaaaaaacgattgaggtatacagcggcgctgaacttaaagctgaaataacagcagatattcaaccatacagcggaggtctagcacaggaagaatacggacttgaaattgagactgtaaagcgtatttactgcgagccttgtacatttcttgaagaaggcgcaagggtcgctttgaaaggtgaaaatataagctatacagtaaagtattccgaacattgggacgattacacaatggctcttttaaacaagctgccaacagccgtaaaagatgagagcgtgaacgttaacacgggagagaacggcgcaagtgatatatacgggggtgggttttattgattgatttaattccacgggtgaaaaaactgctcgaaagtacaggaataacggttaaatatggcacggagtttcattttaacgccgtgcctgttattacgtttagaaaagtgacaactgacgagggctttcacgccgataacgccgagcagtcacaagtaagcaagtttgctgtggatatttggagtaattcgcccgtgcagttatccaatataggagtaaaagtcaatgagataatgcagtcggacggctggacaaggacatacgattgcgatgtgccccggcaaagccctgatgaattatatcatttgtcgcagagatataaaaaagaggtatttttttaaaatgaggggtgacaatgggaatcaatattgaaattgatgggcttgataatatattggacaacttagaaaatatatcatctaaacttgacggcgctgtacaaaacggggtggcaaagggcggcaaagctatacaagcccagtgtaaagctgagtgtcctgttgatacaggagaactgagaaacagcattgtagaagaaacaacaggcggtggaggaaaatatacatctgagataggacccacggctgattatggtatatacgttgaaatgggtacaggtatttacgccggaggacgtcaaacgccgtggaggtatcaggacagcaaaggacaatggcacacgaccaggggtcagagaccacagccgtacatggaaccggggtttgaagccgggaaagatgaagcggttgaaatattaacaaacgaagtacaaaaagcaataaattaattttaggaggtcattaattatggcagtaaaagaaataaagaaaccacattcgaaaattggtgtatcaaattatacctttttccccataacggctgatgatatagcgacagggaagactacatacggcgaggcggtgaccttgcccggaacggttgaaatcgctcctacagattcagggtctacctcaacatttgacgcggacaacggagcatatgaggtggattcgtatgttgaaaaaatgggtcatgaaatcaccaatgcagatataccgcccgaggttgacgctatgtggagaggtgcggagcttgtagacaacggcgttgagttcaacaaagacacagcggcaaaggctgaatattttgcagtagcgtggataattgaaaaatctaacggtgtaaaacgtttggttagatactataagggcaaatatggatttgcctcaaatattggaggcaaaaccaaagcttctgagggcgcgcctgaacatcagaccgccaaagccacattttcagctgtgttccgtgattctgacggtaagggatattactatattgacacagacaatcttcctgacggcgtgacagaagcacaggctatagaaaactggttcaaagaccctaactggtatccgtcggcagcaccggaacagggggcttaatctaatggcaaaagacatagaaaatatattaactataaagattaacggcaaagaagtgcaatcaagaccgtttgactttgaggattacgcagatatgcaggacaagcatttaaggggatattcaggcgcttgcaagctgtgttatgatgttcttatacgtatgttcagaggcacagcggctaataaagaatacattgaaacaatgtctattgcggaaaaagatatgttatgcaggaaattacttgacatatatttgaacactataagcgaagtaaacgaactgataaaaaaccagtaaagtcggacagtgacgaaacttttaatcttaaagatatatatgcagtaatgtataagacaaaagggatactgcccgacgagctggcaagacaaaatccggtaaaattaatggaaatgttaatttctctaaacgaagacgaggaggaaaactctgtcacaaacttacctcccagtcttggctggatgaatgggttataaaaatattgtgcagttcacggactgcacaaagcaaaaagcattttaaacagtgttttttgctttgtgaaataatattttcttgacaaatttgtatacgtacagtataatgtacatataatatatttggaggtgtttttatgacgaacacaaatataacaaatttaagaaagaatttatttgaatacattgaccaggcagtaaattataatgatgttattaatgttaacacaaaaaacggcaatgcggtaataattagcgaaaatgactataacagtttaatggaaactctctatttatcttcggttccgggacttgcagataaaataaaagatgggctaaatacttcgataagtgagtgcgtgcctgaagacaaggtggaatggtaatgtatagcattgtttatactaaaaaggttttgaaagatataccaaaattaaaagaagccggattatctgacaacgcaaagaagcttatagatataataaggaataacccatatcagaatccgccgccgtatgagaagctgaaaggcgaacttagcggagcgtattcaagaagaataaatataaagcatagacttgtgtatgaagtggttgaagacgcgaaaacagtaaaaattataagcatgtggacgcattacgaattttaataacttagcgcaccctttaggggcgcttttttgttgcagaaaaagaaaggcgggattatatgagcggaaatttaggggaattaactgtaaaatttacaggcgacgcatcgtcattaagttctactatatcaaaggtgcagtcggaattatccggtatgaatgctatgtcacagaaaggcgtgaaaagcattgcggagcagacccggcaaatgggcggatatgataagatagtcgcaaagtcggctgaaagcctaaagcaaaagcgaagtatattggctgaaacggaaaaagcgtataagcaaaatactaaacagctgaacgaaaatataaaagggctaaacggtcagaaatcggctataggcagtcttatgacttccaaaaaagctgagattcaggctttagaatctgccaatgcagggctgaataaaaacagtcaggcgtataaggataatgttaaggctatacagtggacacagaatgaatataaaggattgcagaaacagcacgatgaagtatcaaaatcaatcctgaacaatgaaagcgcattaaacagagaaagcgcggcgtataattctgcaaagtcagctgtttcaaacgcaagcaaacagtatgaaagtttagcccaaaaccaaaaagctattgctaacatggaaaaggctttaaatttacaagatgttggggaaagttggcaaaaagcaggacagagcattaacacaataactaagcctatacagttagcaagtgttgctcttgccgccgggggtgtagcttccgccaaatttgctatagattttgaggataattttgcaaatgttaaaaagaccgtagacggaacagagccgcagcttgagaaagtaaaacaaggtattatagatttatcaacaacaggaatagacggcagaaacgccataccgcaaacgacggcacagttgacagagcttgcggctgctggcggccagcttggtataaagacggaaaatattgtaggttttaccgaaactatggcgcaaatgggaactgcgactaatttggcaggagaacaaggcgcaaaaactcttgctagatttatgaatgtggctggtgtttcacaagaccaggtaggaaatctaggctcgtcaatagttgatttaggtaacaactttgccacaactgaggctgaaatagctgatatggctatgtatatgggggctacagggtcaaccgttggtatatcggcgcaggacgtgctggcgtattcgacagcattatcatcattaggagcagaagccgcgtcaggcggcagtgcagtatcccgtatatggatgcaaatgcaccagtctgtgtcagagggcggagaagatttagaaacgttcgccgagctaagcggaaagagttcagaagaattcaaagaacaatggaacacagacgcaagcggagcgttccaggactttctaaaaggattatctaaaaccgacgaccaaatatctacattaagcaatttaggattcaataatataagagaccttcaagcattgcagaaacttgcaggagagtcgggtataaaattgttgactaaagctttagaacattcaaacactgcatgggaagatggaacagcgctccaaaaggaatttaatgctaaagcagagacaacggcaagccaaatacaagttactaaaaataacttggttgaagccgcacgcggtatcggggaaacatttttaccaacaatcaagaatgtatccggcggaataaaagattttgcacaagacattgctaatatgagcgatgagggcaaaaagaatctagttaatatcggcaccgggcttattggtctaggagcaggcgcaaaagttgtagccgggacaactaaaggtataggaaattttgttgaagctttggggaaaataaaagttgcggcaccagcattagctggtatgggacctgtagcccttgcggtagcagggagtattggtatcttaactgcaacatatgtaggattagaaaacgtcagaaaacgtgttgttgaggcacgagattacactataggaatagacgaaaaagttacaaatgctgaaaaagctattaattcatataagaatcttagtgaattatcaaaggaagttgaacagttagaaataaaaataaatgcagaggatacaagtaaagaagaaattgaatcagcaaaaacacgattacaggaaattaaaaaaatactagctgacgagtacaatttaaaaataaatgttgatgacggacaacttgatgaagtaacaaaaaaacttacagaatatgaaagacttaaagctaaagaggcaattaatgatttaaaagatagtgtaggaaatggagctcagcaatatcaagatgatgtgacagacagagaccatacagaagccgggtatacaagagccttagaaaaagaaaaaaatattttaaacgcaaaaaatgatttacgcaagtatagagatgaatggcaggggctaaacgatagtttagatagtggaacaataagtcaagatgaatataataaatcatttggagaacttaaacaaggtattgacgaggtgttttctcgcggtgacatatccgacctatatcatggactaacgccgaaaacagataaattaaaggatattacaagtcaagttgacaatcttagcaatgaatatgacaggctgactaaagaaacggaaatagcaggtcaagctgaaaccgacagacaaaacagaatgtctaaatattatgaagcagctacccaacttgcagatgattctgtttctatgctcaaggcaaatttagaaagcggaaactatgaggaagtttcgcaaaatattgaagatgtaggaaccgctgtaaaaagtgcaggtcttgacgttagtgaatatgcgcaaaagaccgctttagctcaaaatggaatagaaaatttagatacagcttggcaaaagggcggcgaaacgcttaataatgttgttagtgactatatatctaatagtcaaaagtttggagccagtgcaaaagaaacagcagtcggcgcgaccctgataaaaaatggttttaaagatatacaaggcgcagcagaagctggaaaacttgatttaatttctgaaaaatcaacagaattagctagaagtatgggcgagttatccgataatcaatctatacaaattagtgtggatggagatatatcaacgattacagaagttgacggtaagttacaagagataaatggaaagcatgttgatataaaacttaataccaaaacagagaattatgaggttttggacaaagccggaaataaaatttctgaaattgacggcaagaccgctactgtctcagttaatgcagagggaaactatgacgtgttaaatcaagcaggtattaaaatagctgagatagacggaaaaacaggacaggtcagattagaggtagcagacggagcgacaccgactgttgaacaaataaacagtgcggtcggagatttggacggacgcgcggcaagggtggaagtaactgctgacggtaactatgaaatttttgatgaggttggcaataaaattgctgatatagatgggaagaccggaacagtacaaattattgcaaacgatggagctagtgaaccggctaataatgcaacagaggcagtgaacaatatccctgattcacataatacaaatattacagcaagtgatggagcgagcgcgcctgcaaataatgcaactggttctgttaatggaattccgcagtcacatcacacttcaattacagcaagcgataacgcaagtccagtagcgaatcaagtggcttcggcaattaggtcaataccatcatctaaaacaataacaataaatacagtagtaagaggggggttgcctagtccaaatgctttagcaaacggaataacagctaaagggacaatggacgccaaacccggatttggtattatcaatgatgaaaaaggagtgtcagaccctagggaacttgttgtacgcgatggtgttggatatatttttgaaggcaaaaacgttccaatagatttaaaattacacgataaaatttatactgcaaagcaaacaagacaaataatgtcgggcgcgggaattccacgctatgcgagcggcaagaacaacgaggactgggaaaacgctaagtctgacagggaacatatacgcaaaacttcatacaacataattccggcatgggaagagcttgaatggctcgaccaaatgaaacagaaatttgcttctgacgctgaggttataaaagagattgaggaagaaatagttaattatacaagagagatgtggagccaaaacctggaatcaatggaatttgctcttgatatgggctggacatctcaggaagaatactataataacctcgccgtataccgtgatgaaaatttcgcacccgacacgcaggaatggaaagacgcaacactaaaattacataagtacagccagcagcttattgacgacgcaaatgctgcctctaaggcgtatattgatttacacgccagtataaacgactggggcgaaatgggtacaagcatgggcgctgtttggcagacggtaaaccagcgtaatgttcaagcggcaaaggacggattaatcacctgggaagattattttgacacaaggcttgattacacagagcaatttttagacggttatttggattattcggacgactggatagataatgaaaaagagtataacaatatgtcggctgccgacacgatagcggcggttaatagacagagaaaagaagtagaggaatattttgcagggctcggagaactgaccgatgaagaaaaggtagtcagaattaaggtagaggcagagctggataagaaaatgtatgacgcggtcagagacgaattgagcgaatgggaagacgacgcagactggactgagaagcaagcgggggtatacggctgggaagaaattggagaaaataagcttgatttttaccagcgcaaaatagataaatatacacaatggtcgcaagatgagagcctggatccgactaaacagcaatatgctcgccgtcaggctgacgaaatgcggcttgaattatataaagccacagaggacagatacgacgaaatgctggatatggctaaggaacgtatggacgaggtcaaggacttgctcgacgacaagctcagtgctctagaagaatcatgggaagtggaagaccgggcagaagataaggctgaaaccctgtcagacattgagaaatataagaatgctgtaacaatagagggaaaacaaaaatatcaggaagcattagacaaactcaaagagatagagcgagacgaacagcgttatcagatagagcaggaaaacaacgccataataaagcaaatggaagctgaatataaggcgcttgaagacgaaaaggcaaatatattacagcagacaaaggaagcaaatttaaaagttgcctcggttgttgagccgctggaacagagtataaattccaatatggataatatgacgagcagaatagaagctgccattaaggaaatcaaaccgagtattacagtaacacagaatattaccagtaatataaatgacggcacggacggaatactctatcaaaataaagtgctggataaaacggtaaccgctgtagggggctaaaaatgagacatggaataacatttaggggtaaacacagcaatgatataggcgtaatcgtaaagaccgttggaagaccgataatcgcgcctgtaaggcagattgatgaggaggtgccatatagggacggaaatgttgattgctccgagacaggagggcggttatattatgacgataaagttttggaacttgacttttatttagtatctcacgatactgttgaactccaaaaaaacgtaacaaaagtcgcaaactggttagccggaggatacgggaaacttatatttgacgacatgccaacagtaaaatggatagcaaagcctgttgatttagacgatttaacaatagaattatacaagaacggacataccaaaatacaattcaggtgcagaccatttaacgactggatacatgacagtaaaggggtgccgctggacagcaaccattcattggacagcgatatacccttaggattgggcgatgaaaacgagataatatacggcgcaggagcaacaggacttgaattagattatttcggctcagctcctgtcagacccgttgttgttataacgccaacgactgaaacaaatggattcagcctgactgttaacaacagcacaataagcagtacggcggcttttagaaatcctgtaacaatagactgtgcgaatgcggttctgccgagtggcttttcaggtgatttttttgagctgaaacctgaaataaataaaataaatataaattgtctgagcggaaacggtcagattatattagaatatgtacctaaattattatatggagatggtttttaaatgaaatttattgcagtgtatgacaaagacgcaacagagtatgaatcagacagactgggatttttagagaatgcaaaagatgtatgtattgaacagtcaataaacggagattatgaattgacatttattctgcctaaaggtgataaaaaatggggattgattgattttgaccgcaaagtcgggtacgacggacgtatattcagaattaaagatatagacgactgcacaatatcagcgtcaacgcttctgcaggacgcgtgcagaacgcatgtgcaatacataggagatatgataaacaccccggcaaatgagattgtggagagcatttttgcaacaacgccgtatgtaacagttttgaaaaaagaagagattgaagcactggggcttgaacctgtcacggacaaaatagactttttcgaaatgtcaaagactactcctatagcgtgtctcaacaggcttatggaaacattaaaaaaatatagagtgcacagcgaagtatatattgacaatgataaaataggtcttgtaagacagctgggaagcaagaaagattttgtcattgaccctagatacaatggttgtgaaataaagcctaaaatatcaacttatacattagtaacaaagctgtacccatacggtaaggacgacatgccgcttgaaggagacaagcagtacattttaagtcctaactatgatacattgggagaatatgagggattctgcaactttgatgaagtaacagaccaggaagatttgttgctggcagcacagacacaatttagagaagacaacccggaaagaatagacgtgccaaagtatgcggtaaatgtaaaagtattggatttgccgggagaaataaaccttggtgacatagtaacggtaaacgacataaacaacggaatcaaatctaatcaaagagttataacggttaaaaaatacccgtatgagcctcacaaaaattctattatcgtaggagttccgccaataaatatgatagaagcattcagcggtatgttcacggctcaccagtatttgagactggcgcagaacgaaagaaatgaatataagacaaacacacttgaatttatgaaaaagaacactgatgtaacagtcgaaaataacggagaataccaaaaaatagcgcagtatgaaacgggagcaatgttcgtatcccctaacggaatgtacgctgttgcaataatagacggtaaaatcaagattggagttgctgacaaaagtcgtgacgacggctggaactggataggagtatttggacacggcgacggaagcgattgggcaacgacatatctatacactaacttaatcaccataatgtcagagaatggaaaacttaaaatagaggataatttgatacaaatgtatgacggaaacggaacactgcgctatcaatcgggcttaaatccacaattaggtaaatatgtatttgagctttttgacgaaagcggcaaaaaatcgctatatatggacgacaacggtaatttaactatatgcggtgtgtttatgacgggtgaaaatggacagacacgaaccgttatagacggcaacggaatacagagttataacagtgataatcagttacacggattagttagtaatcctgacggtagacatagcgatttagcgacttattataatggtgttgaaatatttaaattatataatgatatagacggagtaacattttattgtaataactcaaaattattgacaacactttcgaataaagtttctatgaatggaacgtggtattataagaacactgaaatagcaacaaaagatgatatacaatcattacaagagcaaataaatgcgttgaaaggtatgtaggtattgacatatatttattttgtatgatatattgttaataatatatagcgaaagggtgttaattatgaaaaaatttatttgcggcttattaattggttcgatttgtacactatcaattggaagtttagcaaacggtgtttgggataatatcagcgtgctgaaaaacgatataaatgtagttgttaatggtgaaactgttacagcggataatttcttatataatgatattacatatttacctttacgggcagtaagcgaagcacttggcgaaacagtagagtatgacgaaactgataatacagcttatattggagaaagggttgataaagatactatgaagagtaaatatacaccaccagtagatttaaaaaattacacaatacttgataatgaaatttattatataaccgcacaatatataattgatttagcagaaaataaaggattaaagacaaatgttgatgaattaatcatgaacgataaacttgaattagaaattgacggtaaaacttggtatatggtttttattaatttgcggcgttgtatcccctacgacacatacgtagacgaaattgagccgctattaaaatataattaaccataaagacacccaatgcagggtgtcttttataatatgaattaatgatttactgaatgtattaaatgtgaatttagagaacacgtcataaaattcctttacaaattaagaaaattatggtattatgtagaaaaatatagaataaaggggatgaagaaaaatgaaatgcagtaaatgcggaactgaaaatccggagagcgcaaagttttgtaatgaatgcggtggtgagttaaaggagggagaggaaaatcaatctataaaaaagtgtcctaattgtggtttttatgtcggggataaaaacaaatgtgatagttgtggatattctattaaaacaggaaatgaaccgaaaacaaattcgctgatagatatagtgaaaaataatattgataaaataattatgatatcgtcaatatgtttgcttattgtcgtattaactataattatagctgtttctgtttctgacaataacgcagaacaaaaattggcggcaagtcaatctgtatcaactgcaactcctaaacctgttccaaccgctaagcctacgccggcgccaacagttgatcctgtagctgctcaaaaagcggcagaggaaaaggcagctaaagaaaaagcagccaaagaagcagaattaaacagctatgaaacaggtattacatataatcagcttgcacgtactccaaatgattacataggtaaaaaggtgaaattttatggtaaagtaatacaagttattgagggaacctcagaaacacagttacgtcttgctattggaggagactatgacagtattattttttgcagagtgcctaaagctaaaacggctaatatgagaattttagaaaacgactatataacaattatgggaaaatcaaatggattattaacatatgaatcaactatgggtggtaatattactataccagatatttctgtttccgaatggggtccaaattaaaaaatttatataatagatataaaaatttaaaaaaactcttgactttctgtcacgcataaagtataataaaggtgtgacagaaagtgaggtgaagtaatgtcaccaagaacaggcagaccgaaagcagataagcctaaagttattcgttatagtattcgtcttgatgaacaaacggaaacaaagttgcaaaattattgcaataaaaacagcataacaaaaggcgaagcaatacgacgaggtattcaaatgttactttcggaaacaaaaaaatgaaacagactgtctcccacaaaagacacaagtctgtttcaagcaccagaagaatttctgataaatctattatatcagatttcttctggaatttcaatagaaattttaggaggaatttttatgcaaaatgcaattacggttaataatcatcaattatcgttgaaagaataccaagggaaaagggtagtaactttgagggatatagacactgtacacaatagaccacaaggaacagcaagaaaaagatttaatgacaacaaagggcattttattgaaggcgaagactactataaactgcaaatgtccgaaagtcggacatttggaataaacagccctaggggtggcattgtagtaacagaatcagggtatttaatgttggtaaaatcatttactgatgatttagcgtgggaagtgcaaaggcagctagtgaatacatattttaaacaacagcaatctaaggcagaagaaattacaccaaaatactataatggagaaccggttataacaatacaggacatagcacgactgacaggattaaacgcaaatacgatacgttattatgtaagacggctccaacgcaatagagattattacttgttggaaggcgaagcgcttaaaaaatttaaaagaaacaacccatcaattgacagaatgatttccagtttgtgcgttattaacagacgaggagtcgaaaaacttgcgcagatgatacagggtgtaccgatacaggattgttttaaaattcttaagccaaataatgagttaaaatggtcaaagaaattatatgtggatatacccgataataatgatgcgcagaaattaattaacaatataaggcgtaaggcaactactctgacagagttgatggcacaggtagatatgtatgtcgcagaggacgaatatcaagcagcggtaaaagtaatagacagacttggagttagtatattagtgtgttgcaacgatttgaaaagaataaaatacaatctatcggaaaagtatgcttaataatgtcgcacccgtgtagggtgcgtggatttaaatgaattatatgattgtgaaaagccaactgatatgtcatcaatcgtgcatgagcacacaaggtatacatcattgtaccgtatattgtctgattgtgttagtgatgtgacacaattacttagagagacacaaaaacaactaacataagactttacataataattaatcaatgatataatatagtggtgcgaatcatatgctcacatgatttccctgggaggttcgcaccacttttttacaaaaatatataataagaaacattcttataaacacattttatattaaacatttaagtattatgtaacaatataacaattataggaataaaagtatataactcttatatatttttgctgtcgcaccccacaaggggtgcgtggatttaaatgtatcggacgacgggaaatatgcagttgctttgagtcgcaccccgtaaggggtgtgtggatttaaattttacctgtcattttatgagctataagttcacaacgtcgcaccccacatggggtgcgtggatttaaatgactttgccgccgtcaaatactgctgtccagttccagtcgcaccccttacggggtgcgtggatggaaaaacaagagcgtccgaaagggcgttctttttatatatattaaaatagaaaggatgataattatgttacaaaaaaatgagcgtgttccgttcgtttgtgatgatgagataccggagggcttatatccatattgcagagaagtttttgacgcaattttggaagcaaaaataccatacggcagaacacatacggtattagaacttgtatcacaggcgttgaaaaatgtaacaccgggtgaagttgagataaagcgagataagacagattatcccatctgctcagactaaacacacataataaaatatgaaaggaggtaaaaaattgacataaaaaggcacatttgatataataaaaaaagccaatggacgattggcggttatgtcgcaccctacaggggtgtgtggatttaaataaattaatgactactaaggttagaagtattatgtacatggtcgcactccacatggagtgtgtggatttaaatttaaaaagaaataaccgcccatagcggacggtattccctcaactctaaattgcagcggaataaccgtacccctacagttgttccattggctatattatatcacacaaataatatttgtcaagacacccaatagggtgtttttttgttgcgaaaaagaaagggtgataaaatggcaaagcatagtataaacgaaaactataacggtcaaacgaaattgcgctactggtggacggttataagagataatctgtcaaatctgatggggtggtacaacagccatatagacggaacggcagacagacacagagcggaggatatagactacgacgacagcacagttaaggataaaataaataaaatagatatgtctctgtttaagaagacagcgaaattgcccgatgaaatattaacaccgggcttttattatgggggaggcgctattgacggaacattagggggcggcggcacatattggtttgcgatagaggtatatccagtttttacaaatctcttgcaggtgcttcaccaaaatgttaatggcgagtggacaacgtattatagaaatgtttcaggcttggaaagttccgctccgcagttcaccgaatggataatattggcgaaaatatctgatgttactgcattaagaactgaggttattaaccaaataaatttaaaggcagataaaagtgagattgggagcatagaagatattaaccttaatgtaaccagtatagcagaagcaataaacacactggttgacacagacgaggacacaataaatctaataggaaatacgcagaatttgactaccgcgactaaagaaaacgtggttgaagctgtgaatgaagtcaatcaaaatatgacaagtgtcactgacaacttatcccaaaaggcggataaggttacaaacgggggatttatagccggaggagcggaagccggagaagtcggcagtatatcaattggaagcggtataggctccaccggagaatatggaatagcaattggcgcaggagcagaggggacaaatgacagtgtagcgattggacatgggtctatagcttcaggacttgattctgtggcaattggagatgttgcggaaagtttggctcaaaatgctgtgcaaatatgcgaaggcagtaacagcgaaagtgaaagtctgcaatttagaaaatataagatagttagatatgattctacagacgatagatattatcttaaagatgtgggtcagttggagagattatatacaaataatcaatcaagcattgtagatgctattaacgaattgagcatggataaagggaataactccagtaaggcagtgatgggagaagcgttatcaaaatcagaagaatttaatatatggcaaaacggcaattggatagtgggatataatatatcgcctataacaattacagatgacacatacggaacttttaccctgccgtctcaaatcttagaaatttcaggggtaaaggacaaaaccggagaagagaaaaaatactgttatgcttcatacatactcaacacggataatttatccggggaattgagcgcgtcagatgtgaccgtaacatacagtcttaaagaagcaaagggaaagccaaacagctatatggagatagaggacgaaacgaaactgacaactataaatatctatctcgggaccattacattaaacgcagagaatgatttactgcctgacggaagtaacagcgtgatatattcagggagtgaaataactaatgaagatgtagaaattaaactgcttaggatttttaatacatccggtatcataacaggtgaatttgttgaggtcactgcagatgaagtaaacgcattattttaaataagtaaaaaataaaataaatatattatataaaattatggaggtaatatcatggcaacaaaaattttaggaatggaagcattaacaaagttagtagaaaagattaaggcggtaacaacagcgataccaaccaaactcagccagcttacaaacgacagcggctatcagacaagttcacaggtatctactacagttacgaatgcgacaaaggattttgcggcaaagactgatgtaggaacattgacaaccttgacaacaacggcaaagaataaccttgtggcagccataaacgaagtagacgggcatcaagattcagctgattcgatgatacagggacagggaaatgatattaatggaataaaaacaaatattggtgcattgtcagacctgaacacaacagcaaaaggaactatagttgcggcgattaatgaagttaagacgagtgcagacgggaaaatgacatcggctcaggttgattcaaaaattacggctgcaaaggcaggactagcaacagaaacatatgtaaacaacaaagtgtcaagcgtatacaagtataagggaagtaaggatacatatgcttcgcttccgacaacgggaaataccgttggagatgtatggaacgttgttgacaagaacggtcaaaactttgcgtggacaggctcagcgtgggacgctcttggcgagactatagacttaagcggatatatgaagaacgacgcattgcaggaaatcacggcggcagaggtagaggccttatttaactaaacctggagggatatagatggcgacaaagattttaggaatgacagcgctgacaaagttagtagataagacaaaaaagtatgtcaacgataaaaagatgataaatgtgatggagggggccagcgcagaaggaagttactctgctgtcataggaggacaaggagcggtgcccggagtttgttctgtgtcattaggcggctatgctaatgctgtgaatggtgagagggcggtagcaataggcggctggtctttgctctgcaacggttataacactgtgtgcggtaaaaataatttggaaccaaccgccggatattattctcataataacggcgacgggtttatagttggaaacgggacgttaagttcccgttccaacgcctttcgtgcggcttacagcggtgatgtgtatgcgatgaagtcaatcaacggaaccggagccgattatgcggagcttagagaatggtctgacggaaatcccaataatgaagacaggtgcggattatttgtatgttttgacggtgagaagatacggcttgcaaattcaggagacccaaaagacttactcggagtaatatcaggcaatccgtgtatagttggaaacaactatgacgaccagtggagcgggaaatataagaaggacgtatttgggcggttattgactgaacatataacctgggaagaaaaaagagataacgaaggcaatattataactcctgcaggcgagggagatgtatatattttatcagaagactatgacccttcacagaaatacataccaagaaaagaccgtccggagtggggatatatgggaacacacggagaactggtggtaatagatgacggcacatgtgaagcaaaaggtcgttgcaagcctaatgatgaggcaaaagcaacggcggcagaagacggtttttacgtgcttgagcggatagatgataaccatattaaaatatttgtgagataggttgggggttagtgacatggttttggatagcacaataatagttggggtactatcattaataggtacgctcattggctcattatcagggatatttgcagcgaataagctcactacatataggataggacaacttgaagaaaaggtaaataagcataataatttaatagagagaatggtagctgttgaagcgtcagctaagtcagcgcacaaacggcttgatgaactgagcgaggaggtgaaagagcatgaataatgtaacagctggaacaatagcaagaaccatagtattattgctggcactggcaaatcaggtattagctatgtgcggtaagcaggtgcttaatatatcggatgatgatatataccaggttgtcagtatagtatttacaattggtgcgtctgctgtagcgtggtggaagaataacagtttttcgcagacggcattaaaggcagataaagtaatggcagagcttaaagaaaacaaaaattagcggttgacaaattgattacataagtatataataatagcagataagagataaccgttaaacggttgtcaaagatattggtaaatatgtaaccgcaatccttgccagaggggcggttacactgcttttatggagacaatcacaaataatattatgattgaaacaattacttttaataagtacttccacataagcgacacctcctttcagctgtgagaaacagcatatggagatgacaaccgtccttcaatttcctcttacctgcttgacagtattatacaagaatatacataaaaaatcaagttaaaatagcattacggaatgtcatctaggggcattctttttttgttataatataatagattggaggaataagaatggcaaagatatacatagacccgggacataactgcagcggagcggatacaggagccgtggggtatggattgaaagaacaagatgtatctgtgcagattggagtgatactaagagaattactattggttagcggacaaactgttaagatgagccgtgatagtattaccgatacagtatcaagcagcttaaacggcagtcttgcatacagatataacagtgccaacagctggaatgcagatgtatttgtatcaatacattgcaatgcggcaaacacaaaagcgtatggctgtgagacatattattgcacaggcagcacgcagggcagggcgttagcggaatgtgtacagccgaatatggccgcggagacggaaaggtataacagaggtgttaaatctgctaactttgcggttataaaacacacaaatatgccaataattctaccagagtggaaaagaacatgctgggtcaggaagtaaagacaatagatccaaagaaaaatgagagttcggcaaagtatgacgactttggaagacagacagaagtaaagagcagaatagacggcgaagacagcataaaaagctacagttatgacaataacggaaacgtaataaaagaaagcataacaagcaataagccgggagaagcgttgacgtacagaaatgtgtattatgagtacgacaatatgaacagactggtaaaaacatacacagacgagccgggagagacattgtatgagtatgacggaaacgggaacataacaaagatgacaacagggtcagtgaacggagaaggaggagtaagcacaacatatgagtatgacagccaaaacagactgatatcaagcacagacccaatgggatacagtgaaagttatacatacgataataacggaaatattgtaagcaaaacagacaaaaacggaacagtaataacaaatgtgtataacggaataaacaacccattgtcagtgacaagcgaaagagacggagagacggagacaataacctacacatacgcagacacaagcacagcgctgctgagcatagcaaacgaagcggccacaataacctacagctacgacagaaaaggacaagttacgggagaaagccgtataacaggagaaacgctgagctattcatacgataaagacggaaaccaaacaggactgatactgaactcaaccaacggagtaagtcagaacataagctatagctatgactatctgggaaagatgaaagaggtaagggataacctggaaaacgagctggtggcagtgtataattatgatgaaaacgggaacctgacagagaagaaaaccaacggaaacacaatggtaacgagctacgagtacaatgagagcaacctgccgaaaaaggtaagcaatcaaacagtggcagacccgctgcaaaacataaagggaacatactcggagtataactacagctactacctggacgggaaccagtcgtcagtgacggacatattcggaaagacaaaaggctatacctacgacagcgccggcaggttgaaaacggaagtaaatgagctaaataagaaaagcaatgaagatgaaaaaataacaacaatatatagttatgatgaaaggggaaatcgaataagcaaagaacaaacaaaggatgaagtgtcactaatgatttggacgggaccaagaccggcgtatgaagaaggagaaggttatacgcagtattattatgataataataacaggttgacaggaagttcttatgattatgaggaatatatgaatgaagataaaacattcacatatgacaaaaatggaaatatgatcacaagagatacagtagtattttacgatgattatccacccgaaggttcatcatatgaaatatatgaagaaaagtatgaaagtttcgaatataacggatttaataggctaaagagttatacagatacgaataagacggcatcatacgcatatgacggaacgggaacgagaatagggaagacagtaaccggagtaagcacaggacaaatatggaacaatggaaacgtaatagccgattacggaacaaaaggaacaaagacgtatatccgaggagctggaggagaaatagtaaagacaaaggatagagcaaataacaacagatacttatcatataacgtccacggagacacaacgaacataatagaaaagaatgcggaaagtacatcatttgcagtaacagcagcatatgaatacgacgcattcggaggtttagtaacaggaacaggcggagaagcagacagtaacgcattcagatataacggacaatataccgatgaagagactggattgatatacctaagaaacagatattatgacccaagtataggtagattcactcaggaagatacatattggaatccaggtaatatgatttatggagatcaacaatttgaagaaggagaagtaaagataccggattattatgcgatagtccaaagtgctaatttatatgtctattgttctaatgaccctgttaatggagttgatcctacaggtctatataatagatgggcagctgttaattatgctcgtgaatatggaaatgcaggatattttggtggaagaaatgaggaattttataattatcgaacagattgtgctaattttgtatctcaatgtttgcttgctggtggaatattgaaaaattctcaatggttttcatatagatataatacagatgattggtggcaaccaacaaataatgataagtatgaatggtgggtttcggaaccatggcgactagcaagagctcagtttgaatttttcagcaatccatataatggttatattaatggtgatgtattaacaatttggactcctgagggtgtcagtgatgttgcaaaatgtggagtacaacctggtgatttgatatattgggccggagaagatggagctaatccacatcatgcagctattgtaacaaaagttgagaatggtgagatatattactcagctcatacaaatgaaaaggttgatgaagcaatttcaaatagattgggcggtgaattagtatatattattagaattcgagatgaagctgttagaggatatattaattaataattgagaaggaatgcgcaaaaatgaattttagatatagcttatgtatagcgtttgttataattctaataatgtatcttactatttttttgaatacaaattctgttgtgaacaatgttgaaaatattatgagcggaaatgttgaaaaatcaattactcagaatacgccattggatcaatacaatagaaaaggagattttggtactgtaaaagttgatgtaaaattaaatagattatttgtacttcataactttaataaaggatatatgtggatgttatatacttatgaaggatatgataaggataacaatcgaacatatggagcatggaacattttatcaaaatggaaaatagaaaaaataaatggaaaatgggaggtagtaaacataattgaagagccatagaagatatgtttaaataaagaaagaaataatgagcggctgtgacgatataaaaatgttgctgtcgctcattgcgcacaaaccaaaacatcaaaatgaggcgatatcatatggtgtcttaaataggatataaaaaaattataacggaaacgtaatagccgaatacggaacaaaaggaacaaagacgtatatacgaggagccggaggagaaatagtaaataccaaagacagcgcaagcaacagtagatatttctcatataacgcccacggagacacaacgaacataatagagaagaatgcagaaagtacatcgtttgcagtaacggaagcatatgaatatgacgcattcggaggcttagtatcaggaacaggcggagaagcagaaagcaacgtattcagatacaacggacaatataccgatgaagagactggattaatatatttgcgtaatcgttactatgacccaagtataggtagatttactcaagaagacccatattggaatccaggaaatatgatatatggagaccaacaatttgaagaaggagaagtaaagataccggattaccatgctatagttcaaagtgctaatttatatgtgtattgtgctaatgaccccgttaatttaaatgatatatttggtactgtagcaggtgaccgttttgctactccagatgaagcagcaattgactgggcttggaattattatgggataactcagtactcaatgattgaacatgcttcgcttatatatttggcatatgatgaatataatactccttactattcttatactgaatgtgttgatggtcaaccaaattatgttcaaacaacattattaaatactcatattaatgaagggcaatatattgttggtgcagtgcattctcatactgtaactaaccgtttatctaatcaagatttagatttagctattgatcaaaattattctatattatatgttgttggggaatcacaatatagtgatggtgttgatatcagtaaaattcaggattatgatgatggtcgaggctatcaattagaggctgtaggttcagattatggttttaggcatctaacatatagtgaacaaagaaatgcagatgtatattttagaaataaatggaattggttttatgatgagattgaatacaattattacttaaaatcaataagggggtattaaaatgaaaaaatatataatatttgtaatgttgttgtttattagcgttttaataataaatatattcgctataaacaatttatacttaaatgataagcataaaacagttgattatgttaaaggtaaaacgattataaatataactccatattatgattttcagaagatagttgattacgagggaagtaaaaatatagattataaaataaataaaaaaaccgctttagaaattggaaaatcaattataatttcaacaataaaaaaagaagtgaaaatgcgtggagaatatatgacaaacgaagatatttttgataatttaactttttatgtaaataatgaagaacttgatggaaaaaaagtatataaaataaacgcaaaaagtaaaagtaaatttttttcttttggtttatctaaagtattaaattacaatttaaataatttgttaagagaagaaggtttatcaatttttattgataatgataatggaaagatatataagtgcatattaaataaaaaagaggtttcaccttatgtcgatgaaaattgcgcttctaaaatcgcattaagtatttttattaattgttatatagaaagatctaataaaaataatataatggaatattggcataaaaatgattacgaaaatggcacatatacatatataagtgatgcaaaaggtgttgcaattgaaggtgaaaatgaagatgagtttttccagattagacaatgtagtaaaattaacattgacaagttatttaaattaaacaaaaaaataaatttggattttgcaaaaaaagaatatacaactttaatacgcaagagtaatgcagaaataataaaagtatggtaagttttattgtttttacataaaaatatctattttctaaatagttactctgaattcggttatagatgaagacacagcaatgttggctacactcaataatcaaggagaaataaatcctccacattcaaatccatctcctaatccttttggaataaatgcaagaaatgaatattattatatgcgtgatttattaggaatataaaaaaggagaaactatgaaaaagtatgttaaaatagcagtgacaataattatattattaccaattatatattttctgataaattggggaagtgcattaataagatgcgaagtattaacaataatgcatggttcagagtttggagaaatatataaagaaaagacgatgataggagaactggattatttaaaggtattgaattattcaaatgaatatgcagaggtatactatgtatcaaaacatagagccggtggtaatattgtgtcttttgttaaagaaaataatgagtggaagtttaataaatgggaacaaacagtatggtcaagtacaggaagtgcatctgatgtaatatggccatattggtggcattttatatatggaggattttgattaataaattaacctagggcaagtaattacttgccctagagtacattttatatacgcatatgatggaacaggaacgagaataggaaaaacagtaaacggagtaagcacaggacaaatctggaacaatggaaacgtaatagccgaatacggaacaaaaggaacaaagacgtatatccggggagccggagcagaaatagtaaagacaaaagacagcacaaataacaacagatatttctcatataacgcccacggagacacaacaaacataatagaaaagaaagcggaaagcacatcatttgcagtaacagcagcgtatgaatatgacgcattcggaggttggtatcaggaacaggcggagaagcagaaagcaacgcattcagatacaatggacaatataccgatgaagagactggattgatatatttgcgtaatcgttactatgacccaagtataggtagatttactcaggaagaccccgttcaagatggtatgaattggtatgtatattgtggaaatgatcctgttaatttaattgatccattgggattatttgattataatacatctttatattatggcatgggatatagtgaagatgtaattgctttacaaaatgagttggcatatttaggatatttaaataccaatgatagagatggatattttggacaaaaaactttaaatgcagtaaatgcatataaaaatgataggggtttatggaatgatggagcttttagcggagtggttgggttaactacatggcaaagtttaggattaatatatagaacacagggagatatagacaggggagtaaccatttttactgaagcaacaggagcacaatattttgatgttactaaaatgtttaatgatcagttgtggtattctgaacaaatgctagatgaaaaatggcaaggagataaacaaattacattttataataaagtaaatcataaaggagattgggatataaaacgtcaagaatcatgggatcgaacttttggaggatcatatcctggctcatttaattctacagtaatattatatggagaatattcaagcccggaggagatgggcaatattatgtatgcatatttaggaagatgtattggatttagtgaaactgttttatattggggtggagactatgctgcaggaggatggaacggtattaaaaactctgctgatactccagaagataaagctgctatacaaaaaggatttaatttatataacaagaagaaagggtaattattatgaaaaatgttatctcgtttatttttggtgcacttttggttttagtgttattgttatttttacatagtaatttggataattataaaaatattgcaaaagcatatgaaacaaatcgtgacaattttgaaagtgtagcaaatgaactaatgaattatactgaggatatttatatagacaaagataatgtaagtgatataggaaaagtgttaaatgataaatatggaataaatttatcacttgaaaaaattaacataatttttaaaaataaatttaaatcaattactaaaagaggaaattctattttattttatcgaggcaatttaaataaaaattatgtaggtattagagcatatgggatagcttattttaaatattattttgctacaaatgaaccaacacatgaattaataactgctattcgagcacttgatgaaaaaaataatggttggtattattatgagcaaagatagtaactaataatactatatatcaatgtcaataaatgcattatgaatcctataaattaaaatttagaaatattaataacaaatatggaacaggaacgagaataggaaagacagtaaacggattaagcacaggacaaatctggaacaacggaaacgtaatagccgaatacggaacaaaaggaacaaagacgtatatccgaggagccggaggagaaatagtaaagaccaaagacagcgcaagcaacagcagatacttctcatataacgtccacggagacacaataaacataatagaaaagaatgcggaaagtacatcatttgcagtaacggcagcgatgaatatgacgcattcggaggtttagtatcaggaacaggaggagaagcagacagcaacgaattcagatacaacggacaatataccgatgaagagactggattgatatacctaagaaacagatattatgacccaagtatagggagattcactcaggaagacccagcaaaagatggcgttaattggtatgtatattgtgaaaatgaccctatcaatttaactgatccaaatggtttagatgcaataatattaacaaatagcaatgctgttaatttaggacctttaggaaaacaaggacatacatctgctatatatcaagatgataatggaaattggttttatacatattggggagataaggcagcggcaataatacgcattccagatgagtacatgaattcactggaagatttcaatgctggtttaaaccaatttttaaccgataatggtttttctaatattacatcaaactatgattgtgctacctatgtgtttggagattttttggattcattaagagcagagtatcgtaaaatttataatatagagccaattcaaggaaatgcagaattgcatgagcttgatgatgatagtgtaatatatcaaggagataacgggtcatataatgtatttacaaataattgtttacagagcactattgattcatttggtgagggaaccttggcaaacgatatgttggtctcagattacatggaatcatgtggatacacctggggaattattccaaaatacgcttctgaaaagtttagtgagatgtttatgaataattcgtttattcgtcaatttgcatttgcaagattattaaattatacaatactatatatgcagggaagtccatgggcgcaagtcggagtaaaagcaaattatgcaagttcagttgttgcacgttaacgttaaatagtaaagtttttaaagaaaaaattcgctatataatttttataataacaattgtttgcaatgtactgtagcataattaggtgcagggattctagctaacggaggatcagtaaatagttatttaactgaattaaattatgtggtcggagttatactaaacaaccaaatatcattatttacttaaatgtttatgaataatgaatttacttttgaaaaaagtatcttattaacttataaattatgttttgctatatagtttaggaaatcagtgggcacaaagttggtataaggcaaattatctaattctgttgttggctacataatttaatattaggaggtataaatatatgtattggtttttgaattgtttacctttgataattgaactatcaatagaaatatatgcgctatatatacctataaggtataatgcgatggaaaataatcttatgtggttatggatattaattgtaagacaaatatatctattgattattaatataatttttatcaatagaaaaaaattatatttccagtgggaatattgtgtatgttgggggtaataactataagtgttggtatgatgttagtgtttcacaaaatacaatacggagaatttataggagatgtcccaagtggtatatatggtttattattaggagttccgactactattgtgataattgctatgtcgatctatcatttaataaaagtaaaatcttcttaagtggcaataagacaatattaaaatcatttggatataaagtattgtggagtgtataatataaaaaataaaagattaatattaaatgagattttagctgatgttactaattttataattgaatgggagaataatttaagtaaaattgatatttatataaattaactccaatatataaaagttttaagtggaataggcttcttaaataattgaagaagcctatttatatttatttaaaaatataatatctattttccaacataatcctcaggtacgtatccagctttgataatttcttcaataaataaatttatgtttatgccaccatttattatgatattaattaaactcctaaatgatggtagtctttttccattttctaaatctgtgtattgacgtggtgacagacaacatctctctgccattttctcttgatttaattttagttcaatttttctaaagtataatgtttttccaaagcatatttttaatatgttcagcatttcacttccaatctataaaatatgtgaatattctatcaataatatattttaaactatatgttacatattgcgtataaactctgtttttcagatattcttataaaatgtgattaataatttatattaaaatttatcattaataaaaaagcacagcttcaaaagccgtgcttgaatgtcaataaatatattaataacaaatatcgatataaaataacaaacacagataaattgcttcactacttggtataatatatcaagaggagcaatacaatgattagaattttattgtctaggaagttaggcgaacttcgatggacacaagctgaccttgcacggaaaacagggataagacctaatactataaatgacctttatcatgaaatggcagaacgagtaagtttagaacagattgacttaatatgtgaagctttaaattatgatttaagcgagttgttggttcgtgttcctaattctgtgtcagagttaaactcgcgtaatcgtttaggtgagttaaaaaaagacacctagtttggtgtctttttgtgtatattatatgtactaatttggcaatcaatttgtatatgagagaaaattcatgggacgattgtgggactttctcgttttaaaataaataaatataatggaatagatgtattaaaaagaaatataactaccgaaaacacacacataaacacttaatagtattttataacggcggagtatcttttgttgtatgccggtatatacagaagaggaaaagaagtttgaccagggttcaacaaagagatgggcaagttcagttgaaggactgaaagattcggcaaataaaggaacagaaatagttttagtggacgatacaaactatggatatgcaaaagacacagaaagcgcaaagaattcactgggactaatgatgtccaaggaatattcgggaacaacagatgcggaaactatgcttgcacgatgcgaggaagcgttaaatgcagaggaaagtatatccacaaatgggaacaaagtgataactttattcgtccaaaaaataacagataagaccgcattggaagaaaagatagaagaactgaataataaaggaatagcagtatatgtaatgttactcggcggaggatatgaaggaagcagggaagaaataataaactgtgaaacagagctgaatctgagactaaatgtatcagagctgtacggagcctttaataacatatcacaggttatgagtctttcagagaatggagaatccagagcagttactgaatatctaagcaattttagagcgggaaaacatgattttgctaatgttactaccaaccaatttggtgtgtcaattgcttctgttttaaacatttatggatgtttgccggctatcgctagtaaaagcgagggagatactaaagactatgacttattcactgaaccggatgatgtatacaatttagtaaatggaaatgcacatgcgatgaatggaagcgatttaagtaatatgtatgcattttatacagaaatggaaagcgatttcgcatggattacaagctctccatcaattaacaaaacaatagaggataacttgaaatatcgttttccagtcgttgcaaaagattctgcgaacaaatatgcaattataataggttctaataatggatataatttctataagtatgatgataaatttgatgaaagtaaaattgctggagtaattgatacatattcatatttgcttgaaattgcgaacgggacctcaataaaagatgaatatatcggtaataacgtattctatgataagataagtttcaatgtaccaaaaactttagtttaaaaaatggggatataaagtttgttggatataatggaacaacatttgaaaacgaaaatttaaatgttagaaatggtatgcccacattaacaggaatatcaacaaataatgaattcttatccggggttaaaacaatatataaaggttcggttcctgaaatatataactcgacaaaatattatttagttaaacaatatatagatgaacaggttaaaaatgcatggtactatgaatacttgtttaaagcgaccaatttaggagccataggcggagatgaaaatttaaattttcttccggaagacgaggtgacaataagtgagtttttaaaaatacttatagaattggcagatatttcagaagagcaaataaatgaggcagtatcgaaacaggaatcacatatgccagctttaataaaagaacactgggcaaagaaatatatatgctatggaatagaaaaaaatataataaccatagaaaatgtaacgggagataacactccggatacatttgtgccaaggtgtgacgcagcgtatatgataaacagaatgtttatagacgaaacaaatcagccaaacctgagaataccatccaatctatataaatatgatgaaaatgtatcatgcgaaagaaatacaagatggaaagccggaatagcgtttaaggatcagggagagatactgtattgtaaagatgagataggtcagctatacttaaatggcgcaatggatggaaccgatacaggatatataaattggaatgaaaaattaaacagagctgaagcatcgaagttaatagtaaagtgtaagtttgtgcttgatgaaggattagagaaggaaaagtgattaatgaaggagaagcaaactacatagatttatcaaacatagatacatttacagtaaagccgtcactggacaaaaacggctcaggtgaatttttctttgtggctcctaagacaggatattatcatataagtgatataaaaaattgtacggtaaaagtaagtgatatgaacaaaagagaagtacggggactagatgatttatcaggagggggaaggtataatatattaaagggtgaaaatgtatatttaaaggtaaatacaagcaaaacggactatagttttaaaataacgaatccaaaaacagatgaattagtgtttgcccctgataggtatggaacatttatttatgataatagacctgaaatgttgatatcggaagatttagcagatgctaaagaggggtatggaaatagttcattaattgtagaagataatttaaccggaattgttgatatagctacatcgcatatgatacattggaattgtttatcgtatggtaatagtaaagtggcttttgaatatcttttaactaatactagtcaaaattctgtgagtatagaagttgaacgtgttggaatcagacctgatacaaatttgaattcacaatggctaagtcaaacagttttagattacactgctttttcggcatgggctgattatatggagtgcgatttgaccgaaccatataagtttaatggaaatagtgttaaaaatgaaagttataaatacgatgaatatatttctaatactaaaaaaaatgatataaatgaaaatttggcatatagactttcaaaaatgaatggttctgctatattaaagcctggtcaaaccattgatttattcgatgcatatagggctctttattcgccaggaagtagtagcacaactggttttgttattgctaggttgaatattgagacattaacccaaacaggagaacctataaatggtgttggaagcataaaattaacttctattgcttttaatgacgtaaacagcgtaatagattctaatggtaattttaatttaccacaagatccagatgtaattacaggtaacagagatgaatttgaaggagacttggcggataaagctaaagggaaaacaaattcaattgcagaaactgagactgatattgtgtggaatattgacaataacactattaacaataattattatagcccaattgtatttaatttaggaaatcctaatggttcaaaaattcaaaaagatatgaataatcaatatattttctatagtggtatggacaatgctgttgtagaaaactctgaaaattcaatatcgtggactaccaaattaaatccagcaaatgattatacagctttttattcgggtgatatttctgatataatgggatatacattcactgacggacaacaaaaaaagtggtactttgatccatttcataaacgtcctaataaagggaacggtgtaattacaacacaagaaatattagattacggagctcaaacaggacactattatgatccagattcttgctcaatgggaaattttagtgtaattgaacgttataatattaagttaaacaataatacaacgcaaaaccgaaaaatatcatttatggtaagaacaataagcccatttttttatcaatatacaattgatggaaaccccgtaattacaaacattaaatgtgacacatctgaaaaatcaatagtagatggttcttttgtggcacatgagttatttaacgtcacaatcgaacctaacaattcaaaaaacattaagcttgaaacagaaataccaaatattggaacaggcggatttataaatatgctacgagtagaatagaaaggaaaaaatatgaataaaataaataaaaaaataataattatatttgcaattgtaattttgacaaatttatttgcgtacatagcttctgcagatgaatatattccagaattgccccaagtacaacagtcacattatgtaatatataaagatagtaatcagaataatagaatagaagctgctttatttgacataagtgatggaagcaagcaaactttattattaaaattgccattagaatatacatatggacaaacagataaaatacagacatcaaatacattgttatctttaatggataattcaaaatgttttaatattataagatattatcttgaagaaaatgaatgggtatatttcgaatccacagaaaaagaaataagtgaaaatgcaacagaaatattagaaagtgatttgccatattttgaagttattagtaaaggaaaaacagatataaatatatgccgtagagcagttgttaataataaatatttatattctgaacccggttctgcatatgtttctatgtcagatggaatacatgatttaaaaaagctgcaatttaagtataagtttccggaatcatatttgccagagaattatataactaatgttgagcagtttatttctggaaacggattaaatgtaattgttggatttgaagattatacagatacaaatggtaataatgagcagtatttagaaaaatataaaattggtgaacatagtaattcacctatacaagtatttgatgataattatgatctaattaatgttattgaataccaaggttgctttgatattgaattcttttatgacggttatttttatatgaaacacagggattacagtaatgtgtcttatatagatgataaaagagttggtgaaagagtcgatacatattataaaagtacagatttaataaatagaattgaaattaatagcgatgattatactttatctaaggaaaactatagcaaatcatatcttaatgaacagaaaactgttagttcatattttatttatcctgataaattggtcaataaatttaacttaaatgaatatagcataataagagaagaatccaaaaataatggtgctgctttacataacggatatccgacgtattgttatttttataatatggatgataaaagtttaattgctactgatattagtattgatggagtatatggagtagtaatgccaactttttcgaaaggtcgatacggaggaaaaacattttattcgtggtcaacagaaaaatatatttattttgaaccgctatatatggattgtttttatagactacctatatcgcaattaaaaaataaaatatatgttcaacttaacgacaaaatcctaggcttttcacagccgccggtaatagaaaatgaccgaacacttgtaccgatgcgttttctgtttgagcagatgggagccgatgtgaactggaacgaagaaactcagacagctacggcaacagttccaataaatactgatacacaaatgcgtacatttagcagcgaaaaagagaaaagtgtaacattttctatagatgatacaatagctacagtgaatggtgaaactgcaacaatggatgtaccggcaagacttgtaaatgacaaaacaatggttccgcttagattcttatctgaaaacttaggatataatgtagagtgggacgaggctactaatactgcaataataacaactgaatagatatttattccgccgctcaaataaactgagcggcggagtatcttttgattttatataatttagacgctattgccagtatatgtgaagaatcaattaaatggcatgtcaaggcagcaattctttacaacaaatatgtcaccgtttactactaataatagatatacaacgccggaaagttcagaaataagtattgctttgccatatggaggagtgataagaaattctgaaaacggtgcaattgaaagtacagttataccgaacaattctgaaggaaagtggatatttgatacagaacattccaaacaaaccgttgatacagccctgcctgatgaatttaaagttggtttatacagtgaaaaagaatatataaagccgggagagaagttcgataataattggatgcacagcattgtaggaaaagataatactgccttcgaaacttttcaggggaaaaatacatccattgatccaaattcaactgataatatgactagagctgtagttcaaggaatgaatggtttcggtgtaacgcataagtatagattaaagataacaaatatatcagaagttacaaaaaaattctcatatgtcctacaaggaatgtgttatactgtcaattattcaattaatagcactattcctggtaaaacaccggttaatggattaatagaaaagaatgttccttattgggtatggttatcaacagagtgttttaattatgatataagccctggagaaacagctattattaatattgaaactacactgatgacgggaagcaatccaacattacataatgcttttgttattgacggtgatataaaatattatactataaataaattagatgaaaataatgaaattatttcagagcattcagatatttactataaaaatttattagataaaattcaaaaataaggagaagagaatagtgaaaaaaacatttacaaaaatatttataatattaatttttattatcagtatatttggtagcagtgtttattctgataactatgataactatgataactataacgcatatgtagtagatgatgacccaaaaattaatttaaatcaattaggaattaattatattgttgaatctaatgatacacaaaccaatggattagtgaagttatatgaacgttactacgagaattctttatgttgtaattattatatgtttgagtttatgggagtacaatattatattgatttagccaattcttctgtttctaaaccatataatgaaaatgaatttaatttttttattaaggaattgcatgcagacgattatgtaaaaatagattctggatatatggtatggaaaaatcctgcaccatattctactatatttgccggtggtgatagttggaaaggctggagtaacttttatgtatatttttatgatgataaatttaatttaatttctcaaacaatgatgggtagttatattattagttgttcgtgtaataatggaatattttattgcactctatctccaggttacaaaggtcataagttatgtaaatcaactgacatgataaattgggaagaatgttattatgattatgaaaatgatgtagaaacttgcgaaaatattatatatagggggaatttaaaatataatgatatatcatttgacaatggaaacacatttatagatattgttcatgaaaactattctggaaaaagaggtgtgtcgaaatctaactttccatatattataaagaatggtggaggatatttttacttttctaaagatggtgtttatgaaataccaattaatgctgatgaaatattaaatgtacaacgacaaatgggttctaatccggtaacaatacaaagatggtattttgttaagaattcacttatacttgaatctgcttatgaaaataaaataaaaatatctctttcagatataaaccgagtacttgatgaaatgtccagaaccccttatgttcaacttaatgacaaaattctaggattctcacaaccgccagtagtggaaaatgaccgaacactagtgccaatgcgttttttgtttgaacagatgggagccaatgtaacatggaatgagtctgcagagacagcaacagcaacgctgccgacaagtgctgatcagagaatacgcacattcagcaatgaggcagaaaaaagtgtgacattttctatagacaacacaaatgcaacagtaaacggacatccagctgaaatggacgttccggcaagactgctaaatgacaaaacaatggtaccgcttagattcttatccgaaaacttaggatataatgtagagtggaacgaagctactaatactgcaataataacaactgaatgaatatttattccgctgctcagtttatttgagtggcggagtatcttttgttgtatgccggtatatacagaagaggaaaagaagtttgaccagggttcaacaaagagatgggcaagttcagttgaaggactgaaagattcggcaaataaaggaacagaaatagttttagtggacgatacaaactatggatatgcaaaagacacagaaagcgcaaagaattcactgggactaatgatgtccaaggaatattcgggaacaacagatgcggaaactatgcttgcacgatgcgaggaagcgttaaatgcagaggaaagtatatccacaaatgggaacaaagtgataactttattcgtccaaaaaataacagataagaccgcattggaagaaaagatagaagaactgaataataaaggaatagcagtatatgtaatgttactcggcggaggatatgaaggaagcagggaagaaataataaactgtgaaacagagctgaatctgagactaaatgtatcagagctgtacggagcctttaataacatatcaaaaataaaaagttatatagaaaaacaatatggagaagcgtttgcaatgacaatagaagacgcttttagagctgaaaagtcttatgaaacaagaagtgaaaatacagatttagtgataggaacaaatggatatggtcaatttccgtatgatttgacagtaacaagtaattctgttttttcaccagaatcagatatgggtgatttaaaagaaaaaaggataggagattatgtatcagcagcaatattgagaagcagaggacccaatatagtagaatatttattagatgtttataactaaagtattatataaataaaaaaataaaaaggatgtgtaaaaaatgaaaagatcaataggatgtatgattgcaatatgtatattattatcaagtataacagtgaatgcacaaataagacgattttgggctaatggagattttaatataatatgtgatttgggaatagtaccaaaagaatatagagaaaaagatataaatgatttagtaacaagggcggaagttgttcatacactttcatgtctagcttacaatgataattatttggcatcaaaagagaatcaagatggaatatatgaaaatcttggttggagattcgaggatattgaaaataatacaaaagattgtacaatagcatcgtggggcgtatcagcaagaatatttaaaggagatatagaaaatggagtacataaggccaatcttcaagaattggcaacatgcagagacgtaatatttatgtccttaagagcgttggatgaaaatttactttttaaagactatagtgaagtactctattttaatttagcaaaagaatgtggaatgataaattatggtacaataatatcatcaacgtcagtagcaattgattttgaagagttagacgacaatatgacatgggaagaattttcaaaaatagtaagaactattttatatattccaaagactgtgacagcatatggaggatatattaatcaatattacatagatgattggaaaaaaggctatagagaataaaggttcctaataaaacaataaattaagataactttgaaaaataatgtttagtaagtaaattttgagggcgtaaattaatttacgccctccggtaaaccaaaaaaagttggacaagcatacgaataaaaaattgaaacggagtaaaaaacaccggaaagtttttgaatatataaaaattacttgatcatttgaaataaaaatccattaaataccttatttaaatagttaagaaatatatagctccatttcagttttttatgcgtaagtaaatttaggtaaaattatagaagataaaatattgttaaggcaacttattttgcctgatccgaatcaaataagtgaaaatgctttaagaaaagaacaggggttaggtgcaagagtatatcattctacactttaaaaaaggagttataaaatgaataaaaatataagtaaaataatagtttttattttaattacttctgtgttatttcaaagtatttcagtaaatacatatgcggaagagagaacagaaataaatactgatgaactaacagaacaattaatattgtatgaaaactatgaaaatgatagttttacaagagaagattgcattgttaatataatgaaaattataggtttgacggaagatgttattgaattaagtggaatatatttaggcagaccttttatagattatgatgctaaattaaatgcgtatgattataattatatttcttatgcgtggttaattggaatggttcagcttgaattaaaaaataatgctgcgtgggaattaagaccaaaagataaggctacaatacgagaagttttaacttggtccgtacgatgtttagaaaggtctggagaagggtgtgataaaaaacattgggattatatttttacagatgaagaattgtatgataaggcgtcaaagtataatttaattgacgaaaccgaaattcaatttgataggttaaatgatttaataaatgtagaaaagtacaaagaaataatttcaaatctattaaaatgtcaaattaatatacactatgcagataatgagtcatatcctgaagaatcgggatgcgatttaaaatatgatggcaaaacttatggagaatatataatattgaagaatggaggatttgaagttagaaaacgagaactttttttcagtataaatgaaacggcttatgataatccaatatttttataccgtttatacaatgatagaattttcatggactatcttactataaaatatagttttttttataatttaagtgaggaagaatttgataaaataatagaagacaattcaatagaaagatatgaaagaaaatttaaggatagaacaaatacatatgtgtcaataagagaattctgtgaagcaataggatataaagtagaatatgaggaaagtagcaatactataattttaacaaattaaatataacaaagaaaactttattatacgagaaagtttgttaggatgtaatttaattacatcctaacaaattgacaagttgaagagtgaagaacaagagtacgcataaaaaactgaaacggagtaaaaaacaccggaaagtttttgaatatataaaaataattaactatttaaaataaaaatccattaaatacttcctttttaaatagttaagaaatacatataactccgtttcagttttttatgcgtaacaggatgtaataagtgaatataacctaatgggactgccaaccaaacaaacggacaaaaacggaaatgaaacagtaaatacgtataatgtgtatggaagcgttctgacgagcaaggtgacaggagatgaagatataatcaatacatacagcaagaataatcttctgatatcaaccaaacaaggaaaggaagagataaaatacacctatgacgactatggctatatgaaaacagaaagccaatggaatattcagaatacatatagttatgacgtaaacggaaacaggaaaaattatacacaaaaagcaggaacaaatacaatactgacagggtcatatacatatgacatattggtgtctaatgtgcgtgtagatatcttgagttaattttatgtctttgtgtcccattaattcttgagcgtcttttgcttctattccggcctcaaaaagcattgtcgcataagcatgccgtaattgatgagcggttaatgttaaattattttctttgcgcattttgtcccagcgacaagcaagctgttttttggttaaatagtcttcatgctcgttacagaaaattatgccatgttttttattcggcaaatattttgcaactctgtccaaaagtataactgttcttgttccggattctgttttagtttcgtatattaatattgggttatttccgtcatgtacaatttttttgtttacatttataattttattttctctgtcaatatcttcgtaattcaaagcaagcgcttcactaattctaaggccggtatataacagaaagtaggccaaaaatccaaatccctcatgtaaggtgttaacgatttctatttctttggtgtcgggcattttacgtattgatttttttaaattctttggtagtgaaacagatgtaaccgggtttatgttagcatatccattaactatagcaaatttaaatatttgattaaaaacacttttatatgttgccactgtcttctgtgcgtaatcttttgcggcaagccgctttaaaaatatatcaacgtcatgcgatgtaatgttttttatccgttcatttccaaactcttgtaatagagataaatatgcgctttttccgcattttttaaaagtggtatatggtgtgtttaataaatattcgtcgagccattcctcggcaacagttttaaaaatttctcctttttctttggtgtcttgataggctaaaatctttctgttaatttctctttctgatttgccgtaaaaggatttaatttttccgttaatccgtatctgtttacagtaccttccatcggctcgttttttcattgtattcacccttcttacatttgtgatgcttttttatccaaagtgtgggaatggttgttgcactttttgcaacaaccaattatttaacctctcctgcagcgtaattaacgcacccaggaggacataccattacatcatatcaatatggcggcgataacgtcttggtatatcaataccaaccatataaccgatttcgtttaacgctaatggtatgatggaaaatccatctttgtaaaatctttggatacgttttgatttgttggttatattttcataattacttggacatacaaaggtccagtcagctccatctttatttactacaagtctaaaatatttgtctaagtccatatcttcatatcctgctaaacgtaataatataagatgttctcctgcatcgtctatggatgaaactattaaccgtctgccgtcatgagcaactaacagtaatagcggatcgtcagtttgcatcgcattttttacagtttcttcatttggataatatattttttccatattttctccttttatttttggctgagatttatttatatttatcgctgtatatgtataacctggtcgaaatcggccaggtttacacacaccgaaaaaagatgtttgcacgtatttcaatccacgcaccctttatgggtgcgactttttatatataacttttgtatacaatttctatatgtcttattaattcttatttatgttatattacatcgctttgaaaagctatcgcttttccgagaatgcgtacgtttacacaatcgccggaacggtaaacaataggtttatattttgcgttttcggctactaaagtgattgtattagtatctttatatactcttttaagtgtagcctcatcttctataattacagcggcaatctcaccgtcttcaacatcgcattgctttctaataaaaactatgtccccgtcatatattcttgcgtttatcatactatccccctttgctttcaaagcaaaatcagcattaatattagttgtaacatcaatatagcattctaggtcttgattcgcgaaaataggtttgccgcaggcaatttcgccaagcagagggactttgtatgtagtaatagggactatgttatcatattttttttcaagagtgctgttgccttcttcgtcttcccagcccataagataagatggagttgtttcaagagcctcggcaaaagctttaattttactctgggtaatatcgttttttcccatttctattttattaatagttgaacgggacttgtatcctaatttttgtgcaagttcgtcttgagaaagccttaactccaatcttcttgctttaattctatcatataaattcatattagttaccgcctttcgctttttaataataacatattgtagactgaatgtcaacttttttatataaatattaaaaaaggtgttgacaaaaaatctacattgtgttattataactttgttgataaataatctacaaaaaagggggttaattaatgacggatacattagaacttgaacttgctattacacgtgctggtattacaaaacgtgatatatcaaaaatacttgaaacatcagaggcgtgtttatacaacaaaatcaataatagatcagagtttaaagcgagtgaaattgagaagttaaaaaaagttttatcactttcagagaaagaaagaaataaaattttttttaactctaagtagattattaatctacaaataaggaggtgagaaaagtggatataaagaaaattgaacaacttgcagaattgttaacagggttgaaacaatatgagtggtcaagattaaagattgctatagaacaactatacagcgaagcatcaagtgggttggaactacctaatgcgaacgctgtacaaagtagacttaatttagaatttaagggttttattgattaagaatttgtatcatagccggatgaattctataatcaacgccgttgtattgaacatgaatgtagtcgtattcaaaacattttgcgtttttagagccatctaaatagcatagattttctttaaaataggtagttggatcttgttggttggcaatagtgcctgtatctgttatatcggtccagctgcctaataagttggcatatactcgcattatactcacctcctttgagatgagtatagcacaaatgggattttatatcaatcaaaataaataaagggaggtgaaataaaaatagaagaatgcaaaattcaacaaatgcagcttagacaattcaaagaatattttgggattgacgaacaaacagtaaaacgctgaatacataaaaaagcttttccggcatataagcaaggttgcagatggtatgttgatatatcggcgtattataaatggcgtgagcaagagcatataaacagttataaatatacttacgtgaaataaaggaaggagagtgagcaaaatgccgagggagaaggcagcatatagggagaacttagaaagcgttttacagtttcttggcgataaatacggagatagacgtcatcttttgtgtattaaggatgttcaggactatacagggacttgttatgattttgcaaaacgcacatttttgggtggtaaaaaatatatttcggctgagacgtttgcaaaaaacttgagtgaataaaaaaactaactattaaatgttaaatggtagttaaaaaaattaaatttgacctgatatagaaagaggtgattgaggatgtataattttttgattaaatataggctaaagaccggggcgcctgcaactaaatatataactgtaaaatctgtatcggcaaagctggcaaaacagcaatttaatgaaatgtatggttctgccagttttgaaatactgggagtatataaggaggtgagatcaattgtataactggattatacgaatatcgggagcggtggttggcgttgtattgttagttatggttaggtcgcttgagtggtatcccatattttacgcagctccgcttatgatgatacttttggcattttttaattgcgcagaggacacagctgaagaacaacccatagctgacgatgtgcgtaaggtcgtaatcaagccggataatcggcggtgggacttttcggacgcggagtgcagcagggattataaaaataacagtagcaaaagaatacataaaattgtaatgtgaggtgattattataaaaccaatagttatatgtggaaattcaaagtttgacaggcttgttatggactgcaattttgcggctatggcatatatggacaaggacatcaatgaacagtacagagaatttaggctggaggatataaaagtaaagtcctgtctaatgtgcgtgtagatatcttgagttaattttatgtctttgtgtcccattaattcttgagcgtcttttgcttctattccggcctcaaaaagcattgtcgcataagcatgccgtaattgatgagcggttaatgttaaattattttctttgcgcattttgtcccagcgacaagcaagctgttttttggttaaatagtcttcatgctcgttacagaaaattatgccatgttttttattcggcaaatattttgcaactctgtccaaaagtataactgttcttgttccggattctgttttagtttcgtatattaatattgggttatttccgtcatgtacaatttttttgtttacatttataattttattttctctgtcaatatcttcgtaattcaaagcaagcgcttcactaattctaaggccggtatataacagaaagtaggccaaaaatccaaatccctcatgtaaggtgttaacgatttctatttctttggtgtcgggcattttacgtattgatttttttaaattctttggtagtgaaacagatgtaaccgggtttatgttagcatatccattaactatagcaaatttaaatatttgattaaaaacacttttatatgttgccactgtcttctgtgcgtaatcttttgcggcaagccgctttaaaaatatatcaacgtcatgcgatgtaatgttttttatccgttcatttccaaactcttgtaatagagataaatatgcgctttttccgcattttttaaaagtggtatatggtgtgtttaataaatattcgtcgagccattcctcggcaacagttttaaaaatttctcctttttctttggtgtcttgataggctaaaatctttctgttaatttctctttctgatttgccgtaaaaggatttaatttttccgttaatccgtatctgtttacagtaccttccatcggctcgttttttcattgtattcacccttcttacatttgtgatgcttttttatccaaagtgtgggaatggttgttgcactttttgcaacaaccaattatttaacctctcctgcagcgtaattaacgcacccaggaggacataccattacatcatatcaatatggcggcgataacgtcttggtatatcaataccaaccatataaccgatttcgtttaacgctaatggtatgatggaaaatccgtctttgtaaaatctttggatacgttttgatttgttggtcatacggccacttatttcaatccactcacccgtatagggtgcgaccctaataataccttttggttggcttcaccgaaatggtcggtaatttcttgatgactgtttttacacgcttccattgctttataaataacaactaaaaaattctgatagtctttatattcaagagcttttgcaagctctcttgctgaccagaattctgcaccatatttgttaacatgttttattccttcaaagatacacattgataactcatcctttgcgacttgtatatctgttgctctcttgctggcgcaggggagctttttatatttatgtattttatacgtgacggctatgccttgagcaagtcagctcttttttcttcattcaatcatctatattctgtcgttatataaatcaaaatagatatcatatccggcttcactgttgtcacctatatatgttttcacttctatgcagtttccccagaacaccatcacatattttacgggtccgcctgttccataggcttcatcggaaaaattccaactgccgtatccgatagcggtgttgggactaacgaattcagcaatagatgaattataagtcaccgagtgtcccggcttttgatagtcaaaatcaaaatacacaataccgtcacttattgaatttatcgttagcgtatgaccgaaccaatatcgaccgtttggttcaatactcttgtagaatctacctatacatgggttcaatgctagataatcagtcaaaatccaaccgacaagaccattatatataacttggttaaaactattatcccaaccaatgctttcaacttgcgcgccaaggggcacctgtatcaactcttcagcatttacgctcggggatgttctcaatgtgacagattgttggcaattgaccacatccattgtctcggcacatgtcgtcatcgccacacttaaagtcattataataacaacgattaagctaactatttttttcatttctaaatcctcctttaatattcataatatatatatttattttttcttctaaatctgaaattctttttctttaaatataccgcttaatccaattttgaccaatgcctttctaataatatagcaaaatatttttttaaaatttatttattatttgaaatacagatttcacaaggttgatatcccgcctgtatggcttcatcagctgtcatatgtattaaattagttttattttttatataactgcagtttgggttatgatacttttgtcctgtttttgtaactatcacgtccgttatttgaggagcaggtgtagcttcctgagttttttgagtgtagtctatattctcctgattatttttatagtctgctgttattgtagctgttattagtaatattgctgttattattgctacgacaatatatttgatttttatagttttatcttttatttcgttaaattgatcacataatttttcttcatactctgtatattttttgtgcttacgtacttcatcagccactaagttgcttcgtttatcatctagtaacgttgttgctgatataagctgaggcgtatttatatgcttttgtgacaaaatgcatacaggtgcaagaaattcgagtgcaaattcatttgcttcgtcttcctgcccctcatcaattaatccacctggtttatatcctaatatgttgttgctagacatatgccccaaaattatatgacctaattcatgagctaataacatacgtttatcattagcagacaaaccggagcgaataaatacaattttttctgttttacgcttataagtaaacgcttttgtccgttttgcaattgcaaaaatgttgtattgtttgagcaattcaatttgtttgccgttgtttacatcatattttaagatgctccagccttttgcctttaataagtcttctataagatttatagtaattggcaatttgtttattttattttctaacaaagtaattactgcactgtatcttgcaaacactatgatacctcctgaaatcaatttcatataaagatatcataatgctatatggtttttatttcaagtggcaataactgttaattactgttcatcatcgacaaatgatgattcttcaccatatgccgctgtttgtgaagaatcaatgttttgaaattgttcagtaacagtttcttcaccatattcctttgtttgtgaaaaatcaatattttggagttgttcgttgatagtttcttcaacgggagattctatttgaattctattacatatatcttgagggggttgaaggccaatgtaatcaacggtattaccgctaaaaaatacgctcaatattatagaaattatctcaatataaagtgatattttgttatatttttcattttctttttctgcttcttcgtataaagaattacttttttttaattcattaatttcttgttcttttaaagaattactttttactaattcgtcttttacttctttaaaaagtgaaacaatttcatcagaagtgtcattactattgctcagttttcttatagcatttatggtgtattcagtatttgattccgcagattcttcacattttatataatcttcatttgtttttgtttcaacaaaagtgtcaataaaattattttccattgaaataatatcgtcaataaaagattctattgtttgttctggcaaatttgaaaatatagaactaatggaatttttaaagttagaatagagagtatttgatatacctaaacttggtaatgatgaatacaaatctgtagtgttttgaatatttatttttgtaatactgtcattaatatttatagtatttaacttgttgcttagcttatagttcatgttttgcagtttttttgcaatagaaaaaagagtagtttctgatagaatcgaaacaacgttattatcttttattttattaatcatttccatcctaggaatacaagatttctctaactcagttttaaatgacatatccgttgtaaaaggactttcgcaaaatggtgttagtttagttttaactccagtaatatagctcaatgcattatcaatattgcgtattttcgattttaataaattttcttgaattgatacaattttttggcattttattaatttatcaaaagagtcattaactgacatctcactaattctccttatcctttataaattcattttcgccataagcagctatttgtgatgtatctaattctctgaattgttctgcaatagatattggctttgttgctttattaaattccttaacatttgttcgttctaacaaataatcagcagaaacgttaaaataatcgcataatatttttaaactatcatatttaggcagttgacgaccatttttccattgactaattaatccttctgttatacctgtctctcttgacagtttatatgcagtaacgttattttcttgtaaaagttgtacaaataaatccttaaacatttgtgcaaacctccaaactttacaaatgttaagtaaaggtgttgactactttacaaatgtaatgtataataatattaacttaataaataaattaagcatataaaaacacgccagctgtaaaagcggctaaatatatattttttaatcgacaaattaattatacaatatttggttcgcttttgcaataggtttgtaaatttttttgaaaggagtgaaaaaaatggttaatgggattgcagcaatattattaagtgcaaatttgttgatattagcctgtttttgggtaatacctgaagggataactacatggactgctttatttttatttttcagaaaaaaacgcgcagaaagaaaatttaaagaaaaaaacacagaaaaggagaaataaagatggaaaatctagtcaaaattagacttttaaatttagggaaaaagcaagtggacctgttgaaagtaataaggtcaaaaggctattcgaatttacaaccgccgcaattgagttcttacatcaatggtgccaatactacgccacaggctcaagccgtaatgaaaatagtatatgagactttggagcagtgggaagctgatttatcagcctagaacatcacctaaaaaaataataccacgaattgagtaaaaaaacaaccactagatattgtggtggaagaaaatcagcctaggaggtgtaacaatgacgatcaatttaaagtttagagttttaaccgattggaacgacgaattgaaaacaattcttgatttagttgaaaaaataaaagaacgtcaccccaacgaccaactatttattgaagtgacgttcgaaaattaagcttttactatttcaatacgtatttagcaaagttgcaaaataaagtatagaaagaaggtgagcaaaatgccgagggagaaggcagcatatagggagaacttagaaagcgttttacagtttcttggcgataaatacggagatagacgacatcttttgtgtattaaggatgttcaggactatacagggacttgttatgattttgcaaaacgcacatttttgggtggtaaaaaatatatttcggctgagacgtttgcaaaaaacttgagtgaataaaaaaactaactattaaatgttaaatggtagttaaaaaaattaaatttgacctgatatagaaagaggtgattgaggatgtataattttttgattaaatataggctaaagaccggggcgcctgcaactaaatatataactgtaaaatctgtatcggcaaagctggcaaaacagcaatttaatgaaatgtatggttctgccagttttgaaatactgggagtatataaggaggtgagatcaattgtataactggattatacgaatatcgggagcggtggttggcgttgtattgttagttatggttaggtcgcttgagtggtatcccatattttacgcagctccgcttatgatgatacttttggcattttttaattgcgcagaggacacagctgaagaacaacccatagctgacgatgtgcgtaaggtcgtaatcaagccggataatcggcggtgggacttttcggacgcggagtgcagcagggattataaaaataacagtagcaaaagaatacataaaattgtaatgtgaggtgattattataaaaccaatagttatatgtggaaattcaaagtttgacaggcttgttatggactgcaattttgcggctatggcatatatggacaaggacatcaatgaacagtacagagaatttaggctggaggatataaaagtaaagtccattatttttgttgttttttggctttattatatgtattagctaactgtccacaagctgctttaatctctctaccatgagaaactctcatggtaacttcaagtcctgtttgctctaattgatgtttgaacgcaaccatttcttgtttttgtggtgctctaatttttgaattactcgtcgggttgtattgcagcacgttaatcataacatttttgcccttaaaccattttgcaagttgccttatatctgaggaacggtcatttatacctggtaaaagcaaatacgcaaataccacttttcgattatgcctttgtgaataggacaatgcttgcttaacaacatcttcaatagcgtacatgtgcatatgaggaatgatgcagtttctcgcagcctgtgttgctgcatgtaaagatattgtcaactgaatttttagatgttcttcgcgcaatttttttaattgattaactggaccaactgttgatacggtaatgccgtcggttggaaagttaagtccatttctatctcgaagaatatggattgctgcaatcaagttgtcgtaattgaataaaggttctcccattcccataaaaacgatacgatttactttttgacgtatcaatatgacctgttgcacaatttcagatggtgttagattacgaacgaaaccattgcgtccggactcacaaaaaatacagccaacagaacaaccaacttgcgtacttacgcaaacagtcccaccatctcgccgtttaataaaaaccgtttcgatatacctgttgtctttcaattcataaacatacttttcagtatcgctacttttatagactttttttgttgatattgatagattttttttgtgaaatggctgtttatacaattccgcatataaggctcttgctttatcctctccaattacttccgacatttctttgtaagtaaatccgtatgggtcattcaatatttccgtaagtgtacttttaggtaagtgtttcatttaatatccttccttttgtttttcagagtttttgattatgatttctaatttttcaacatcaatgatatgtgttaatttacatttagggcagaaaagaggaaaatttcttaataccgtattataaaatacttgaaccctcgtctttccgttacaaattggacattttatccaatatttttcaagcataatatttctccttttgtgcaaaaaaatacaggtcaattctcaacatgagcattgacctgcatttatacatataacactacaacaaaattaaggcatagtttttatactatgtctatacatcgttagttttgttgtatagcatacgcaaaataagcatgacaaaaaagcccatattgaaaatgggaaaaatcttttttgatttcaatgcttatcgaatacgcatgctatgtaacataaacatttcccccttttaataatactatacaaaaaaagcggctaattgtcaacatatacatatgaattattttggctaactgattgaattgtgtagacatatccaagaagaaaggggaacagtaaaatgtaacagggtgaataactatggcaaaaagaccagtaccgaaatacgatttcaaggcttttggggcagcgataaaggcggcgcggacagggcgcaaggagagccgcaagaaagtgagcgacgaaatgtttatctcgccgcgctaccttgcgaacattgagaacaaggggcagcacccaagtttacagattttctttgagcttatgctccgctacaatatatccgtagaccagtttcttttggaaacgccgccagagaagaacacgcagcggcggcagcttgacgcgcttcttgacggtatgagcgatacaggcatacggattgtgagcgcaacggcaaaggagatagcggaagtcgaaacagagggcagataagaagtgtccgtcagaattgaataaggtttagagagcgttgtaatctttttttgaggattgcagcgtttttcttttgcggaagtttggcaaaaccgggcatagctccgtagtaaggcataagggataaaagcattcgtagcaagcataggaagcgggtacccacttccgtattttcccctcccgcgctgcggcgcgtcggttgaaaattgcttgttgggaagtgtcccaaaccctcggaacggaaaggaaaggagcgaatacatgaacggacgcaaaagaacggtgcaaatcaaattcagagtgacggaagcggaacgggatttaatactggaaaaaatgaagctcgtacccacccggaacatggcggcatatctgcggaagattgccattgacgggtatatcattcagatagaccatgccgatataaaggcaatgaccgcagagatacagaaaatcggtgtcaacgtcaaccagatagcacgccgcgtaaacgcgacggggaacgcataccaagaggacatagaggaaataaagggggtgcttgcggagatatggcggttacaaagattaagcctattaaaagcactctaagcaaagcccttgactatatcgaaaacccggacaagacggacggaaaaatgcttgtgtcctctttcggctgctcctatgaaacggcagatattgaatttgaatataccttgtcccaagcactccaaaaggggaacaatttagcctttcatctgatacagtcctttgagccgggggaagtcgattatcagaaagcccatgaaatcggaaagcagcttgccgacgcggtaacaaaggggcagcatgaatatgtactcacgacgcacattgacaaaggacacgtccacaatcacattattttctgcgccgtaaatttcgtagaccaccgcaaatataattccaacaaaaggagctattacggcatacggaacatgagcgacaagctgtgtcgggaaaatggcttgtccgtcgtcgttcccggcaagggcagcaagggaaagagctatgcggagtaccaggcagaaaagacgggtacaagttggaaaggcaagctaaagattgccgttgacgcgcttatcccccaagtttccagttttgaggaattgttgcagcggttacaggcggcgggctatgagataaagccggggaaatatgtgtcatgccgcgcccccggacaggaacgcttcacccgtcttaaaaccctcggcgcggattatacagaggaagccataagggaacggatagcgggcagacgggcaaaggcggcgaaagcccccagagagcagcgcggcgtttcgctgcttatcgacattgagaacagtatcaaggcggcgcagagtaagggctatgaacagtgggcgaaaatccacaatctgaaacaggcagcaaagaccatgaatttcttgacggaacataagattgaacagtacgcggatttagtcagccggattgaagaaatggcagcggaaagcggacaggcggcagacgcattgaaggacgcggaaaagcggcttgcggacatggcggtgcttatcaagaatgtttccacctaccaaaagacaaagcccgtctatgacgcataccgcaaggcaaggaacagggagaagtaccgcgccggacaggaacaggcgattatcctacatgaagccgccgcaaggtcgctgaaagcggcgggcattgcaaagctcccgaaccttgccgcgctgcaatcggaatatgaagccctccaagcgcagaaagaagccctttatgccgactatgggaagctgaaaaagaaagtccgggaatacgatattatcaagcagaacattgacagcattttacaggcagacaggcagccggaacgggaaaagggaacagagcgcggataaggatagcaaaatccccgccgctgtgctatgatagggctatcaaaaagcagaggagcgttgagcatggaaaaccagaaaatgccggaatatgaaaccatacgcgccgccgttgccggggaaaaatgggcggtggagaaagtcgtggagtgctacaaggacgaaatcgacaggctatcgacggtagcggtcagacagccggacggaagcacgaaacaggaaatcaacgaagatatgcgccagtccatcacaaagaagctgatagaagccctcccgcagttcccgcttgaagaaatggaaaagggaaatgtcagataggcaaaaaaagaacagggcgcggaagccagtatatgacttccgcgccctgtctttttatgggtgctgttttcgtgaatgttacgcagtagaacgccatttttgggggtaaaggtataaagtatcgcctatccgattttcacgcccggaaagccctgtaaatcaagggattttccgcgcctactgcgtaacaggggcgcgtcttttcctcatgcgctcggcggcttgtctgcgggtgatacgtttccggcagacggggcagtatttgacactgttagaggttgacgcaaagaacgcgccgcactcggtacatttcttcttatcccctgtctggtaaagctccgcataaagcagcctgtcggcgggaagcaccgcaacccggaaccacttgcagagaagcgaataggaaatgagctgcggacatacgcactcgtccccgtcgtccagtaagatacagttcccgttatcataattgcagcacgtccggcgcacaagggcgttgactttccggctctggggcggcgtcagccgcttaaccccgttcatacttcatcagcggcgtaaatgggaagctctgcaaattccgcttcggtcaaagcgtccactttggaaagggtgcgctttgcaagctcccgcatatccgcgtccatgtagggcagcgcggcgttgacattctcaatcaaagcccgcttgccgccctcgttgtaaatgctcaaaaggtttgtttcttcaacagtcagtctaatcatgctcatacctccatatcgtgattttttgtttttgccgccgcctttttcggggcggtctttgccttgtctgctttaagctgcgcccggatagaggggcggggcttccttatctccctgtcccggttctcccccttgtcaatcagcgcatacgtcccatgtctgccctcgattttggaaaaggaaagggtcttgtagggcagcatggagaaaaggcggtcagtgtcctttgtggctgcaagccgcatgaacgccggggaaagctctgccatgaaatgggtcttgttcgggctgttcggctcgtaatgccgcttcatttcccgcacaatgcgccgcgcttccgtttcaatcagcccgtcccgcaaagcggcaatatgcgccttgaaatcccccggcgaaagctgctcccggctgcgccgttcttcctgtaagagcgattgcagcgcgtccgggtcgttgggtacggcttcaaagcgttcaaatttcccaagctgcgggtctggggttccgtcaaaatatctcccggcttcctgtaccctttccccatgctcataaatcagcttcaccgtatcggcgggcagctccttttccttgacgcgctcataatgtttagagtagtccagttcgtacagattgcccttgattttcccgcgctcctttcccgtcagctcgattgcataggcaagaacgcggtcgcttgtctgctccatgtagaaacgccatgtgttgtggggcgcggtgtctttgaggaaaacgtcgcgctcccggaaacagtgcgtcccggacgggcggcagaaccacaaaagtgttttgtcctccctgtgggggcttgccgccgcctttgcgataatctctttgtcaatgtctaagtcgctctggtaaaagcctgtgttctgcttcataatcgcttcaagggaagcaaacaaatccatgttttcaaatttgctctgttccggcatgggtcagctcctttccaagtcctgtgacttctgctttgcgtttttcttctgtgccttttccttgtcggctctaagctgcgcccggatagagggtttcttttccggtttcgctcccttgccgcgctccttgtcggctttgacagcgttagccaggtcaacaagggaaatctgctcgcccgcctttacctttgcttccagttcgtcaacggtgggggtgttgttgatgataccgtcaatcatgttcccgttctgctctgtggtctgctcggcggttttcaagggattgtcccgctgcgcctgttctgcggcaacggcaaacgcccgcgtcccattccccataatcagatactttccgtcgtccgactggtggtgaaagccatatccggcggcttctatctgctcccggctcatggcggtcacatggaaagtccccctcggtgtcttgacagtttcgcccgtttccaagtcgtccggggtaagctgcttttgctcctgtaaaaactccggcacttcccgaaaacctacactgtcaacgaaatgcgccgcgtcctgtccgtcctgatgaagcactaccacgtcggaaacggaaaggctgtgtcccttaaaatctttggggtggtcgatattgaaacaggtgtaaatatcttcaagggaagtttccggcgcaaggggcgcggaatagacaagctcatagttcgccctgtcaaccacatttcccgccgcctgcaggcggtcgtatggctcaaagcggaaatcccttgtttcgtccccgccctttatctggtaaatggaaaaggtgtctttgtcctgtccggcggtctgcgccgtttcctgtgcctttgcgtaaagctgcttcacgtcgccctcggtcagctcgccgcttttgagctgccccataagctcgcggcatttctccggcgttcccgtataaagcacgtcgcccattttcgcccgcccgttctcctgtgtcacataggcttgcaagaggtagctgttttcccggctgtcgctgtaagggttccggcgcactctgtaaatcgtttccggggtaaaggcttctttcggggctgcgcccgctttttcctgtgcgccggattttcccggtgcggctgcttccggatccggcttctccggcgcggcttcctgtccctctctggtgggctgctcctgtccggcggtctgctccttgtcctgtgccttttgcagctccgctaagttctcgtctatggaattgataatctcggcggctgcgctgcgtatcgtttcaagggagcttttcagctcggacagctcccgcccgctgctccacccggcgacatagccgaaagagtagtccgacgtgtcaagcccgtaatgttggcagacagtataggcgacgctttccgcttcgacttcgcgggtgcggcggtcaacgtggggctgctgctcgtcctttggcgcgttgaggtcaatgtcgtgcagcttcgcatgggcgatttcgtgaatagcggtctttaaggtctgtaattcgctcatgccctcgttgatagcaatgcgcttgtcctccaagtggtagtagccatgagagccgccctcgatattctcaaaggcgataggaacgggggaagtcttttcaagggctgcgaaaaaatccttgtagcggtcaacgtcgcctgtcagctcgtcaaccgcaatgtccggcagctcctttccctcggtctgggaaacgtcaaagacggataccaccttgtaggcgggtatggtgacttccttttcctcggtgacgggcttcccgtccttgccgataacgggcttctgcgtgtgcgggtcgattttctgcatttcctgtttgattttatagggtgacggagcaatgattttaattcccttttgccctttcatcacgtttcgttcaaagttgttcttccaagcggaaaagcccgccacaagggaagcgtccggcttctgcatggcgataaggacggtgtttcggaagctgtaattatggaattttgacatgactttcagatattcccggtaacgctcgctgtcaaagagttccgcaataccctgttccagacggtcggtaatctctttgagcttttcggcgggcttctcgctcgtcagcacgatagggataaccgggcgcggctcctgtggctgctctgcggtctgcgccgttctctgccccggcgcggctgcgtccatttctacctttgacgggtcgggtctttccggctgcgggggctgcggcgttacccggtattcctccggcacgtcgcgcccgtcgtaccattctgtaaaggtgttgcggttgttgtagatatagcccttttcggtaaacataccgtcgtcgttaatggaagcgtcccgcccgtattcctcatacatgaaatactttttcgcttcttcgggaagttccggttcttccagttcatcaaccagataacgcccgtattcttcttcattgtggacggacggataaatccagtagcagtcaaggttctgtgcaaggttgataatgtcctgtaagctgtcggcatggtcgccgtattcaatggctgcaatgaatttctcccggtcgtcgtcaaactgcatttccaagagcttccctaaatagttcagctcgtcggggtgggaatactcgcttaaatgctccgtcaagccggggatagtggattgaaattctgtgaaatgccattcctcatagtgcttgaagtcaatcccgatacggtcaaagacttctttcagatgttcggcagtcgtggggaatgtcacccattcgcccgcgggtctgccctcggtgtacttcccaagattggaaagatagccgcttaaaatcggttctgccatttgttcgctcctttctttttcaatcatgcggtgcataagctcaaaatcctcaatgctcatgctcccgtcaaatacataggggttaaaatcctccccgtcccggtagggcttttcggaaaagggaagccccgcttcatgggcggctgccctcgcttcctcgataacctccgggggaagcctgtcgtcatgcgctccgataaaaccgtcaatgtcgttcatgctgttttcgtagtggtaacgcactccggcggtcagctcgtcaaggctcatgtcctcgcctaaatgcccgcaatagtagccgtttaagataacggcggcggggtcaatgctttttatttcctctaaccggctcctgtcctccgggtagagcgtatcgtccatatcaagatgaaaatattccgcgttccatgaacgcccctgtttccagaacgccacccatgcgataccgtccctaagctcgtcttgatagtcctttacggtgtcccgtaaacttgccatagtgaaaaacctcctttctctgcggcagcgtcataagctgcattttttggctgcatggtctactacgggtacgcccgcatttctgccaaatatttttgaaaatttttagagggtgaagccctccgcaaaagagggtttgggaaacttcccaacaagcaaaatccccgtccggcgcgtcagcgtcgcaacggggatttacggaagtgggtacccgcttcctatgcttgctattcaagtttttagttcttctgcacttcgatacggtagttgacgtatttcccgccagtgtcagccagaacgatagttccgtcgtaggtcttgcctgttttcggggagtagagcttcttcacattcgccttgccggatttaaggagcgcggcggcaatcttcgcggaaaaagcggtcttgcgttcctcgaaaaagcggtcattcttccacatgacaaaggcacattctttgttgctgcaataatagtttttcttcccctcatggacgggggaaccgcaacgggggcatttgccgacagagggcttttcctcccggaacaaatcctttttcccgtccagtgctgcggcgtgtgtctgcacaagctcccgcgccatagcttcaatgccggacagaaattcgccggggtctgcggctccctttgctatctgcgtcagattgttttcccattctgcggtaagctgtggggaagtgagtatatccggcagaatacagataaggctgttcccgtttttggtagggataagctgcttccccttgcgctccgcaaagccgccctttaccagtttttcaatgacggcggcgcgggtggcgggagtgccaagcccccggcgttccgcgtccgggtcggtgtccccgttcccggcgcgttccatagccgacaaaaggcttgcttcgctgtggggcttcggcggcgttgtggtatgctccgttacttttgcggcggggttaggaaagccctgtccctcggaaagcttcggcagcgtcacgtctgcattttccccgtcctccgcttcgggcttatctttcagcgtcgcccggtatctgcgttgaagctctttccaaccctccgcaagtacggtctttccccttgcggtgaagtctgtcccggcgcatgagaaaaccgccgtaaccgcttcataaatatgcggctcggcggtggcaaaaagcagacgcgcccccgcaagggtaaggatattcttctcgctttccggcagcgcgtccgggtcagcctttgcaagctccatagtgggaatgattgcgtggtggtctgatacttttttactgtctaatacctttacaacctccggcgtgaagtccgcgcccgccataaaggggagtttttcgcaaagcagcgcgataatgcccgctgcggtgccgcccatgtcgtcagtaagaaagctgctgtccgtcctcggataagtaaggagccgcttttcataaagggattgtgcaaggtcaagggtctgcttcgcggtgtagccgaaaatgcggttcgcttcccgctgcaaagaggtaaggtcaaagagcttcggcggggctgcggttttcttctctctggtgagggaaacgcataccgccgtttccgcttcgcaagcccctttcagcgcgtcggcttctgccttgtcggaaatcctcccgcttgccgcttccgcgccggataaatcaaggcgcacatgataatatttttctttctggaaatgggagatagccgcgtcccggtcggtgagcatttttaaggtcggggtctggacgcgccccacgttcaaggtctttccatacaggcaggagaaaagccgggtggcgttaatgccgataagccagtcagcctttgcgcggcagagggcagacgcaaagagcgcgtcgtattcctgcccgtctttgagggaagcaaagcccgccttgattgccccgtcctccattgaggaaatccacaagcggcgcatgggcttcttgcagcccgccgcttcgtagacaaagcggaaaatcaattctccctcgcgccccgcgtcacacgcatttaccacttcggaaacgtcggcgcggtgcataagctcttttagggttttgaattgcttccccttgtccgggtcaacggcgtactgccattcctccggcagaatgggtaagctctcaaaactccattttttatattgctccccgtaggcggcagcttccgcaagctgtaccaaatgcccgacgcaccatgaaatgaggcagccgccgccctcgatatatccgtctttcttttccttaacgccaagcgcggcggcgatagtctgcgccacgctcggcttttctgcaataatcagtttcattttctgttctcctttcggttgttttaggtttgaaattggtttatactttaagcattactataagaaacaggtgacaatatgaaatcaatacatactttcgatgtttttgctcctactgatgaacaggaagaagcaatgaataaaaaacgtggcgggcattacaggcgcggtaaaaacaaagaaatggattactttattgagtgtgctacttcgctatttcccaacaaccattattcaaggttcacacctatatatgatacgacaaaagagttttatcaactgattacttcttccgatacaacagaaagagctatactaaattggatagcttctaatcgtgcatggaattatttgtttggcttattacggcattattacagaacaggacaccatgacgataattatatctttccagagttcaaaatcgggtcggcttatgtggctgattatctgctcataggtaatagttcagacggttatcaatttgtctttgtggaattagaagctcccaacgggcggataacaaaagaaaaaggtactcgtttcggggaagtaatcaataaagggattgaacaggttagggattggcaaatgtatattgctgcaaattggaatgtaattgtagcagaattggaaaagcactcattctccaatacaaagttacccagacaattatacaaatattgcccttatcaaatctactatgctgtgatagccggactccgtaaagattttgagaatattcgtgatagaaagctccaactgcaaaatgaaaataacataacacttttgcattacgaaaatctcatagatgttgcaaacgaaaattaaaagtccattttcagcgttccggctcacttgcctttttctcctgtacctgtttcagacagtagcccacacaagggagctgccctttgtacggacaggaagcgcaagccggggaatggggaacgggcggcgcattgtcacgccgcccgcccggtctttgtatcatcatcttttcaaagggattgtcggtaaacagggtcatgcttcctcgtcctcctgttcttcatcagaaagcccgtccccctcgtccggctcgtcctcgtcgtagtcgtcaaaatcgaaatcttcaaggtcggtgccgcccttgacgttttgcttcggcttcataaacttaaaataatagaacgcgcccccgccgccaagaagtgccacgacaaggaaaagcacaagcccgcccgcattgcctttctctttgggcagctccggcggttcctcggtttccggctctgcttccttgccgctgcaagcggtcatgttgtccttgcagacggggcagctcacatttacctttccggcttcgcatttttcggtgcaactgcaaacggcgggcggggctgcttcggtgcttccgtcctccataagtgctaagaggtcggcttcgtccacttgattaaggaaatgtacggtgttctcgccctcgtcgtcccggtcaatgaggatataaaagtaattgccgtttttggtcgttacggtgataagctgcttgttgccgccgaaatcgtctacaagggtcgcgttcccgtccggggtaaggggttcttccttttggggttcctcgtagacaacgccgctgtcgttggtgtcgtcctctccctccggggtctgtgcaaaagcggtgacggaaaagccgcccgaaagcataagggcggcgcaaagtgcggtcagtgttctaaggattttcttattcattctcggtgtcctccatttcttcggtgtcgtggtctgcgggttctgcggggtagcccggcgcggcttccatgcccggaataccgcccccggaaagcatagcggaaagctcatgcggggaaaggcgcatggagcgcacaagctgtacgatttgcaggttttccgcttcggttttctgcgcttcaagcccccttaatttattctggtactcggtgattttctcgcgggtctttgcaatctccttgtcgatacgttcaattttgttcatagccatcaataaatttctcctttcagattttcatttttttgttgtcagttccaattcattaagccgtagcccttgatacaggagtaattgacggggtagctctttatcttgcaggcgtcgccggaattgccctcgacggtatagacgcgctccccgtccgtcccgataacaagccctacatggtctgcgctcccgtccccgtcccagtcgaaaaagatagcgtcgccgggggcgatattctcatagcccctcgcgccccattgcccgcgtgactggaaccagggtacgccctgtgactggcacccggcaaagcgcggctcgcttttcccggcttgattgtagcaccatgaaacaaaacaggcgcaccattccacgcggctgttaaatccgtaccagctccaaaagggtcgcccgcctacgttgccgacttgccgcttcgcaaggtctacaacggcggtgttgccggggcgtgtgccgtttacaagctgtacgccgcttaaatcctcggacgcgcccatatcgggggagccgccgccgaaaatcagcggcttgtttccgcttgtttccagatagacgcggtacatttcaagctgctgtggcgttagaagttcctccgcaatctcggaaatgggcttgttcgtcagcttcacgttgaggatatggtactcgtagggtacttcctcgctggtcgtttcccctgtttccgggtctgtgcttgtttctgtgcggtagcggatttccgtttcttccgtcagcgtcaaagtgtactgcatggcaaagacgcggtttagttctgcctgtgcgctctgcggggtgtaggtctgtaaaagggcggtgaggtaggacgctaactcatgggggttatgcccgatactgtcaaggtcatagcggtattcgtcatagccggggtgggtgctttcgatattgtcaatctgctgctgaagctcgttttcctttgcggcgtaattattttccgtcgccacaaggtcgctgtcctccgacgtgtaggaagtcccaagtatgccgttcatcaagccggagaacatggagccgcaagaggaaagccccgccgataccatgatgaataagagcagcgcggcaacggcgatacatacgcccgccgggtgccgccctacaaaagcgattgccttttttgtttcctcggcggtcttttttgccgccttgcgggtgttctctgcggctttctgcgccgtttttgcgccgcctttccttgccgactttgcatactgccgcttgatttgctgcttctgcatgaagcgggaaaggggattgcccgcaatctgcggattgtcatgtagggatttatggtactggaaatccacattcgccttgaacgccgctttctctgcctttgccgccgcccggtagggtttgagcttgtggctgcggtagccctccttgactttccgcgtcccgtactttgcgccgcgctctgccagttcttcggatttgtgcgccccctcaacgccggaattgtccttttcaacggaatgtatcttgttgtggacgaaaatacccgcttcctgtgcggggcgggatagcgggttattgtggggcttattccttcctatgggcttttcctgttcctcaaaatgtaggcgggtcttgcctttcccggtggcttcatcaaaggtgcgctcccgtacaagtttcttttctttggggatagccgcctttgccgcgtccagacggtcggctgctttgtccgattttcggatatacctttcaagctccggcgttgcccgttcctcgtcggtaaactgcaagcgggaagatttttcttttgctgtggcttctgcctgtgctttcctcgccgcctttttgctcgcctttctggtacgcgccccgtcgatacgctccaagacgcgctcggctgcggcggtgtcctgttcccgttctgcccccggcgcatggggaagcggcggcgcggcggctgtgggcgcgggagctgcgccgcccggtatggtctgcgctgcctgttccggcggctgcggtgcttcggtctttgcaaagtccgcgtcccttatccgcttgctgatacgtttctttttcccggtggcggcgtttacctcgacagccccctcgcgggtcattttctgcgtgactttctcacgcgctcgatactgttttatttttctgtccctccaatccgcgcccttgcaagggcgcaatactcggcgtttatctcaatgcctatataatgcctgtcaagctgccttgcggctgctcccgtcgtgccgctgccgaaaaaggggtcaagcacaacgccgcctttcggacagcccgccttgatacaggtttcggcaagttttggcgggaacgcggcgaaatgcccgcccttgtagggtacggtattgataagccacacgtcccgcctgttccgcatggtcggcatgagggcttcgtcgtagtagctgccgcttctcgcccggttaagcccctgtactttcccctgtccgggtacttcgtccgcatatttctgtcccgcgctgcgcccggtgcggtaccgcgccgccgttgtgggggctaacggctcggctatggcggctgcgtcatagaaatatttctttgacttcgtaagcagaaagatatgttcatagcagcgggtagggcggtctttcacgctctccggcatggggttttctttctgccagataatgtcgctccgtaaataccacccgtcagcgcgtagggcaaaagctaaaagccaagggataccgattaagtccttttgtttgcagccggaaacgcggttgttttttgcaatctgctgtccgtttctgcctttcgggttcttcgggtctgcatggtagcccttgttccctgtgccgcagtaggtgtccgcgatattcagccagagcgtaccgtcagaacgcagtacccggcgcagctcgcggaaaacctcggtcagcctgtcaatgtactgctccggcgtgtcctcccgcccaatctgcatatcaagcccataatccctaagcgcatagtagggcgggcttgtgacgcaacagtgtacgctttcctctggaagctcccgcaaggcatagagcgcgtcccggttgatgatggtgtcagttttcagcccgttcatgcttcgcccacttcctccggcttcgtcgtcattacccggtaaagctcggtgtctttcgggaagcggtctacaaagggcagcaccacgttcccgtagaagataagcccctcgcccgcttcggtgtgggtgacatatttcatctgctgcggggagatgttgagctgcttcgcaaggatagcccggtcgcacgccgcctgattgagcatgaggacaaaatcagagttttcaaagatattctccacttcgcgggaagcaagcaaatccttgacattctgcgtaatggctgtgggtatgccgccccattttctgaaacgcttccagatttcaacggaataggcggcggtctgttcctctttcaagagaagatgaaattcgtccataaaataccgggtggatttcctttctgcccggttgacggtgacgcggttccatacctggtcctgcacaatgagcatacctaactttttgagctgcttcccaagctgcttgatgtcaaagcagacaaggcggttgttcagctccacgttggtacggtggttgaatacgttaaggctcccggaaacatacagctccaacgccgccgcaatacgcgccgcttccggctccggctgcttcaaaagctcgttgtagaggtcgcccaagataggcattttctccgggtcggggtctgcaaggaaagggcggtacacgttcctaacggcgcggtcaatgacggtcttatcgacgggctgcaagccctccttgccgcctatgacaagctcgcagagggagaggataaagtcggatttcagcgcaagggggctgtcgtcctcgctgtaattgaggttaatatccatagggttcacatactggggcttcccgtcaatgcccttgcccgtaggggataagcgtatcacttgcccgtcaagccgctgcacaagggaaaaatactctgcttccgggtcgcagataattatgtcgtcgtcggtaatgaggaaagcgtttgtcatttcccgtttggcggcaaaggatttcccgcttcccggcgtacccaagattaagccgttggggttctttagctgcttgcggtcgcagagtatcatgttgttactaagggcgtttaagccgtagtacaaagccgcgcccgtctggaaaagctcctgtgtgataaaggggataaagatagcggtgcttgacgtggtaagccctctttgaatggggataaggttctccccaagcggtacagaggacataagccccgcttcctgttggtagtcaaggcgggttaaggcgcagttgttcttctgtgcaatgcccgccgccgcgaatacgtcattttccagtttccgcttcgtgtccgccatgttcaccacaaggaacgtcaagaggaacattctttcattccggctctgcaagtcctgtaagagattcttcgcttcgctgccgaaagtggcaaggtcggacggtataatatccatgtcatagccgctgcgtaccgctttcttctgttcctcgattttcattttgtcaaggtcggtaatcttgcgcttgattgtctttatggcttcggtctggtcgatactgtggatatgcagattgacgataacgcccgtttccaagtccagaatgtcagataagatacggtcgtttaattccggcgcaaggatttcaaggaatgaaaccgcgccgattttgcgccccatgcggaaataacgcccctcgccaaaacggaaagaggacggggcgataaagtcctttgtggaaagcccggacggggcaagccatgaaaaatcaaaggcaaactgcccgccctccgggtggaaaatgccatgcagcattttaaggcgttcatagcctgtcatggggcgggcagacacgcccaagagcttaaagttgttgagtacgtccgtttcgatacgggcaaggcgggatttcgccgcgcccagactgtcggcttcaatggcaaaggtgatatattttgctttgacaagcccgttgttgccctttgcaagctggtttttcagcatatcccggtattctgtgcggatagaattgaaagcgtcctcctgtgccgggatattgaccgccttttccgcttcgccgcgctgcgtcccttgattgatgaaagaaagctgcaccgaaacggaagcgtcaaagtagttgaggaagtcgcaccagttctcaaaaatggcggtcttgtcgtctgcctgtgcaagctgatagttaatatcttcaaaggcgacggtctttgagtatttccgtcccgtaaccttgcagataccgtccgggtacatctggatataggggattgtctgctgcgcggtgtgggctttcccgtcgccctttgcctgtctgatgatttccgcaatctgctttttctcggcgcgggtgagcttgcggggcgggttaggctttgtgcttcccgccgcgctgtttcttcgtgtttccttttgcaatcgctgatacctccttttcaagttttctctgccgttctaagacggaataaaagttgtctgtcctgtatggtcgttctttgggggctatgaattttgtccgtatgatgttcttcaccaccacttcaaggggctgtccatgcttctcatacatggcaaagaggaaacagggcagcatgacggcaatcatagccatagacgcaaggcttgtgcctgtgctgtctttgagcagaaagaaaagcggcaagccgaacaggagagccgccgcaaaacatacaatctgccgtttggtaaggttgaaagctacttttgtcttgactttggataagtctttgggtacgggtacatacgccaagtgaaaacctcctttctctgggtttggtgttgctgtaattttccataagggtaatcaaggcaaaggtcaatctatgccctttgcccgcccgtattatatgggggttatccgcgtcaaggtcgggtcgtattttcgccgcttcgctctgaaaatctccaccctgcccttgacacgccgctaatgcgcggagaatatcgacttcgccagtgcgccggatttgaacagggagaaacagaggataacggtataggctgcaagggagaatatcgcgctgtgcagattgtccgctattatcatgttgtttaccagaaccgcgtaaatgccgacgcatatcataatgaggaagccttgaaaaccgatagcgaacagggattttaggtagttgtttcctatctgcccccattcccggttcgtcatagttgcaaacgggataggcgataccgaacagtaaaggtaaatttctatcatgcgcccgtagaggataacggttatcagtacggacatgattttcatgcacaagctcacaaggcttgtttccatgacaagtaagagcagttcggggatttccatagcgtcaagcccgctctgcatggaagcaagggcggcggcaacatcaatctctgtgctgccgccgattacccccgccgcgccggaaacaacgtgctgcgccatatcgaacaccgccatagtaatgtcaaaggtgtgcgtcacaaggtagactgccacaaacgccttgaacacccacttgaagaacatggaagtgtcaacgtcgtgcatattgttcttttccgttaccatgctgataagctcatagcataggacgtaggtaatgacaagccccgcaatgggtacgattacattttcactaagggtctgtatcatggagaatatatttgcgttccacccttgcggggtctgccctacctctgcggcgatagtgccgactttttcgtttacgtccccgaacatagttgacagattaccgtttatggctcctatgaggatttcctttatccattcgttaatcgcgtcaagtatgctctgcataagcctttacccgcgcttcttaaccgaacaagccggaaagcagcggtacaagggtcatgccgataagggcaacgccgccgcccgccataagctgcttcatgccctggctctttgcgcccggattgtcattgccgtagccctccatcagattgattacgccccagataccaagcccggctccaagtgctacaacaagggtctgcaaaacgtctactgcgctattgaaaaatgccataaatatatcctttctgccgcgtctgcggctgtccggcaagcggacaaaaggcggtcagcgtatggtcgccgccgcacaaaaaaaccgccctctggtaaaggcggctgtccccgcgctgcgtaagttctgcggcgcggcggtattcagttgtaaggggtgcggctcctgccgctgtgtactgcgccggaaagtgggggcgcgtatcatgtagccggtatggatagatgtgattgcttcaatcgctcctttctgtgttccgctgtgctgccggacgtttttttcagacttgcgggaagtgaatagcttgcgtagcaaggtgttcgcttcccgcaagttcacaaaggggtagctgccgcaaggcagcgtaggggaagtgtagcttcccctgtcccccggcggtctgccatgctgtcactgttgcgggataagcccccggcgcgtgacatactccgttgcaaaacggcggtgttccgcttccttttcccgccaatactcccataatgcagcgtcggcggcttccgcaacattcattaaaaaccgttcaagctgcttttgtttttcctctgcgctacgtttcctcatggtctgcgtcctcctgtaagtctgccgcgtcaagctcgtaatagtcaaaaacctcgtcgggcttgacaatggcggggcggcgtttaaggtgcttttccatgtcaaaggcgttcttcgggtctgcgtcggacaggtacttgtatttcgggtgcttcgttatgtcgaatttgtccgaaaagaacgggcgcaccccgcgtagctgcaagatacatttccctccgtccatgactgcaatttcatcttccgtcataagctgctttcccaatttctgatagttcagcccatgcgaaagctcccgcccccttgtttcggacgtgttaaagctgtctatcgtttcttttcctaaaatttccgatatttctttaagggtggttttctccttgccgcccaagaaaagcgtggtgtcgcagttgccgactatggtatcggcgttgtctttgtaaatggcttttagctgtgactggctctgcaagatgattgacgcggatatttcccggctccgtatcgttgcaatgagcttttcaaactttggtatctgcccgatattcgcaaattcatcaagtaagcacctaacatggacgggaagccgcccgccgtattcatcatctgccttgtcacaaagcaagttgaatagctgtgtgtaaaggattgaaacgacaaagttaaaagtgtcgtcggtgtcgctgatgatgacgaaaagggcggtctttctgtcgcctatggtgtcaagctccatttcgtcggtttccataagctcccgcagctccttaaatagcgataggtaatcctttgatgttatctccggattttcccccgccctaaaccgggcatgaacctttcagctcacccggcttgccatcaggaacagaatttatttcatctcaataactctcaacgtggacaaggcttcttaacttattgagtttttctttctgcttttggtcaaggcctaggatttccatatactttctgataatatcagggtttgtagcatgaatcaggtgatgtacatcttcacataccaacaccagattttgataattgtccttgccgcctaaataccgtggcactttgtgatggcaatgaatatcgccaatagaaagcactttgccagatacggcgcattttcccatttgggccgaatacagtgaaagcctgttatcgttgtattcgatagtacggtacagaaccgggttcctcattaagtaatgaagaaccgtcatgtcgattctgtccagattcttatggatttcggctctgccctcgggcatataggaattgattttgcggttcatggactttgggggcttgtgccgtatgtagccaatcgggacaactgcgtgtccggctacatatcggagctgtttgcttttcccataccgttccctgataactttcggaacttcacacggaatcttcctttttctgacctgttttgcagttttaacccgttctttcagtcttgcccgcaggctcttgtggacagataaggcgaatggcgtaaggtcatcgcagacctttgtggctaattgatagtagtcatggattcccattacataaacgttgtagcggcaaatcgcctgatattcagtacgtttgccttgtgacgggaactcaatgtcgtaaatcagccgttttaagtttggttttattttcgcaatagatttctctctgatatggctctctactacatatttggcgcgtccgttgctccgtttcccacgggggataacctttaacttgaaaccaagaaactctgaatactgctctttcaggttaatcaccttcgatttttcaggactgatttcaagagaaagcctttcatggagccagcttttggttgcgtggaataacttcaccgcattttgatagctgttcgtgaatatcttaaaatcatcagcgtatcggacgcaggtgacttctttcagccttgtcctccgcagtgcggcaaatttatggctcttgctcacgcttccgttgtaattgaccgattccttgtaagggaactccgttggtatttcttcccattggctggcaagccaccaatccaattcgtttagaactacattggatagcaggggagagataatacctccctgcggcgtacccacctccgggaatcctatcccggccacctccgcttttagcatagctgatataatactaagcagcttcttgtcttggattcccattgtccagagctgtttcagcagttttccgtggttcacgttgtcaaagaaccccttaacatctatgtctacgacatagtggagattgcttctctgcatatttttgtgaacctgggcgattgcgtgctgttggtttcggttagggcggaatccataactgtggtcgtggaatttcgcctcacatatcggctccatgacctgcaatacgcactgttgtatcagcctgtccataatcgtcggtattccgagcgggcgcttcttcattgggtcatttcctttcggaatttctacccgccggacgctttgtgggacataccagtttaatttgcgctgtatggcgcatataagctgttcatcagagagtgctgataattctgtgattgtttttccatctgtgccgggcgtcgtactcccgtggttcttcttgatgttgcggtatgccagccgtatgttttcgggtaatgcaatgatttcaaccagatgtttgaaaactttgcctttattgctgtcggcatacagcttatcttgaattgcctggaagtcataatactcggcgtgccttaacttatctttcttctttgcctttcctgttgccatagtcggttacttatccccactttcgtttggattttcgcctttcttagtcctactcgaacctatgcgtgtttattgaatatgattttgtttctgttcctgactacagcccgtccctccaccgcttactttgttcacggcttcacaggtagcatggctgctctttcctcccggattaagaacggttataccgcacctcccataaaaggcggcacgattttcccgcccattgcttcatcatgcgtatccactccacatccggggctttccacgttccgatattcctatctttgcataatacccttaaccctgccctttaggcctgtatgcctgatggtgcctgtaacaccatagggaatttcatatcgacaaatcttactttaccccacatacgccgttttcacggctatggcatttctgccatatcccgttatagacctgtacattcgggcttttgtcagcggtagtcagccgcattctggacataggtactttatagacctccggcctaacacccccggccacctctggctcggctttgctttatcccccaaaggggacagtcgcgggtgcagacagccgacttcagcgtgctgtgtcagtcgcgggaaatacgtcccgtttcttccaacgcagtatcaagggaagcgtttcagggcgttaccccgccattccacttctcggaatatcagttagaaaggctatagcctttccgtcacttttacctctttgcaggaaaatcccacgcagagtttatatgcgacaacgtgtcgctgcactgtctttttcgaacggtaatatatataatagcgacttcagagcaggaaaacatgattttgctaatgttactgccaaccaatttggtgcgtcaattgcttctgtattaaatatttatggatgtttgccggctatcgctagtaaaatcgaggtaaatactaaaagctataacttattcactgaaccggatgatgtatataacttgacgcaaggaaatgctcatgaagtgaagcaatcaaacgcaatagctgaatattatcaggaaatgttaggacagtacacgaatgataataatataacgattaagaatgcggatttatcaaagtatgatgttcagcaagtcattgataaaaacctgcagtatagattccctgtagtagtgtataaagatagtacagcaagtataatcacctcaaaaaatagtcagggaagttattgtataaatggaacgaattctgcaatatcaggaacatataatattatcgatacgtattcgtatttgttatcaatagcaaataaaacaaatatagtaaactatgttgcggaaggcgaatgtttatatgataatataaggtttacaaagccatatggttatgataagaatgatgttgaagtatatcaaaagttggattcaggttggggtaaaacaaatgttgttgaagaacaggaatggtatgtaataccaacgccggagcctgatttagaaatagtaagaggagtgagaacagagtttgacggagtagtgccaaatatatataatgcaaatgaaaaatataaggtaaagaagtatgaagatttgcaagaaaaaacagaaacatggtactacccctatttgtttaaggcaacaaatataggagcaataggaggagacgaccaaggaaaagtaaatgcaatagacccggttacaagagcggaattatttaaaatattactggaaagcgcagacgtagaattagaaaatgcaaatccaaatgcagagtattgggcgagaaactatatacggtatatgacgcaaaatattgatatatatgcagggaaagcaatcgacgacagttatttttacagtgaaatcccaagagatgagtcagcatatataataaagtcagtatttatgggagcagtggaagatacaaaagtaccaaacaagttatatacatatagtgaaaacatgtcatgcgaccaaatgagtaattggaacagcaataagggattgagtgataaatggaaaataaaccagtattatttagaggcagtaaggcagttatactgcaataaaataatggtgggagacggaaatagctttaatccagaagatacaatcacaagagccgagatgtgtaaatcaataatgagctgcttatttacgctgtatgaaggtttgaaaaatgtaagagttgtaaaggacggtgaaaagactgtatatattatgctttatgattctgacggagtaggaagtgtaaatgctgatacgaatataagtagatataaaaattctgatggtagcaattacgtatatacacaagagttttttgaaaagtattttgagttgataggaaacaaaaatgtagcgtttgtaatatcagttagagatgttgattttgacggttacatgcaaaacaatggtaaggtagaacaaaataatttaggaaacctatcaaaattttgggatagcagcagtttgtacggagaaacgagcaatcgtttgagtatagttgtaaataaatataagaatatattgcagaatatgcagagtgcattaaccgcagtaaatggaaacagagcagataaaatacaaatgcctgaaatatatttgggaactccgcatatgtggagatacgaaattgatgatgccacacagagaacagactttttaaatctatatcttgatacaacgcagaatatctataacagtatagcaaatgaatttggagaaaatattattacaggtttatattacgggcgtgaagatcctatatgcttagaatcaaacgtaaacacatatacaggttatgcgaatatggagcagatatcaagatatatacatggcaaggacaaaaaactgatatggataccttattgcgatgtagatactgaacattgggagaacatcggaactatagcgaatacaggaaaatgcactgataacagcgatatatttgatatagtaatgattcaacctggattgtatttttcggattataatgatgatatggcggcagatgagaaaatgttatatgaaaataaggttgaaaatatactaaaaagttcaataaacaacacagtcgtagatggagatagtgtaataggaggaataaagaatacaaacacaataatttcgtttgaaatggaatatgatatatctcttgtgacaggccgtgttcatggatttgacaacaatgcaaaagtatacccgaaacaaaaagcgcaaaactttatgagaacattgggaaaatattatagtttaatctatgatgatatgacgtcgtacggtatatattcaggtggtccaaatgagcaggcatatttgactcaaacattaaatggaactaataataatattcataattttattaaccatccttctgtttatggtgtttataacgatagtagtaaaacttggagtgatagtcatgacgaatttgcatatgatcaatttattagtacatttgctgataatagatataatataaaggattatggtaaattaatatatgatataactagagggttgttatataatgtatggggagaaaacggggatactagagttaagcagtacttaggaatgcaatgaaataattaaaattagaaacggaggagaaacaaatgttaaaaattcaaaaaatattagctgttattttgactataacagttttatatgctggtatgacaataacagtaaacgcagaaccaattgatttttcaataggtacatatcttcaaatgggaaagtataataatgagccaattttatggaggtatatggcagatgatgaaaatggcaagttaatagtgagcgataagataatatgctttaaagcgtttgacgcatctgttaaagatgcaaatgcagatggacatttagtatatggaacaaataaatggaaagaaagtaatatacgtacatggttgaattcatatgctgagggaggggatataatatggccgagaaacaatcctccaaccgctaaaaagatacatggaaataataatgctgttcaatatgaagaaggtaagtatccatatgcggatgaaaaaggatttttgcacattgataatttaacattatcagagcgtagagtgatgaaaacagtcagccaatggcaaaccttaaacggaagtgaacttgatttatctgaaaacggatgtaataggatatatatgcgaggatttatggtgggcagtgggcgtaatcctagagtgcttcatacggttgatgtttcggaactgggtgaagcatttcaaggcgcaatgtatagagagactgatactgtatttttactcaatgaatcacagatatataatatatggaaaaactttggaattgtaggagccaaaagaaccgatagctcaattccaaactcaactattaataatgggtattatgaatattggcttcgtagtgttgcaactatgcatgcaggaacgttaggaggaagcacagatgtaacatcaatatacggagaaaatacatatagtgggaaaatagttaacatgtatgaacttggagttcgtccggcattttatctgaatgaagataatatgataataaaatctggatcaggaacagagaacgacccatataaaatcgacggatatggtcaagaaggcatagctgtattttcacagggtaaacagttaaacttagaccagcagccgatagaggagaacgacagactactggttccggttcgggcaatatttgaatcacttggagcagaagtaagttatgacgatggagacggggttataacggcgaacgatggcgaaagaacagtagtaatgcagatagacaactatgaaatgggaaatggtacagaagtctttacgcttgatacagccccgaaaatagttggagaaagaacaatggtacctcttagggctgtatcagaagcatttgacgccaaagtaacttatgtagaaaatttgcagagggtagtagttgacaaacctgaaccgcaagtgttttcagaagcatggcgtaaaaccccatggtataaagaagcatggatggaataaagttataatcgtgtagagtaatggttccgtttagcttcttatctgaaaacttatgatataatgtgaattgggacgaagttactaacactgcaataataacaactgaataaatatttattccgccgctcaaataaactgagcggcggagtattttattataatcggtcaacagtgttctattatttaagaatatcattctttttttgtagaattgcctctgctgcagcacaagccggacaatcgcaatattttgcccctgatgatttaatttcccttgcatgttttgctatgctttttgcggcgtcagccccaaaataatttactccgttatctgattctgcaaaattaattaaactatcaataggcataatatcagattccaattcagcaaaataattctttgtctcagaagcttcgttttctgtgccaacggctttcagccaggattctgctgctgattttgccccattactgcatgttgaagaatttattagctcttgtgatttttcggagatatattccaacaattttttatccatatatatcatgtcctataagtttttcttacattctactataaccattttataatgtcaaccatgatatttttagtttgtcacccagcaaaaatattttatacaatgctattttttaaaacctaatttatgaagccatttttgaaatagctacgtatatattagaaatttgataccatgttgaaaaatctacaactcctgtttccggaagataaaaaattttttgaaatgtttttacactgttcgctgttgattcaccataacttccatctatcctcagtttagcaattaacgggtaattgttcgaaattttatttaattgagtttgaacggttcttactgcttctcccaagcttcctatttgcagaggttctcctggatatgatgatggaatcccctcaactttttcagctgattcaatatatatatctgaaccataataagtttttaatatacttaaagcatcatatccctgctccccgagtgcctgagaaccccattgtgacaaaccgccgcactgcgtatgtttgccgtcgcaatactgtgtaaacaatggctgttcaatattttctctggttatataattcgtgaataattcatctactgctacagagatttctttgaatatatttcttccgtaattaaatgcctgatcatatgctgtagagtttgtgacagtaaaatcatgtccctttcctctgtaccattctgtataaacacggtttaaagtaaatgataaaattgcaagtatatttgcttttattgtttcagtcttccaggtagaataaatttcacaacttgctacattttttatgtactctttaaatggaacctcaacgtcaccggcagatatgtcatcgggattaccaagatgaacaacaatatactcaggtataaccggttcaggcagtactacaaacccacttgcattatctattggcttcacttcattttcaggtatttttgccggataattcgtccaaagagaatgagagttaatcaacgtattgcgaacattgaagcctcccggaacggctggtcttaaaactgcattttgtatcgctgaactagtgggtaaaatttgtactccatcaatatgaagaacctctgtatctgctgctgaaacagttacattatataatgcatatggtctttcatctccaccgttaaccgaatattcaagcggcggtgcaggcaattcaacagcgggcgtctgacctgaactgtctgttttaacttcctctattacagaaccgtcaagaggatcagtaatacgaaccaaagcattatctgttggtattacaaatttctctgtagagaccgatacctgcagaattcctttatctatataatctgttctcataatatcacatcctttctcataataatatatgtacagctcgttggtacgtgagcaaaaatatattttaaggctgtgttcatatggaatatattataaaatataatggcaaccttgattctataagagataaaattgaaatattaagcgccggttatgcaattattgatatagaaccatctcaaatcaaatatctgagagaattaaaagaaattgaatattgggaaccaacaaaaaaactatttttatcaactaaactcggtctcaactcaacatgtatatctccggtccaaaatcaaacaagttaccatttgaccggttctagagttataattggaattatagattccggtattgatagcagccactccgaatttatgaacactgcaggaacaacaagaattttatctgtatgggacatgacaactgaaggagtcccacctaatggtttttataagggaacagaatatacattttctgatattaatgcagataagtttgtatgcaaagattttataggacacggaactgcagttgccggtattgctgcaggaatcagcggagcagctccggaagcatcaattatagcagtaaagcttggtagttcagaaactcgcacaaccgacataatgagaggtataaaatatataattgataaagcaattaattataatatgccctgcgtaatcaacttaagttatggtacgaataatggttctcatagaggtcaatctttatttgaaacttatattgatgacatatcaagattttggaaaacagtaattgtatgtgcttccggaaacgaaggatatagcggccaccattttaaaggaaatattaaagaaaataatccactaaatttgaactttaacgtttcctctaataaaaataatgtttacttatcactttggaaaaatttttccgatattgttaattttgaattagttaatcccagcgggatgtctacaggcataattacaccattggttcgagatattagtttaaacttacacaatgttaaaatatctttttcttttggtgaaccaaatcactatagtgcagctcaggaaatttacgttaatttagaagcatcatcagacctaatggacggtatttggactctaatatgttacggtgaaaaaatagtagacggtaattttgacgtttggctccctacaattgatgaagtgtctgaacgtacttcatttcttgaatctactccagacatgacgatgacattaccggccactgcggttactccaatttctgttggcggttatagacccgaaactgacactgtttgcaccttttcaggaagaggcggcacaatacatgaaattggactgcctcaattggatttgacagctcctgccgaaaacatctatacagcaaaatccggcggtggttttgatacatatacgggaaccagcatggctgccccatttgtttccggagcagcagctcttatgatggaatggggaattgtaaaagggaatgatccttttctttttggacagcgtgttaaagctttcctatgcaaaaatgcagtccgaaatacatatttaacctatcccaatcctctttggggatatggaaaactaagtctttgtgacaccatcgatgatttggaactatataaaaggagaatttaatatggaactttcaaatgagatcaaaaattttatacaatcgcccgacactcttgattttatagtcagaagttccgattatcttgatgaatttataaaaaaaaatcctaatataacaattacacagactctatccggaagatatattatcggttatatagataaaagtcactatgatgatttgctttcatatttaagcacatcatttataagttctgcacccgtaatattgggaacactggaccgtcctccgcttgattcagccggaattataccggttcataaccaaccgtatcttgacttaaaaggccgaggcgttttagttggtatcgtagacacaggtattgattatatgcaagaaagctttatttatgaagacggaacaagtaaaattcaatttatatatgatcaaacagctgaaggagatcctcctgatggtttctttttcggacatgaatacaataatgaacaaattaactccgcattatattctgaaaatcctcatgatatagttcctgaacatgataaatcaggtcacggaacctttttggcctcggtagctgcaggaagagaaatagatgatttttcaggagcagcgcctgaggctgatataattgccgttaaattaaaaaaagcccggccattttatcttgaaaagttttgcgttccagaccaacaggaatacgcttttgaatcaagtgcagtaatggtaggtattgaatatattataaaaaaggctcatgaattgaaaaggccggtagtaatttgtcttggtctaggtacaaactttggaagtcacgatggtttcagtatatttgaagaatatttaagcggtatatctaatttaaaaggagtttgtatttgtaatgcagccggaaatgaatgtcaggagcgccatcatacatcaggaaaactcaacacagttggtgaaactcagaatgttgatgtaagagtaggcagcaacgccggtaacatatgtatttcgctttggaatactgtatccgataggctttctgtatcaattcggtcaccatccggagaattagttggacgtgtaccggcaaaagcgggcacaagcacagaggtaaagcttgttcttgaaaataccagagtaactatagaatattatatgccgctggaaggcagcggcggtcagttaacagttgtgcgaatattagatgctactcccggaatatggaccattatcgttcatggtgacattattcttaatggtgtttatcactcatggcttccaatgtcaggatttgtgtctccagatgtagaattcctgtctgcttcaccatattacaccacaactattccagggacagcaattggcactatatgctgtggagcttataatagtttaagccaaagcctttatcaaaaatcctcttggggtccatcaagggcagaggtaactcttccggatttagtagctcccggcgttaatataggcgggtactttccgtatggatttggccaaatgagcggcacaagtgctgctgcagcaataaccagtggtgcatgcgcacttttaatgcaatggggaattgtaaatggaaacgatgtatcattaagcacctatcaaatacgggcttacttgatacgcggatgtgtaaaaagcattgcaatggattatcccaatgaacaatggggatacggaaccttaaatctaatgcagtctttccatctgatgcgtgaattataaaacttagaatttttttatataaaaattttttgataaaataattttgtcaatggaattaatggtttgaagataagtgcagataaattcataataatatttattagaaacatttattattttttaatcacaatttatatattgtaattgatatgtcgtagtaagatttacattcatgttaattatctgccatttgttggtttaatctgtgtacacttattaattatatattaaaaaataaatatctgttatatttttatgaccaatatattgtttatgtgaaatgtgctatatacttttaaaaacataataggcagaaattcatgacatatttttaattagtagtttaacaattaattttaatgtaaacaaataaatataaatcacggaggtataaatatgattattcatgtcgtcaaaccaggagaaacactaaccggtatcgctaatgaatacaatgtaaatttaaataattttttagctgataatggtttaaacaccaactcaagggctgttatcggtcaagcattggttatactgcaacccgaaacacaatatatagttcagcagggcgatactctgacaggtatagcaaacagatataatgtcagcattaaaactttattaagaaacaattatttcttaaaaggcagtacaaacatttcaccgggtcaaacaatagtaattaaatatcaagatgaaaacagaacaacatcatttataaccaacggatatgcttatccgttcataagtcgcgaacttcttagagaacagctgccttatatgacatactctactccatttacttatgggataagagaagacggcggattggttaatttagaaaacgatgagtggatgattgctatggcaaacagctttggaaccaaaaatttaatgcacctttcaacattaactgaagctggaaacttcagcaatgaaagagcaaatcttgtattcacaaatggaaatatacaaagtaaattaattaatgagactattggtaacatggaacgaaaaggatatgacggtcttgatatagattttgaatttatatacccggaagatagatatgattatgttatatttctccagaatatgtacaaagctataaatcctcttggataccctttattttcagcgcttgctccaaaagttagcgacacacagcaaggaactttatatgaaggtcatgattatggcgctattgcctcatctgtggataaagtgttacttatgacttatgagtggggatatacatatggaccgccaatggctgtggctccaataaataaagttaatgaagtggtggagtatgctctgacccgtatatcttcttcaaaaatacttttaggcgttccgacttatggttatgactggcccttgccatttgaacaaggagtaacaaaagcaacgtctttatcaccggtagaatgtattaggatagcggaagcaaataatgcagaaatacaatttgatactgttgcgcaatcaccgtggttcagatacacagataatgaagggcggcttcatgaagtttggtttgaagatccaagaagtattaccgccaaactccagcttgccgaacgttacaatttatcaggaattggctactggaatctcatgcgggagtttccacaaaatctagtaatcctaaatgcaaattataatataattactttataattataaaatacatcatacagataataagtataaatatttctattattgacaactgcgtatttatttatataaaaataaacaaatattttacttataatacatcgatattactgctgcagcatatgtatcataaacttaatataatatatatctttttggtgtatatatattcaacagaatttttgatataaaaaattgtgctctatattagattattaaaagggtgtgaaaacatacccttttatatttttgctatgacattttcaataaagaaaatgttactatagcctgataactgcaaatttttttgaccaacatatcaatacttcagagtattatttagaaataagaaattagaagattaattaataggtttatatataatgataatataattaatctttaaacttatacattataaagaaaaatattattgttagataaatatcctaaaacttattaatatatctttactatatactgagtaaggtttgatataaaaaatttaagaagattttgggattcgcatttcatgaatcacacttcgtttcaaaatatataaaattctgatacaatccatctgtagtatattgaagggaggtgttttttgtgataaataaaaacaatcaacagattataaaaactgtattgagcgaaatcttactatctaaaagaaaggaatataaacttactcaggaggctatggctcataagtgccatattacatgcagatcatatgtaaatttagaaaacgctgtaagtataccgtcaaccccaacttttataaacatattaattatttgtgatatagaccccggtgagtttataaaaaaattaaaaaacgctggagattatacctgaaccgataacaactatatttgcaccgacaggcgcggcatttaaagccgcgttttttttatttaattataaaatttattatgcaattattactcatactttataaaaagtatgagcaagtaaagttcatatgcagcaattaaacatatagcttggaataaaaattgatagaatttacacattttgtatattaggagtgaaatgatgaatatattaaaattatgctttggaaagacattatactttagaagaatggaactgaaattaaatcaagagaaaatggcagaaaaatgctgtctctccccgcgtcaatacatagatttagaaaatgggaaaagactaccgtcatttaagagtttaattaatataattataaatggcggaatagacttaaatttatttgtagaaaaaattattaaagctggatacatacctgaagattcagtggggaaatagaatatatgtttttaaacaagtagaaacaggcttcttaaaaaagttacaagaagcctgtttggcatatttaattatcaattttaatcttgtaatcaaaaatatatgctataatattataatagttataaatttctccttttaataatattctgtcattgttagtaatcaatatagttcattttggagtgcatataatttatctgatgtcagtttttattgaaatttatacatatgaatttttaaaacatataatatttaaaatttataaaaatataaattatctttccattttccaatactgcacgctgtatggaggaagctcgcttccgccgccgaagtcgtgtacttcgtcagtaattaaatcgacagccattccacattgagcgtcaaagtgtgcggtgaaagatgaatcatcaatatttattgcgacaagcacacgttcatcttcaaattttctctgaaaaattgcttgtttatttgttagcagaacagattcaaaacttccataacagagcgcttttgattccatatgtgcctttgataattttgaaattaactttgtaagttcattttcaataggagcttcaaagctttgacgcagtgcgttgtctccattttctttctttccttttgcttcccattcacttccgtagtaaatacatggaactccgggcatactaaataataacccatatataaggggtaaatgttctgaaacattaagcaaatcagcaattctagtaacatcatgattatcaacaaaatttaaaagatgtttatctttataaagcgaccaattttccggtccaaactgtctaattagcgaatggattatttcgaacatattctcagaattaaagctcgaatatagtcccttgtagcattcataatttgtacagctgtgaagtttgtcatctgaaacgaatagattgtaatccccatgcagtaattctccgattaaaacaaaatcttctttaatttgattacaatgatatcttaaagtttttaaaaaatcttgatccaaacaataagctacatcaagtctaagtccgtctatatcgaattcatttacccaaaaatctacgcattccagtatataatttacaacttcttggtttctcaaatttaatttaaccagctcataatgtccttcccagccttcataccaaaatccgtcattataattactgttaccgtcaaaatttatataaaaccaatctttatattgtgaatcccactttttctctataacgtctttaaaagcccaaaagccgcgtcctacgtggttaaaaacaccgtctaaaaccacttttatgccgttttcatgcaaattctgagctaccatcttaaagtctttgttattgccgagtctgcagtcaatatttttataatctcttgtgtcataaccatgattatcagaatcaaaaataggcgaaaaataaaccgcattacatccaaccttttttatgtgcggtatccaatccacaactttttttattctatttttatatattccatcgttttctgttggagcgtcacaaaatcccaaaggatagatttgataaaatacactttcgtcataccacataactattcctcactttcatcaaaataatatacaaatttaatcttttgtttattatactatactaaaccatcattgtcacgttaaatttaccttatttataaataaatttataattgtaacaaaaattagagtatagcgtaacatacaataggtgattcttatgtttatttggcaaaaaaagttaaagtataggctcggattatcaggaaaaaggtgtaaacgtcacagaacatactataatagaaaatcatcttcaaaaattaaattttatattatcctaattttagtcatagtttcatgtgtatttttatttaattcaattgaaaaccatattgatccagtaattaaagatttgtcattatcagtattaaacagtgaagttacaaaagaatgtaattcagctgtcagcgaattaataaatgaatcaaatattaactatgattcaataataaatatgacaaaagacagcagcggaaatgtaaaaagtcttgaaaccaattacagggagataaaccttttaaaatctgaacttgctgtaaatgttcagaatagaattgataaaataaacagcgtcgatatatcaattccaatactttctatgttttcgagtaagttctattccgggtacggaatacctgtatcgttgcgtgttttaacaaatgagaatgtaaaggttgagttttgtaatgaatttatttccgctggaattaatcaaacaaaacatttaataaaagtaaaagttacaacagcactgggtgttgttttgcctgtaagaggagaccttgaagacatagttacagaagtacccattgcagaatcagtcatagttggcgatgttccagatacatatcttgactttaattaattaaatctctttaattttgcgcttaatattttatatttaaactaattttgcttgatttttttatcgctttggtatataatgccttaagtaaatatatatgttatttttaatagcaatataaaatctggaggtttatatatggatgtaaacacttttggtgaatatgtcacaatcgttgcagaggaagacggagtaactattattggtttaaccagaggaaaagatacacggtttcaccatactgaaaaattagataaaggtgaggtttatattgctcagtttacagagaatacttctgcaataaaaattagaggtaaatcaaaattatatacaaaaatgggagtaataaacataggtgaggagaaataatcaatgagaagaaaaactaaaataatatgtacacttggtccagccacagatgagccagaagttttaaagcagcttatgctgaatgggatgaattgcgccaggataaatttttctcatggtactcatgaggaacatttggttcgtataaatgcagtgaagaaaatgcgtgatgaactcggccttccaatagcccttttacttgacactaaaggccctgaagtgagaaccggagattttgaaaatggaaaagttgaactcgttgaaggacagagctttactcttactcctaaaaatatagttggcgataacactcgttcatcaatcacatataaggatttggcaaaagatgtatatgcaggcgccaaaattttgattgacgatggattaattgaaatgaaggttaccggcatcaaaggttctgacgtaatatgtgaggttttaaacggcggtcctgtcagcaatcataaaagtataaatgttccgggaattgagcttggaatggaatatatgagcaaaaaagatgttgaagatattaaatttggaattgaacaggattttgattttatagcagcatcatttgtccgttcagcttttgatgttcttgacataaaaaggatattggaacaaaacggcggagaaaatattcaaatcatttcaaagatagaaaacaggcagggtgttgacaacattgaatcaatattaaaagtcagcgaaggaataatggtagcaagaggagatatgggagttgaaatatcctttgacgaactccctgccattcagaaaaagctgataaaacaatgttatacagagggtaaaaaggttataaccgcgacacagatgcttgaaagtataacacataatccgagaccaacccgtgctgaaatttctgatgtggcaaacgcggtttatgacggaacttccgccgttatgctttcgggcgaaacggctgtcggtgaatatccggttttggcccttcaaactatggcaagaatctgtattaaaacagaagagaatatagattatgttaagaggtttgaaaatttgcatttaaatcaaacaaccagtgtttcaaatgcgataagccactcgtcatgtacgactgcacatgatattggcgcagctgcaatcataactgtcactcagtccggatatactccgcgtcagatttctgcttatcgtcctaaatgccctattattgcaggtgctttaaataaaaaaatatggcgtcagctgaatttatcatggggcgtcactcctattatgacagaagttaagagcacaagcgatgagctttttgaacatgctgtgaattgtgcagtaagagaaactaaactggttaaaaaaggtgatgtagttgttctcaccggaggttcgccgttaggtataagcggaactaccaacattttaaaagttctgttggttggggatatactagcgtcaggacaaagtctttcaaataaatcaataagcggaaaagtttgtgttgcttccaataacaatgaggctttaaaatattttgaagacggcgatatattggtaatacctgagacatctaattctataatttctatattaaaaaaagcctcagcgattataacagaagtttccggaagcacgtcacatgctgccattgttggaatgactttggatattcctgtcttggtaggtgttaaaaatgcgacaaagatactaaaaaatggtaccacggttactatagacggaataagaggacaagtttactccggtatagcaaagatagtataaggagagataaaattgtttaaaacaaaaattacggttcgatactgtgaagttgacagtatgggagtagtgcatcactctagatattttccttggtttgaagtcggccgcactgaattctttaaaacttcaggtatgtcatacagagaagttgaagaaaacggcgttttgcttcctttgcttgactgctattgtaagtttattaagggtgctaagtatcaggatgatgtttggattgaggttaatttaaaaaaattgggcgttgcaaaatgcgtttttgaatataacgttattagagatgacggtgaattattagccacaggatataccactcatggtttcactgacagacaatttaaaccactaaatcttttgaagaaataccctgaaatttatgcttgtataaaaaatctgcaaagttttaataatgaagcgtagtatattattctattagatttatataataaggatgagtaattctcatccttatttttattgacattataaaataaatatgctatgattattatgagttaggaattgctaactttttacaaatgttccaattattgaaaggagctgttgttatgaggtctgagctaaaaattgacgggatgacctgtgctgcatgcagcggaagaatagaacgtgttttagcaaaaacgaacggtattgaagaaatcaatgttaatttaacaactgaaacggcaactgtaagttttgaccaaactcttataacaaatgatgaaataatagataaaattaaaaaaatgggtttcggagctgaggtttacgacgaatcaaaagaaaattccaatcaaagagagtttagaaatctaaaaatatatcttatattttctataatattaaccgcccctctgattttgggaatgattgcctcgtggcttggaattcatataatgtttcttcacgatccgatttttcaattaattttagctacaccagtgcagtttataataggttatagattttataaaccagcgttttatgctataaaatcaaaaagccctaatatggacgttcttgtttctattggaacgctgtctgcatattttttcagtttatataatgtgatagcaggtaatatagtacatggacagatggatggtctttattttgaatcgtccatgactattattactttaatattgctgggaaaatatttggaattaagagcaagagttaaaacaagcgaagctatacagtcgctgataaaactacagccgcaaaatgcaaatcttcttcgtgacggagttataactacagtaccgctctctatgttgaatgccggagatgtagttgttatcaatccgggcgaaaaaataccaattgatggtgttataaaaagcggacggtcaacagtagatgaatctatgcttacgggcgaaagtcttcctgttgacaaaaaaattggagacaatgtattttgtgctacaattaataaaatgggcgttatacaagtagaagctgaaaaaattggtaaggaaacaacgttatcaaatataatcacatatgttagaaatgcccagggcaagaaagctccaatacaaaagatagcggataaggtttcagctgtttttgttccggctattatgataatagctctgataactctttttgcttggtattttattactaaaaactttgaaacttctttgataaacgcagtatcagttttggttattgcatgtccatgttctcttgggcttgcaaccccaacagcaattatggttggtacagggctctgtgctaatcacggaatacttgtaaaaagcggtgaaatattagaaatatcctcaaaaataaacacagttgtatttgacaagactggtactataactaaaggaacgcctgatgtcaccgacttaatattagctaatcaggaagataaagaaacatttttgaaaataatcggcggattggagtttggaagtgagcatccgcttggtaaggctatttatacacattgtgttaaaaatgttaatggtttgctggagctcgaggaaactgaagcaaaagtaggaatgggtatagagggaaaaaataaggaaggaaatgtatatagaatcggaaataggaaactaatgaattcagctaatattgagataagcaatatagatttaaaaaaagcgtctgaatttgaaatgcagggtaagactgtaatgtttgtatccgaaaacacgaattttattggagccgtagccctttctgacacagttaaggaaacatctgttcaagcagttaacagattgagcagaatggatattgatgtttgtatgctgacaggtgataatgatgcgactgctgcagcaattgctaagtcggtaggtataaaaaaagtgtttgctaacgtattgcctcatgaaaaatcagaaaaaatattgtcttttaagtcaaaagacaatgttgtggccatggttggcgatggaattaatgatgcgcctgcattagtcagtgctgatataggtatagcaatgggcgatgggacagacgttgctattgaagctgcagatataactttattgagaggagacccaaatgcagtttgtgacggaatttatctttctaaaatgactatgaaaaagataagacaaaatctattttgggcctttatatataatggaataggaattccgttcgcagcctttggatttctcaacccggcaattgcaggtgcagctatggctctcagcagtgtttcggttgtgactaattcattacttttgaaaagaataaagataaaataaaaatatagaggtgttaatatgaaaacttcagagattaaaattaaaggcatgagctgcaaccattgcgttgcttctatacaaaaagccctttcagctttagaaggcgtaaaaagtgttgatgtcagtcttgaaaacgaaatggcgacagttgaatatgatgaggccaaaacagaagaaagcatttttaaaaatgtaatagacgatattggatttgaagcagtttaatgtttctgtataattaaccggacgtactttataattaagtgcgtccggtttttatttatataatatataacaaattaagacaaaatgtaggtttgtcaatgatgtgttacaaaaaagattaaaagagttcaccgaaattgataaaagagttgatgtagtcaatgggagctttccatttttcgaacggtaatatatataatagcgacttcagagcaggaaaacatgattttgctaatgttactgccaaccaatttggtgcgtcaattgcttctgtattaaatatttatggatgtttgccggctatcgctagtaaaatcgaggtaaatactaaaagctataacttattcactgaaccggatgatgtatataacttgacgcaaggaaatgctcatgaagtgaagcaatcaaacgcaatagctgaatattatcaggaaatgttaggacagtacacgaatgataataatataacgattaagaatgcggatttatcaaagtatgatgttcagcaagtcattgataaaaacctgcagtatagattccctgtagtagtgtataaagatagtacagcaagtataatcacctcaaaaaatagtcagggaagttattgtataaatggaacgaattctgcaatatcaggaacatataatattatcgatacgtattcgtatttgttatcaatagcaaataaaacaaatatagtaaactatgttgcggaaggcgaatgtttatatgataatataaggtttacaaagccatatggttatgataagaatgatgttgaagtatatcaaaagttggattcaggttggggtaaaacaaatgttgttgaagaacaggaatggtatgtaataccaacgccggagcctgatttagaaatagtaagaggagtgagaacagagtttgacggagtagtgccaaatatatataatgcaaatgaaaaatataaggtaaagaagtatggagatttgcaaggacaaacagaaacatggtactatccgtatttgtttaaggcaacaaatataggggcaataggaggagacgaccaaggaaacgtaaatgcaccgaatccggttacaagagcggaattatttaaaatattgctggaaagcgcagacgtggaattagaaaatgcaaatccaaatgctgaatattgggcgagaaactatatacggtatatgacgcaaaatatagatatatatgcagggaaagcaatcgatgacagttatttttacagtgaaatcccaagagatgagtcagcatatataataaagtcagtatttatgggagcagttgaagagacaaaagtaccaaacaagttatatacatatagtgaaaacatgtcatgcgaccaaatgagtaattggaacagcaataagggattgagtgataagtggaaaataaaccagtattatttagaggcggtaaggcagttatactgcaataaaataatggtgggagacggaaatagctttaatccaaaagatacaatcacaagagcagagatgtgtaaatcaataatgagctgcttatttacgctggatgaaggattgaaaaatgtaaaagttgtaaatgacggtgaaaagactgtatatattatgctttatgattctgagatagcaaaatacagcactgaaacgaaaggttttagtcgttatatgaataatttgggcgatgaataccaatatactgctgaatttttcaaaaattatttagaaatgatagggaacaaaaaggttgcgtttgttatatcaatacgtgatgttgattttgatgaaagcactattggatatgcaaatactgccggagatgaggatggagcagaaattataccttcatatgaaattacggatactagaatgaataatattataaataaaactacagaaaagtctataaacataataaataatataagtttaggattatctgcggcaaatgaacatagaacggataaaatacaaatgccggaaatatatttaggtactcctcatacaagtgcaaatgaagattgggttcaagtgtgggaacaagttaacgtaaatgcaaggcaaatttatttagataaatatagttgggtctctaagtctatttataataacgttttaaattcaataggggatggcattataacaggaatatactttggacgtgaaaatccagatgccatgtataaggatgacggaataactccaactatatcgtatcaaaatgcctcaaatataagtgattttatacacagtaaaaataaaaaactactatggataccattttcgactaccactaatgagtggtataatataggtatgtatgtcaatcatggaaagagctgtaataatggcagcagtgatttatttgatgtagttatgatgcaacctggcatttattattccaattatagcggaacatttgaaaatataaaaagttatgatgcatctatacatgacggagaatttggttatgataatcaaaaacgaaagataaaagacttgtatacaagttctgaaaaaaatcaagtatatatgtataacgaacctgtaggtgaagaaaacaaaataaccaatacaaatgtttcttttgaaatagagtatgatatttctttagttaccggacgtgtgcacggaagcaaagtaattcctaaagataaagctaaaagctttacaataacctataagtattataaagatttgataaatgattctaatacatcgtatgctatatatgcaggcggaccaaatgaacaaaattatagcagtttagtaccaggtagaaataataatttacattattttgtaaactttccaacatattttggaagtgaaaaagatggaaatccaaatgacatcggagatagaaaagaattttcatggtttcatgatgaaataataaaggaaatttcagatgcttattacgatgtagattatagcaatctaatatatgatataacaaaaggattattatatggcgaaaattactttagtgatagttgcaaaaaatatttgggttggaaataaaacaatgaaaggatgtaaacatgatgaagaataaattatttagaaaaacatttatctttataacaatattcgctatatgcttttcttgttatattgtgaaagcttctgacaatattataattgaatcgggtatatattttcaacttggaaaatataacaataaaccgattttatggcgctcagtagtatctgatgaccaaaacggaatattaatggttagcgacaaaattttatgttataaaatttttgatgtgtctattaatgacggaggaggtataaccaataaaggtttttgggagaataccgcaatgagggtgtggctaaattcaacagctgattccggtaaaatagaatggattggagaacatatcccctcatccgataggattaaaaaaaattatatcagtccatacaatgatgaaaaaggctttttgaacaaagataatttttctgaaagtgaaaaaagtataatgaatactgtaagtcactggcaatcgttatcaactaaaaatgctattgtttcagaaaatggattaaaaaagccgttttttccaaagattgttgagggagaaaattctcaatttgagcgtactgtatatagatataaaattgcggatatggatagggcatattatggagcaatgtatagagttaatgatacgataatgactcttgatgaaaaacaattgtttaatgttctaaaacaacttggaacaatttctagcgaaaatgctgacggcattactaattcagaaggtgatggaatatattggcttagaactcaatatacaggtaataaaactgtaacttatggtagtggatcaattacaacagctacaaaggatggaaattatggtctctcgtgggtagatgaaattgagttaggagtaagaccagcattttatttaaacgagaataatatgataattaaatccggaagcggaacggaagaagacccatatatattggacggaaaaggacaagaaaatacagcagttttctgtaatggaaagcaagtggaatttgaccagcagccaatagaggaagatgatagattgctggttccggtaagagcaatatttgaacaactgggtgcggaagtaacgtatgacgatggagatggagttataacagccaataacggtgaaagaacagtagtaatgcaaataaacaatcctgaaatgggtaatggaacggaagtgttcacactggatgtagcgccaaagctagtaggggatagaacagtagtacccctaagggcagtatcggaagcgtttgactgtaaagttgactggatagaagaattagacagagtagtaatagacccgccacagccagaagacactgacgaaggacactggcaaagcacatgggatataattattaacggaaaaggaaaaaaacaataagttgtgctaacagaaaggattaaacaaaatatgatttcctctgctgtaagttaaaattatggcagaggaaaaatatataatttggaattttgatatgttaattccacaataaatagaaagagtgggatagagatgaaaaaaattacttttttattaattgctataatcttatcattacaaaatatatctggttttgcttataataatataacagctactgtggaaaattctcagaatatagattcttttaatatgactattaataatggtgaaataggagttactactataaatcaacaaagctatgttgtatcaaaatgtagaagttttgcgtttgaaccaactatatatgatgaaataatagaaagccattttcccaaagaattgtatattgatattggagattatttttatacgcgtgagttaagttatgattatccatatattccggcaacatggaaatataatgttaatcctaaaataaaactttataataagaattttgaattagaaaaaattgcgaatttaggtgagacagcttttccgcgaaatatttggtatgaaaatgatatgtattattgttcatattatcaattttataagaaaagttcagatacatatgttcctgctaacgctagcgatatatactatggacagatagatactaaatatttaataacagttgcttctaaagatttcgaaaattggaatattatagatagtgaaaatataggtttatattctacaaaaccttacaataatagagtaattgaaaatgataaggtaaaactaaaaggaaatcaagtctcttttaaaaataataatatttttcagaatatattatatgaaaataatttatataataatataattactaaggttggaaatttgtttttaagtgtaaatagcgaaaatgatttattattatccattgataatatatactttatcaacatagttttaccggaagacgcatctaattttttaaagaatttaaataatggtttagctaatattttatatatttatgaatacaacgataatattaaaattcaacttggtacgtatgatgatttaaaatcaaaactggtaataacacaggaagatttaatacaaaatttaaatttaatttctaaatcaccttatataaaattaaataataacattttaggtttttcagagccgccagtaatagaaaatgatcgtacattagtaccgatgcggtttctgtttgagcagatgggagccgatgtaaactggaacgaagaaactcagacagcgacggcaacagttccaatagatactaatagacaaatgcgtacatttagcaacgaaaaagaaaaaagtgtaacattttctatagatgatacaacggcaacagtgaatggtgaaactgcaacaatggatgtaccggcaagacttgtaaatgacaaaacaatggttccgcttagattcttatctgaaaatttaggatataatgtagagtgggacgagactactaatactgcaataataacaactgaatagatatttattccgccgctcaaataaactgagcggcggagtaacatttaatttatataattaatataaattaaatgttacggtaaaataggaggatatagaaatgttaaaaaaaataaatttaagtacttatattattgtattattattattaattttaccaattaacgtgttagctaaaaacgaaataaatgctatctttgaaagtaaaagtacaggtacttatgaaaatatagaattgaaaactatttttgataataattatattgcaaatatagataaaaaaacgtacgtgattagtaaatgtaatagtccttattatataccaattgaatataatgaggaaatcgaaaatcatttttataatgaggaatatgtatttgcagatgattattatttcacacgtgaatgtgaaaatgatgcgagtataaattttatgtcacaaattaatttgcagaataatattaaactatatgataataattataatttaatcgttagcaaatcgtttgatggatatgtatataaaatatgttattatgataagaaattttattgcgaatacagacaagttttagaaaaccaaaccaattcatggggaggaaaaaaagttattatacatactatgatgtcagaagattttattgattggaaggatataggagaaaatcgtataccgaatacaaattcaaaagtatcatatataaataattctgtaaaaataaaaggaagtaataattttgtaaatgttatatatgaagatggatttgataaggttttagatacaatgtacggtgatatatttgttgcttcaaatataaaaaaggttgttacagatataggaacagaagcgacaagttatggcaataatttattgagttatgataacatatattttatagaaataaatacacctttagataatatgaaacaatattttataaatttttatgtttatgaaaatgatgattatattatttttgaaaaatataatagagatgagagattaaaaatattgaaacaggaagttgaaaataaattaaatttgataaaagatgcaccatatataaaattaaataatagcatcttaggcttttcacagccgccggtaatggaaaatgaccgtacattagtgccaatgcgttttctatttgaacagatgggagccaatgtaaactggaacgaagaaacccagacagcaacagcaacagttcctattaatactaatactcaaatgcgtacatttagcagcgaaaaagagaaaagtgtaacattttctatagatgatacaacggcaacagtgaatggtgaaactgcaacaatggatgtaccggcaagacttgtaaatgacaaaacaattggaaagctccaattgactacatcaactcttttatcaatttcggtgaactcttttaatcttttttgtaacacatcattgacaaacctacagatttaaaattttgctgcaattatttaaattgaaaaagtacaataaatctggtggaatattaatgtcaattaaaataaataaaatttttatataatttatcatagaataattatatatttaatatctaatatacggtgtatatggtgaactgcggcaggtgtgactgtgaccgcacctgaaaggcgcgtgtgcgccacaatatctctttaccattaaacctaaaatgtcaataaatcacttagttgtgatattccccacctaaggggtgggtgtgatacaaagtgacttgttttggttagacgacaatgtcaataaattacttagttgtgatgtattgcgcatttatgcgccgcgttaggtgagctgtcatctcacgcgaagcgtgaattacttatggcagagtatcataatcctttttattactaattttccatgactgcgcgccttacgaggcaaactacgtttgccctaccgaagcttgcgaaaccacatttttatatgatttattatagaataattatatatttattatctaatacggtgtttatagtgaatatcgggaggtgtgacaccaccattctggtggggtcacagtcacagccctccgaagcttgcaaaaccatatttatgtaatatttttatatacagtttttctgtttaggtttcttttaacttttcaaatgtctaatgaaatacgatagacataagcacataattccaacatatatttaatattgaataaatttaatcagagctggtggggtttaaatgaaatggtttaaagcggttgtcgtcttgattctgtgctatgtgacattttgtttggttatgtttcccgatgcttgtataacagcggtgagcggagcgctgaagttatgcgtcactgctgttatacccacgctgtttccgttctttgtatgcagttcactgcttatagcatttggattaggcgaatttggaagcaggtttttgagcggagtgatgagaccgctttttaaggtcagcggagcgggagctgtggcggtaattttaggtgtggtgagcggctatcctgtgggtgctagctgtgctgttgaactttataagactggaaagataacaaaacctgaggctgaaaggctgttgagtttctgcaataactccggtccgctttttattataggaacggttgggtttgctatgaattccagcgtcgctttgggcggagtgctttatataatacatatcacggcggcaatatcggcaggaattatatatgcgaaaatttcatcaaaaaagaatattgaaaataatctgataaatccgctgatagttgatatgtcgccggataaaaaacctaaaaaactgatagagtttttcggtgatgcagtgtcaaaaagcgttataactattttgaacgtttgcggttttgtggtcttttttgctgtggtggaaaagactattcctgagtttataggcagtccttttatcaattcattgctggagataaccggcggtataaatggcatgtcttctatgggaatagaaccggttttgaagttttcattaatttctatgttcctggctatgtcgggcttatcagtgtttttgcaggtgtcgtctattatatcttctgcggatatatctccaaagtcatatgcagttggcaagctgatacatggcggagtagcgtttattttaacatatgttgtgatgctggtgttaaagctgaccgggtggctccagcagataattggttccggcagtgctgcgtcagcttttgccatgagtgagggctggatagtaccggcggcgtttaacagcacttgtccgcttgactctgttttgcagtatgcttgtcttatggcaggttccgcactctggtgcctgctttctatggcggtactggcgttggcttctgcctttttctgcaaggattgacataatattttatatatggtatcatgcttaccaaaagagattattatggaattttgaggtaagctaaatggcggataaaaatgaacgatccgtatatatcggcgctgtcagcggatgtaatgtgatttccgcagaaaaggcggtggttcctgccaactattcagccgtcaactccactaccggtcatgggctgatggcggaggaagctttgactgtgatagacaaattcagcggcagaagcgctgaggtggtaggacgtacgaatataaagaacggacctgacagaatggttgatggaactgctctgcaaaccaagttttataattccggcaagggatgcgttcaggcgtgtttcgacaaagaaaacggcggtctgtaccgatatttgaatagtgacggcagtccgatgccggttgaggtgcctaaagatatgtatgacgacgctgtggaggcgtttagagcaaagatttctcagggtaaagttcccggggtgacagatgttaatgaagcagggaattacgtgaggaaaagtgatttgacttatgctgacgctatgaatctgtgcaagccttttactgctcagtctctgctttatgactgcgcaactgggataatatattgctcgtttgcgtttggaataagcgctttggctgttttcattcttgagtatagcagaaacggcagaaatgagaaaaaggctttgttttccgctgtcagaacaggagctaaggtctttgggctttcatatgttactcatattctttgttcgcagtttgctagaactgaactttttaaatctgtttgggatattaccggatacataaacagtgggggctttttcggcggagcggttcagtctgtaaacaatgctgtgcgtttcagcgtcggcgacagtgtttcttctgtaagcgcttcgctgacgcagttttctaaaatgttcagagccgggatttttatgaatctgtttaccatgcttatatttttggttcctgatactgtcagagtatttgtcagggatatttcggggtttgattatttaaacagggtgtttatgatagttatatcaagaattttttcaacagtgttttatataacagccgctttgatgcttggaagtttcagcagtctgccatatatggtctcaatgactgtgtgcctggcggcttcatgtatcggaggaatagccggacgtgctgttgtttcaagactgacagaaagatttatgatacttcgggcttaaactaaagaaagaggagtgaaatttttatggcttcaaaatgtgatgaatgcgttaactatgagtatgatgaggattatgagtcatatgtttgtttagcaaatttggatgaggacgatatggcgaaatttatcagcggaaattataatgaatgtccgttttaccgtcccggtgacgaatacacaattgtcagaaagcagaattgatttagggattaatatctatgtaagtgaatattctttaagttgaatattttaaaatgaatttattattacttaacagagtttataatattatgcttgaatatgttatgggattatcttagatttgttatgacacggaagttatgtagtgtcaaaagaaaactaggcagaaaatataagagcgttgtttggtaaacatcggttgggagtgcgtatgaagtatgacgcgtgaggtgtgcagtcgctgaaaagtttattatttaataggatcatgacaaattgtttgtatatatgttcacgctccgcgtgagatggcggctcacctaacgaggtgtgcgcaagcacaccctaccgatgttcactaaaaacactgttttttggaatattgattttaaaaaatttttataaataaagtggttttgcaagcttcggagggctgtggctacacttttatttaaaagtgtatgttatataaaccgtataatgtgatacaaactataaatgccaataattaacttagttgtcatataataatcaaacttagatgtgatgtgcaaacgttgtttgcctcgtaaggcgcgcagtcatggaaaagtttatataaaaaggattatgttatactgttgtatatatgttcacgctccacgtgagatgacagctcacctaacgtggtgtgcttgcgcacaccctaccgacgttcactaaaaacacggtttttggaatattgattttataatttttataaataaagtggttttgcaagcttcggagggcaaacgttgtttgcctcattaggcgcgcagtcatggaaaagtttatataaaaaggattatgttatactgttgcatatatgttcacgctccgcgtgagatgatagctcacctaacgcggcgcataaatgcgccctaccgatgttcactataaacactcttgattttttgtctggtttgttatatcttattcagtattttttcttggattttattgcggatgtttataaggtaaggcttgaaaaggtatgtgttatttgttttataatattgatgaggtactgagaattaaagtatataggacaaaaacgttctgaactgtttaacactaatttatataaacgaaaaatgtttgcggcggcgtgtaaaactattcacgccgccgcgttttttattttatatttaggcttgtaaattacgtttaaaagaaatataatagaatcatataatttaaggattgattcatggtgatagagtaatagataagacgtcttgttctattgcagtgaaatgtttttttatatgacagcatattgcgtgaaagatatgtgatatattttaattaaggttgatgccggtaaagcatcaatgcgtacagtagtctgtgatactattgtgaaaaacaataaaatattttgaaaaacaatagatatataaaacgtcttattttctctgacgtaatattttatttatgtgtgctgtgtgtagaaacgtaaataatattttatatatgctggttttaaaataaagcattacataataggcgctttttattgcgaaacaaaacgaaaaccagcagatgatggtttggtaaatgaaatccggagaatattccggcagagatcgtatataacagaaagtgcggtaaaggggattttaatatatgaaacggatatttttagttgaggatgataaggctattgctaaaaatcttatgcttctgctccgctcagagggctacacggttactcatgccccaacacaaagcgaggctattgatttggtcagcgtgaataggtttgatttggcgctggtcgatatttcactgcctgacggaaatgggtttacggtttgcacggaaattaaagaaactcaggatattcctgttatctttctgacggcttcgggggatgaggccagcgttgttacagggcttaatatgggagcggacgactatatcaccaaacctttcagaccccgtgagcttatagccagaatcaaaaccgcgctgcgaaaaagcagccgttctgcgtctgcgtttgaaatctgcggacttaatgttgatactgcaagcggcgttgttaaaaaagacggcagcgagatttttctttcagctttggaataccgtttactgttggtgtttataaataatcccaaaagtattatcacaaggggcagattgcttgacgaactctgggacgcggcaggtgagtttgtcaatgacaacacgctgactgtttatattaaacgcctgcgtgagaagatagaaaacgaccctgcaaatccgcagattattcttactgtacgtggaaccggctacagattgggggacggatatgtttcgcaatagggagtttaagaggttttcagttctctttctgattatagctgcggtttccgtaacgtttagttttgtatttaatacggcggcaggaattatttctatcatttctgcagccgcttttggcacggcattttttatctttaccaaatcgagatatgagagtattgcgcagatttcagaccaaatcgaccttgtgcttcacaatgccgaccaaatctatatcagcgaatctgaggagggagaactttcaatactgcagagtgagataacaaagatgactatgcgcattcgtgaacagaacagcgctttgagaaaggaaaaggaacatttggcggattcattggcagatatagcccaccagctccgcacccctctcacgtctgctaacttaattctgtcattgctggagaatgctcccgatgaaaatgagcgaaaaaatttgatgagagaaacagaagaattatttgtgcagatggactggcttttgacaactctgctgaaattatcacgccttgacgcaggaattgtggtttttcaaagcatacaggtaaacgtgagcagtctgataaaatctgcggtccatccgtttctgatttctatggagcttcacaatattgatttaaagtcagacgtaccggacggcataaaaattataggggatttaagctggctttctgaggcggtacaaaatatacttaaaaactgtattgaaagtgtgggcaataatgggaagatagaaattagctgcactgacaatccgttatttactgagatttccattcatgacagcggagcaggttttaaaaaagaagatttgccgcatttgtttgacaggttttatcggggaaacagtgaaaacgcctccggttatggtataggactggctctgtgcaaaatgattatagtgcggcagggcggaacagtcagtgcaaaaaatcatcctcagggcggggcggtgtttactattcgtttcccaaagtgacaaatctctcacctaaaagtcacagagatgtaagctgaaggttctattatatgggtagactaagaaaaaggaggctcacataatggagttcttaaaagttgaagatttatgcaaagtttatggcaagggtgaaaataaggtcaccgcgctcgaccatgtttcacttacaatcgaaaagggtgagttcactgcgattattggttcttcaggctccggaaagtccaccttgcttcatattatcggcggcgtggacgtgccgaccagcggaaaggtatatctgaacggacaggatgtatatgccggaagcaatgaaaagctcgccattttccgcagacggcaggtagggctgatttatcagtttcataatctgattccaactttgaacgtggtggagaatatcacactgcctatacttatggacaagcggaaggttaacgaggagcgtttgaatgatttgctcggcctgcttggtcttcaggagcgcagaacgcatttgcctaatcagctttcaggcggtcagcagcagcgtgtttctatcggcagggctttaatgaacgcgccggcggttatgcttgccgacgagccgacaggaagcttggacagccataacggccatgagattatcaaactgctgaagctgagccaaaaaagatacaagcagactcttataatcgtaactcatgatgaaaatatcgccctgcaggcggaccgcattatcggcatatcagacggccgggtagtgagagacgagagggtggtgcggtcatgaatattttcaacaaggtcactctgcaaagcatgaaaaaaagccgtacccgtaccatagtaacaattatcggtgtcatactgtcagccgcaatgataacggcagttgccacctttgccgtttcactccaaaattatatggtcaacggggcaattcagaaatacggaagctggcatgtcggttttttggatgttccgccttcgttcgctgaggagcggacaagtgatgataaggttttaaattctgtatcaattgaaaatataggtttcgccaaactcgacggcggaaaaaatccaaacaaaccatatctttttgtagcaggatttaatgaaagctcttttgataatttgcctataaaactgctttcaggcagacttcctgaaaccagcggcgagattcttattccgcagcatcttgacgaaaacggcggtgtgaagttctcggtaggagatactgttacgcttaatgttggaagccgtgtgccgaataacggggaacttggtaaaaatgccgaaacagacggcaaagttaagctttcggtcaaggcggagcattcgcttgccgataaaagattcatagaccgggaggagagactcggtcagcatgacccttatattccggaagaagagacgggaaaagcaggggaaacatttgtgccggaaactgagagaagttacactgttgtgggaatctgctcaaggcctgcatttgaggaatattccgcgccgggatacaccttaataacagcgtcggactccgaagcaacggcagacagtctcagtgtgtttgtgactcttaaaaatccgtggcaggttcatagttacgcaagaggcacggccgggaatgtggcttatatttttaacgatgatgtactgcgttttatgggcctttcggatgataatttgtttaacgcgctcttgtactcaatcggaattattttgataatcctaatcatgctgggctcggttttcctgatttataactcattcacaatttcactgaatgaccgcacgcgccagttcggaatacttatgtctgtgggagccacagaaaaacagctgaggaagtcggtgctgtttgaggggctttgcattggagctgtgggaataccgattggtattattatcggaatacccagtataaagctggtgctttctattgcggcaaaatattttggcaatgttttgtacagcggagtgcctttgaatttgtcaatctcggttccggcgcttatagccgcggcggtgataagtttggtcactatcctgatttcagcatatattcctgcgcggaaagcggcaggtattcctgttatggagtgtatccgccaaacaaatgatgtcaaggttgaacctaaagctgtaaaaacgtcaaaaatctcagagcgtttatttggtttggaaggcgttttggcattaaagaattttaagagaaacaagaagcgttataaaagtattgtgttgtcgctcactttgagcgtggtgctgtttgtggcggcaagctcttttggaatgtatctgaaaaatgcggcggagagcaccgttgtaggaactgactatgatttatgtttctattcacaggatattgacgaggaagaaatgttcaggctttatgacgaattcaaggttgttcccggagtttacgacagctcatatcaggcaatttcatcatattcatgctcaataaaaccaagtgatttttcggatgcttatctggaatcaacggattatgaccgagacggagaagctatgcctatggatattcagtttcttgaagacagcgtatatttgagctttattgatgagttgggcttgccggctgaggaatacacgggtcagaacgcaaaaatgattgctgttgccaaagctaaaagagagagcgccgagcaagaaggcaaaaccgagctgattgatatgtttgaaagccgggatatgaattttcagattattcccgaaaccaataacgcgccgcaggcagagcagggacagaacataaacataacgtttgtagacacaattccgactgacactcttccaaagaagccgtctgaggttaaaccatacgtttttatgggggttgcaccttatcagctgaaagagagatttgttaccaaggacacccatacagaaatgggactgacattcttatccagcagcccgtctcaatcggctgcagagatggaaaatataataaataattatggtatttcatctgattatactctttataacgtgtatgaaatgtttgaacaaaaccgcaatattatctttattgtcaatctgtttacctatgtatttatactgatgatttcactgatagcggtagctaatgtgtttaacacaatttccaccaatatcaggctgcggagaagggagcttgccatgcttcgctctgtgggtatgtcggaccgtgaaatcaataaaatgatgaattttgagtgtatgttttatggaatgagaacgctgatattcggagtgccgacagcggtgcttatctcctggctgatttataaatttttatttgtcggcggagcggaggtgagttttgtattcccgtgggtcagtcttgttataagcgtgcttggtgtgttccttgttatttttattactatgctgtatgcagtcagcaggataaaaaaggaaaatattatagatgccctgcgcgacgatatgacttaatgcggtcaatatttgtttgatttatttgaaaatcttgtcagcatacgtacggctgagattatttaatgaaaacaacagcagagtttaatatttttatcagtttgccccgcctattttggcggggtattttaatttaaatatcattatcacgcaaaatttgcatatgatgtattaaaacaaataaagggctgatagaatgtcaaaaaacaaacctagcaggaaaagagacaatcagaataaccaaccatcgcttaaagaaaagcttgcagacgcgattgatatttccaaaaacgtcatgctcggcgttcctctcgtgactatggttggagacagagagcttaccattgaaaactatgttggcataatagaatatggagaggatattatcagaataaaatgtaaggcggttaatgtaagcataaccggaaaaaatttagaactaaaaactatgactgatgaatttttatatattaccgggaggttcaaatgcttttcatacgaatactaaattacataaaaggttatcttattattacaattaacggagtttttgccgagagattcataaacatatgcgtccacagaaatattctgatttgggatgttagccgaaaaaacggcgggtttatggcaaaaatggcaacaaaggatttttataaggttcgtgatattgcgcggataacaaactcaaaagttcggattaaaaggagacagggactgccttttttattgattagatacagaaacaggtggccaatattttttgctttaattctttttatagctattgtgcatttcacctccacccatataatgagcgttgatgtggagggaaatcagaggataccgacagagcaggttctgagcgagcttagggatgttggggtaagctttggaaaacgcgtaagcggactgaacgctgatactataagaaaccaaatgataattaacaatgacgaaatagcgtggctgggcgtaaatgtccgaggctccagggtgtatgttgagataaccgagaggatagacactgagagcgtgccgcacctgacggaggaaaaatgcaacctggtcgcttcaaaggatggggttatagaaaaacttgaggtaggccagggacagactatggttaaaaagggcgacggagtgcgcgagggcgacgttcttgtcagcggcataatggacagcgcatacggcggcttcaggttggttcattcatacggcgaagtatatgcaagaactgagtataccgccaccagggaataccaactcaactatattgaaaaggaatacagcggtgaggaaaaggtcagatttggtctgaatctttttggaaataagatagagctgtatccgccatcgatgagaccggacgataattatgatgaacaggcggaagaatatgtgtatcgcggaagctggcttgggaataatgttgagttcggaggtgttgttgaaaaatttcttgaatataaagaggtggaaaagcaaagaactatacaggaggcggttgagacaggcagaaaggaaatgacagaggaagttgaaaactctgtgcccaaagacgctgagataattgcaagaaaaacagaccataatattatttccggggatgcggtgtctgtgaccgtaacctatgagtgcagagaaaatattgcaaaagagagcgaaattgataaaagtctgattgacaaaaacgacaatttggattatgatataaaagccgaggaagataattccggcggcagataaaatcataggattttgaaatacaaaagaaaaacagaggttttttaatggagagacatatagaagttgaaaaaatggatctcgttataaatctgttcggcagttttgacgagaatgttaagataatagagaaggagcttgacgttgctataatcaaccgtggttctgaaattaaaataggcggagaaccggataaggttgaaaaggcagtggctgctgtaaaccagcttttggccgtggcttcccggggagaaacgataggggagcaggaggtccgttatgtcatgggtcagattgacgacggaaaagaagaggaactggctgatttggggaaagacgtaatttgcatcacctctaacggtacccctttaaaggctaaaacattaggtcagaagcagtatgttgagatgataaagaaaaaccctattgtgtttggaatcgggccggcaggaacgggaaaaacctatttggcggtagcaatggcggtgtcggcttttaaaaataaggaagtcaacagaatagttttaacgagaccggcaattgaagccggggagagcctgggatttttgcccggggatatgcaggaaaaggttgacccttatctgagaccgctgtatgacgctttgggggaaatgttcggctttgaagcgtttcataagatattggagagagggcagatagaggtcgctccgctggcgtatatgagaggaagaactcttgacgacgcttttataatcctggacgaggcgcagaataccactcaggagcagatgaagatgtttctgacccgtatgggatttgcttctaaaatagtggttacgggcgacgttactcaggttgacctgccgagggataaaaagtcggggctgagagacgcggaaatagtcctcaaaaatattgagggcatagagtttatgtatttgtctgaaaaggatgtcgttcgtcatccgctggtgcagaagatagttaaggcttatgagaaaaagactatggagcgcgagagggttttaaggcagaaacgtgacagaaacagcagggagagacgcgcgcagaattaatatttgatatacaaaagaggcattgcttatgaaagttgcaattttaaatcaacaggataagataaaggttggaaaaccgctgaaagatttgataaaaaggtcggcggaagcgtcgcttaaattttttgatttgggaaccgatgttgagataagcgttatgctgacagacaacgatggtatacgcgaccttaataaacttcacaggaatattgacagggcgaccgacgtcctgtctttcccaatgtttgagtataatgaagccggggagataaacgaggattatgctgagctgaatgaaatgggagaaatatgtttgggcgatattgttatttctctggagcgcgcagaagaacaggctgaggagtatggtcattcgtttgagagagaggtcgggttcctgactgttcactctatgcttcatttgctggggtttgaccatatgacagaggaagaagagaaagaaatgtttgactatcagagagagatacttgagcagatggagctgacgagatgaaaaaactgataaagagtttcggttacgctttttcgggactatgggcgtgtataatatacgagaggaatttccgtatacatatctctgccgctttggcggtgtttgtttttgcgtggctgtatggcgttgacaatgttcatcttgcggttttggtgctgacggttgctctcgtgtttataaccgaggcggtcaacacctcgattgagaaggcggtggattttttgtcacctgaaagatcggaaactgccaaaatcgccaaagacgcggcggcgggagctgttctgctttcggcaatagcggcggtggctgttgcggtgatgtcatttaacgatcttgacaggctgagctggacttttctgcagctgtttactatgcctaatttaatttttactgtggcttatataattttgagtatcgtatttatattttgtatagtacctaagactaatattgaaaggaaataattatgaaatcaggatttgtcgctataaccggaaggccgaacgcagggaagtctactctgcttaatcggataataggagaaaaggtggctatagtttctaaaaagccgcagacaacgagaacaaaaattttaggggtgcacactgaggaggactgtcagattgtcctgattgatacccctggtatacacaaaccccacaacaagctgggtcagcgcatggagaagtatatatactcagcgacccaggatattgacgtgctggtctatgttgtggactgcaacatttccgacagggaacttgagcttgaaaaggagtcgcttgacgggctgaaaaaatcaaatgtacctgttgttttggctgtcaacaagattgactctgttcaaaagctgagtttgctgccgctgatggacaagctgaagtcgatatacaattttgatgagattattcccatatcagcgcaaaagggtgaaaatgtggacaggctgttaaaaatccttgagggatatttgagcgagggcccaaaattttttccggatgatattataactgatcagccagagcggcagatagttgctgagtttatccgtgaaaaggctttaaggctgcttaataaagaggtgccgcacggtattgctgttgaaatagaaaaaatgagccaaagagagaacgggacttatgatattatggcggcaatatattgtgaaaagcagagccataaggggataataatcggaaaaggcggagagaagctgaaagatattggaagacagtcacgccaggatattgagagatttttaggtgaaaaggtttatctcgagctttgggtaaaggtgaaagagaactggagaaatcttgataatttcatcaccgaaatgggattcgataaaaaataacagtaaagacttttatgtgattttgtgaggatataaatatgtcgttatttaaagttgcgcttctgcagatgacgtctgcagggacaaaggaagaaaatctgcgcaagggcgtggagttttgcagaaatgcgaaggctatgggtgcggatttggctttgtttcctgagatgtggaacaacggctacagtctttcctatgacatggaggttatggaaaggaattcagaggatcaggacggcttgtttgtcaatacttttaaagagctggctgccgagctggaaatggcaatagctgtgacatatttggaaaaatacaagcctctgccaagaaataccgtgacggtttttgacaggcacggcagaaatgtgcttacatatgcgaaagtgcatacctgcgattttgatatagagaaaaatttaactcccggcgatgagttttatgtgacagaactagatactgaaaacgggaaagtaaatattggggctatgatttgctacgacagagagttcccggaaagcgccaggattctgatgctgaaaggtgcggaaatcattcttgttcccaacgcctgcccgatggagataaaccgtttgtcacagctcagggcaagggcgtttgaaaatatggtgggaatcgccacagcaaattatgcttatggccagcccgactgcaacggtcattcttcagctttcgacggcatggcttacggagagatacgccccggcacagttgaagccagagacacgcttatagttgaggccggagaggctgaggggatatatttggcgcagtttcctatggataagatacgtgaatatagaaagaatgaagttcatggaaacacctacagacgtccgcttaaatataaagaactgatttctgagaagatagacgagccgtttataagagatgattacagaaagtgaaaacagaactctgatttatagctatgaaatacgagcgttatgattacagcgaatgaataaggagggctttgatgcctaatattgatgtttgcggtttggtaaccagggaggtcaaatatggtgaaaacagcaggatactaactgttttggctaaggatataggcaaggtttcggttcttgccagccgtgcgagaaccaaccgttcaggtttgctgactgcaacacagctttttgcttattctaatttcacactgtttaaagggcgtgagaacagccttatgaagatgaatgagggagaagttatagagtcattttctgagataagaaattctcttgacaatatggcatacgcgtcatacttttgtgacatagccaatcatatatgcaccgacggcacagaggagaacgaactgttgggcctattgctcagagtattaaagagactgtctgtaaaggaagaaaatacggcggagtcgctcaaagccgagtgcgtttttcttttccgtgcgctttcaatagcggggtttgcgccaaactgcgacggctgcgcttcctgcggcaaaaatgaaaatataaaattttttgatattcagaacggtatttttttatgcggaaactgttccgcaaaacccaggcagaacactgtcgagattaccagcgcgatgtataacacgatagattatatagtaagctctgagattaaaagggtgttttcgtttagtttaggggagaagagtttgagatatttggcaggagtgggagaagcctgtgtaaggaatcagctggaatacgattttaaaactttaaaatatttaaataatgtgagagatctatagggatttaaaacaatattattttatataattattgctgtgtatacagcaataaaatttatatctaagtgagtatacatattattaatttgtatctaagtgaatatacatattattaatttatatctaagtgaatatacatattattaatttatatctaagtgaatatacatattattaatttatatctaatgatatgtatatgaaccgagcttttcaagcgcggctcattttttaattctttattacatatacccgtgcctgcgcgcctaacgcggcgcttaccagcgccctaccgatgcttgcctgaaagtgtgattatataataaaataaaaataagctggtgttttggcgaacatcggtaggtgtgaccacacttttaaaaaaagtgtgtgtaatacatactaacttgttttgccattacctgcaatgtcattagtatgtatactcaatgcaaactgtgtttgccgcgttaggtgagcaaccaaatcacgcgaagcgagaacatacatataacatttgttataatccattttataaaatttattccgcgactgcgcgccttacgcggcgcttaccagagtcattgagtattcataataatatttgcgtattcatattattgacattgaaggtttgataaaacaagtcacaatgcctcacactcaccatacaggtggggtcacagacattgtaggttatggcaaaataaaatcatatgtattacacacacttttttaaagtgtggtcacagccctgtcgatgcttgcctgaaagtgtgattataaaataaaattaaaatataaataagctggtgttttggcgaacatcggtagggcagacggcgtctgccgcgtaaggtgagcaaccaaatcacgcaaagcgtgaacatacgtataacatttgttataatcctttttataaaatctataccgcggctgtgcgccttacgcggcgcctatcagcgccctaccgatgcttgcctgaaaatgtgattatataataaaataaaaataagctggtgttttggcgaacatcggtagggcaaactgtgtttgccgcattaggtgagcaactaaatcacgcgaagcgtgaacatacgtataacatttgttataatccattttataaaatttattccgcgactgcgcgcctaacgcggcgcttaccagcgccctaccgatgcttgcctgaaagtgtgattatataataaaataaaaataagctggtgttttggcgaacatcggtaggtgtgaccacacttttttaaagtgtgtgtaatacatactaacttgttttgccattacatgcaatgtcattagtatgtatactcaatgcagacgttgtctgccgcgttaggtgagctgtcatctcacgcgaagcgtgaacatatatataacatttgttataatcctttttataaaatctattccgtgactgcgcgccttacgcggcgcctatcagcgcccttccgatgcttgctgaaacataattttaatttatgcaaagctatttataaaatacaaaactcatatttataaagaaatttattctttatttatatgagttttatgttttattttattttaataatatgattaaattatatattgttttttagcttttgactggaagctctatttttttgttttcttcagattctttatagagcacaaatttgtttcctataacttgaaccacgtctgcggaggcggcttccgccagctcccccgccgcttcccgggcggttagcattgagttttcaagaacgtgaacttttattagctctctggcttccaatgcgtccagaataagtgcgaccatgttatcgtttataccgtcttttccaacttggtatagcgccggttctctgttggcaaggcctctgagataagcgcgctgtttactgtttatcatattgctctccttttgtttagttagttttcagcagttcggcagtcttgctgtcaggctgtctgccggtctgacgtatcagtgcttccgaaactgcggcgtatacttttttggctgtgatgtccggttcggagtttttgaagcattcaatgtgtctctttactgtctcaaaatcgccccgctctataggacctgtcaaagcgtttataggtccgttttttagaatattgttcatattatttttcagcagaggtcttatggcggcgaaggcgtcgtcatatgaaaaaccgcattcctctaaaagttcgcaggaaagttcagcgagagccacaacaaagttgcttgcaaaaacagcggcggcatggtatttgcttttgttttcggcgctgagaatttgaaagcggctgccgcacttttttaaaacttccgccggaacgccgcttccctcaacggtgaaaaatgcttctctaaaatctttatagcttgtaaatttatcattcaccgcaagcagcatatgtatacttgcggtttcagcttttaatattttgagttcggacaaaactgtactggaaagcgcgccggaggtgtgacagaaaattttattgcttatatcaatatcatattttctgcattcactggctatattatggcttacatcagcaatagcgccgtcgttcaccgttataaatattaaatccgaatctgtgattatctctttcagtccggtataagcagaggcagagccgccgataaattctgcggattcctcagccgagctttgtgttcttgaataaaagccggagacggaaagcccgttttcggacagatatttgccgagtgaagagccgacccgtcctgctcctataaatcctattctcatatttttctccattttatttagctgaatattcgaaactgtcaaacgagggataaatagtgctttcagttccgctgtaggcatatagaccaatcatagcgccagtaaagcgtttgcccttgctgattgcctgactgcaaaggtaatacaggttctcggcagcatagacctctgtaaaagttttgccgtcatggctgtagctgaatgtgcgttttaatccttcggttgaaattttcaggtacaggctgtcggttacctctgttatatcaacggtgcaggtatatttctcgtcctcgtctattttttcaaacagttttaacgcgtatccgtcaccgttcttatatattccatatgtgaagtatgtattctcatcataatatccggtcattccataattttgttcgctgtccagcttgattcccaaatccagcttgcatacagcgtcaaaattaaagtccggctgtcttctgaccgtaatgtttttggcagacgttgaacttagcggacagcgtgagccttttattatcagcttactgtccttaacagtgattccgtctgcttccggcgttcttggaaatatccagtcaggttttaatctgtctccgtcaaaatcgtcaaatcctgatttttcttctgtatccatagccgggagatttggttttttctgcagatagctggggccgttcaagctgttaacgataggccagccgtcggcggtccaggtcaccgggtcgagacatgtctctctgcccaaaattccatactcgccgtcgagcagtctgttgcacagatataccatataccattcgccgttttgagtctcaactggcttgccgtgtccgcagcatgtgattggagcgtcataatccctctgggtcataatcggattgtatgggcagggttcataaacgccttttaaggttttgctccttgaaactgtcacctggtgcataagcccggtgccgccctccgcttcaaagaggtagtaatatccgtctttatataatagatgcggtccttcgggagcgcgtttattggttccgtagtataagagctccgcgtctgaaatcttttttgtgcagtcgtctcccagttccagtattctggcacccctgttcaggagcatataccgtttgttgtccttgtcggtaaatatagacgggtcgattccgtcctcttcaataaatgccggttcggagtacggtccctcaggtttttcggatgaaaccacgatttggcggcgctttacatctacgtcgtcattatatctgagggtggctgtgatataaaactttccgttaaagtacgaaatatccggtgcccagtagcccctgccgccttccaaatcatctatgtgcgcccagtcgggatttgtgattgcatggcctataacttcccagtgcacaaggtctgtggaatgagagataggtatgcaggggaagaagataaacgaggagttaaccatataataatcacttcccacacgaacgatagacgggtcagcgaaaaatccgcgtcttatcggattgtgatacatatcctcatatttggctccggtgacctcttcaaaataggcctctatctcagcaagtccgttttcgtgagcaagctgatacggggtcacaaggtttttgtcagcgtcgcagggagacattccaacacgctcaaccaaatacttcacacattcaagactgcctgacataaccgcttcgtgcagacaggttctatggttcttgtctccgatattaaagctggcgaaagagtattcaataagaaaacgcagcatttcaaaatctccggttcgggctatataaaaagacataggaacgccgttttcgtcttcttcatttattctctttggattttcgtttaatatttctttgattttattcaggtcatggttctttataagttctatcatttcactcataacttttactgcccctttcaatatacagatatttcataaatacatatattctaacagtgtttaagaataaatgcaacatttattttaagtatatattacaatatatacgttccaaaatcaaagtgacaaattgagtgcatttaacacatcgcttgataaatatccgccaaacatacggcgtggataattattaatccaactttgaatgtattttatttttttatgtactatattatataaggtaaaatcaatcagcttgtttgcactcttgttgttactctttcatatatactgtgcggaaacgcataatataaacttgtgagttccccgtctattttgcagcttaacgtatatgtgtttaaaatgaaactgatttttactagatagaaaaacagacacgtgataaattatcagcttaagaatcgtttctgcggatagtgaaacatagcgtttattcagtatttttcaggtctgcttgttgacaaattttatcgtttatgatagtattacaaaataattgattagaatttttgtccgtattaaagcgggcttgtactttaggataaaaccagcagaattaggaggaaaaaccatggattttgtaatgagttgtttgagcgtcggcgaaaatggcaatctttctattggaggatgcgacgttgccgcgctagctgaggaatatggaaccccggcgtatataatggacgaggatcagattcgtgaaaactgccgtgtttacaacagggcgatgcaggagtattacggcggtaacggtatcgttctttatgccagcaaggctctttcatgcaagtatatttacagaatgatgaaagaggagaacatgggtatagacgttgtttccggcggtgagatgtacactgctttaaaagccggattcccggctgaaaggatatactttcacggcaacaacaagactgacgacgagcttaaaatggcgcttgagaacggtgttggaagaatagttgttgacaatgtttttgagcttgaaagccttaacagactgtcaggggaaatgggaaagaccgcggatatattgtttagaataaaacccggtatagacgcgcatacccacagctttatcagaacagggcagatagattcaaagtttggggtttcgcttgaaaacggcgaggctgaaaatataataaagatggctgacgatatggaaaacttgaatgttgtcggagttcactgccatataggctctcagatttttgagcttgagccgtttgaactggcggctgagaagatgatgacgtttatagccgaccttaaagacaaatatgatatttctataaaagagctgaatttgggcggcggttacggcataaagtatactgagggcgacactcctattgattatgacaagtatatacaggcggtgtctaaggttgtccgccgtatctctgaggagaggggaatacctctgccttatatagttatggaacccggacgttctataaccgctgaaacaggtctcactgtttatagggtaggcgctgtgaaagagataccgggggtcagaacatacatttcggttgacggaggtatgggagacaatccgagatatatactttatcagagcgagtatgaagctgtcagagtaaataatcctttagctgaaaaaacagttacggcaacattggccggaaagtgctgtgaatccggagacattttgattaaggacgctaagctgcctgaaatcaaagttggtgatttggtagcggttttggctactggcgcatataattattcaatggccagcaattataatagaataccgcgtctgcctatagtaatggtgagcggcggaaaatcaagattagccgtaaagcgcgaatcatatgacgatttgattgctaacgacctgtaaaccggaggaatttttatgttatttagtgttttgggtgacgcttcgatgaactttggacagaagctgctcaccatattagttttggtgttttgtgtgcttctgtcgttgtctgttcatgagcttggacatggcttggcggcttacgctatgggtgactataccgcgaaaagcagcggcaggctcagtcttaacccactgcatcatcttgaccctatcggcgctatctgtctttttctgtttggattcggctgggcaaaacctgtgccggttaatccatacaactttaaaaatcaaaagggcggtatggtgctgacgtcgctggccggtccgtttaccaattttattttggcgtttatcgctcaaatcggcgttgctgcgcttgggagcataacattcaggtctgcgaatattggttatgatatagcttcggttttctatatgatttgcagctatatggttattatgaaccttggtctcgcaatttttaacctgataccggtgcctccgcttgacggctcaaaggtgcttagctctgtgctgcctactgatttgtattttaaatatatgcagtatgaacagtttggttttatactgcttatcctgctgataaacctgccgtttttcagcagattgctgaatatgtgcgtgtatgggataatgggattttattctcagattatctcactgttcattcattagggataaattttagcggggattagtgattttgataaatggaacaattaaactttaaggttttggactttgagggccctctggatttgctgctggcccttataaaaaagaataaggtcagcatttatgatatacctatctccacaattgtggagcagtattttggcgttatgcgtcaaatgaaggaatataacctggacatttccagtgagtttttggtgcttgcggctactctgctgcaaataaagtcaagaatgctgctgccgaaacctgttgaggaagacgagactgacccgagagaagagcttgtgaaaaggctggaagaataccggcgcgttaaggcggccgcggagtatcttgaagccagaaagcatattggggagtcgatgtttttcaaagagcctgacaaaatcgagaaacctccggctgagtggaattattccaagctgacccctgaaaacctgcttttagcttataaacaggcttatcagaagatggagcggaaactgccgccgccgaaatattcgtttgacggaatagtggggcgtgaaaaagtttctgtgcgctcaaaggttaagcaaatttggggcaggctgttcggaaaaacgaaggtctttttcaaagaactttttaaaggaacaaaatccaggcctgaggccgttgcttcctttttggcggttcttgaaatgataaagctaaatcaagttaaagtcgagtatgatgagagcggagacatatcaaatcctatcgtaaccaaaagcggagacggggaacttgatttaagcgcgattgaggactaggagaagataaagatggaaatcagggaaattcaggccattgtggaaagcctgctgtttgcggcaggggaagcggtggagctggaaaagattgccgatatagttgatgttgataaaaaatctttgagagaaataataaaaaaaatgattgatacctataattatgaaaagcgcggtatccatataataaagcttgaggattcatacaggatgtgcaccagaggcgaatataaggattatgtttcaatgcttatgaagccgggcagaaagctgcagctttctaatgccgctatagaggttttggcgattgtcgcgtataaacagcctgttacaagggctacaatagagcatataagaggcgtaaactgtgactatatagtgaaccggcttatagagagaagatttatagccgagatgggacggatgaaagatgctccgggcagaccgatactattcggcaccactaaggagtttttgcagacatttggtatagagagtataagcgaccttcccgaatttgagtctttggccgtgcctgaggatactgacatggagcagatgacgattgatgagaagcaggaacagctggagtttaacagcgccgtttctgaggaagccgcggtaactgaaacatccgataaaaatattgaaaatgcaggggagtaatttttattcggcaagggatataagtctttttgtttgaaacgcatgagttttattagaaaactgtttagacgtgagacgatgtataatactgagaggtggtataatgcacgtagtttggataatacttggtataatagtatttatcatttgttttgtgctatggtcaaccgttacgctggatatagcctctaacggtaaaaaaactattattaccgccagtatgtacaggtttcttaaatatgaaatagttttgccgaagccatccgaattagacgaggacaagcaggagcctgacgcggagcagaaagctgataccacagaaaatgaaactatgggaaatgaattctctgaaaaagaatttcacggtaatagaagaaatattgcggagcagaaagccgggacggctgatagtgcagacaatgattcaataggaaaagaatttgatgaaaaagaatttcatagtaacagagcagattttaaagagcagaaagctgataaggccggcggttcagaaaataatgaggcagataataattcctctgaaacagataaaggattttatgaaaataaaaaaagttttatgggaacctttaaagaggatttaaaaagtatttgggacagtgaaaaccacaatcttgatattccgcggatatatgaagtgattttaaaatatactaatataataaaaagcggcaaatacgggcttaataagttttttggatatatgaagcataagattaggattaacagactggatttgtatattcgttttgggacaggcgagcctgataaaaccggtatgacatacggtgcgctgtatggtttggcaggaagcataagtcctctgctgaaaaagtttttcaagatgaaagacagcccaagactgtttcttgacccaaactatgtgacccggtgctttgaatttgaagtgggaagtataattaaaacaagggcggctcatattatcaatgccgcagttatagctcttgtgtcttatttaataaaaaagagaaaaggaagtgttgagaatgtcagaactatcggacaagcatccaattgaggggttgatgtcttctgcaatgcagggactcaaagaaatgattgacgttaacacaatcgtgggcagccctattacgacttcggacggaactgttataatgcctatttcaaaggtggctttgggttttggagttggaggctctgagtttcctaaaaacaaaaaactgctcagcggtgaacaggaagaggtcaataacctgttcggaggcggaacaggcggcggactgtctttgacccctgtgggatttttggttgttggcaacggcactataagaatggttccggtcagcgaggagaacagtatctatgacaggattatagacgcggttccgacggctatagacaagattagcgagataatttcttcagccaaaggaaagagcaatgtggtggttgaccatgaaccagcggagcctgacagttatgttccggatgatgaaagcgatgattatgttgcaggttcgtttgaaggctaggcggtctgcgttttagacttaatgattaggagtaatgttatttaatgctgattagagagaaagttctgccgtttatgctgagtatctttatttttgcggcttgtttcgtgggtacagagcctgcatatgcggcggataatcaagttataaatattgtgttggacccgggtcacggcggcactgattatggtgcgacttcggtcggaggcctggagtttcaggaaaagaatatcacgtttaagcttgcccagtatatacagctggaattgagaaaatacagcggcgtatctgtgaatatgaccagatatgccgactaccatatgaccaacgctgaaagagcggattatgctcagagagttggggctgatgtggtagtaagcctgcactttaactcgtcttcggacaggtctgtgcatggcgccgccgtctgcgcgtcagggctttgggaatatactaagcccgatttgggatataagatattgtcggagctggcggggcttggtatagatacgtcagccggggtttatactcaggcttcaaccacaggaaacatgtggtgggacggtgagcggttggctgacttttcaggcgttatgcgtgagtgcgcctaccgtgatataccggcgatttctgtcgagcactgttacttgagctgttatgacgagcttatttattataataacgacattgcgctgagaaagctggcggccgcagatgtgaggggaattgctgaggaatatggactgcagcttcaaaaatctgagggaaatgttgacagaacatacgataacgcatatatcaacggatatgaggacggcacattcagaccatcgggaacaataacccgtgcggaagccgctacaatgctggcaaaactcagcgatagttttgacccggatcagcagtacagcactacgctcagcgacgtgccggcgtgggcgtggtattataagtatattgcgtttttgaattcagttgggttcataaccggagacgtgtatggaacatacaggcctgacgacaatatgtcaagggccgagttcgctattcttgcctgcaggtatttggggcttcagccgggcggagaaagcggattcagcgattgcaaaggacatatggcggacggctacattgccgctcttagaaataatggttacgtcggcggtgatgaaaacggcgagttccatccaaatgacgacatgatacgttcttcggttgttatgatgatgaataggatactcggaagattcccggtttgcagcactcagaaagaaaatccgtttacggatatagctcccggattctgggcttatgacaatattttggaagcggcagtatcacacgaggttcgataattaaacataaataatattataaatgcggacaatatgtttgtccgtatttatttttggtttaaggctcgtattttgtcaaagtttttgggtcaatagttgaggaaactttgaatatattgatttatatggataatcaattcttatttttataggtaatgtttgtatgattgattgtttttacgtcatttgaaaacggagatgataaattgggtattaaaaaacataatgcggcaattaaatatataggggtctttttgttaacggcctctgttttgcttactaatttttatgccgtcagagctgaggatacggggacggtggggacatcagctcaggccgccgccgttatagaacagaactcaggcagagtgctgtataataaaaatgccgaccaggagctgcctatggcgagcactactaagataatgaccgccgcagtggcgctgaaatacggcaatctttcggatgttatagaggttagcgcgactgcagcaggagttgaggggtcaagcatgtatctggagtgcggtgagaagataactttagaaaatttgctgtatggactgatgcttctctcgggcaacgatgcggccgtggcaatagcggaacatattggaggcggagtggacggatttgtcgagctgatgaacaaaactgcctcagagcttggtttatcacatacccattttgacaaccctaacggtctgccgtcagatactcattacaccacggctttagagctggcgaaaataaccaggtatgctatgagtatgccggagtttgttcagatagtatcgacaaagagcaagacgataccctgggagggcaagggttatgacaggagcatgacaaatcataataagcttttgggaagtttagagggctgtataggcgttaagaccggatttacaaaggcggcaggcaggtgtttggtttctgccgtaaaccgaaacgatatgacattgatatgcgtgactttaaatgacccgaatgactgggctgaccacgcatcgcttcaaaacagcatgtttcagaaatacagccagaatgttttgacctcaactgaaatgataatagataagatttctgtagccggcggaatgctgggatatgctggggtcagcccgaataagacgtatacatttccggtttgtgaaaacgacagcgtaagcgttgacacaaatgttgacagcgagaatatgaagttcccaataaaaagcggcgacgtggtcggtacgggcacggtgacggtaaacggcgaaaactacgggaattttgaactgctggcaaacagcgatatagatttggctcgaccgtctaaaggcagtttttggaatgatatgaaaaatgatattgtatatgtttttcagtattggctgagcatgttccggtgagatatgaaaagttagataatttatataagatgagaaatataaaattatataacttatataaaatgatatgaaatataaaaaggaaagccgacagaaaattaagggttttgctttgcaaacctcggaagtgtttgcccctgcctgaagggtggtgtaatacaaagggatttgtattacatctactttaaaaaagtgtagtcacagtcctgccgaagcttgcgaaaccatatttttatatctttattatagaataattatatatttataatctaatatgcggtgtatatagtgaacatcggtagggtgtgcgcaagcacaccacgttaggtgagctgccatctcacgcggagcgtgaatatatatgaaacgatttgaaagtatcatttttatataaacttttccatgactgcacgcctaacgcggcaaactacgtttgcacatcacaactaagtgatttattgacattgaaggtttatcaatacaaagagatttgtatcacatacactttaaaaaagtgtagtcacagccctaccgaagcttgcaaaaccacatttttatatttatattatagaataattatatatttataatctaatatgcggagttcttagtgaacatcggtagggtgtgcttacgcacaccgcgttaggtgagccatcatctcacgcgaagcgtgaatatatatgaaacgatttgaaattattctttttatataaatttttccatgactgcgcgcctaacgcggcagatttcatctgcattgagtattcataataatatttgcgtattcatattattgacattgaaggtaaatcaaaacaagtcactttatatcacacccaccatactggtggggtcacagacattgaaggtttatcaatacaaagagatttgtatcacatacactttaaaaaagtgtagtcacagccctaccgaagcttgcaaaaccacatttttatatttatatttagaataattatatatttataatctaatatgcggagttcttagtgaacatcggcaggacgcgcttgcgcgtctcgttaggtgagctgtcatctcacgcgaagcgtgaatatatatgaaacgatttgaaagtatcctttttatataaacttggccgtgactgcgcgcctaacgcggcaaacgttgtttgcattgcatattcatattattgtttgcgtattcatattattgacattgaaggtaaatcaaaacaagtcactttatataacacccaccatactggtggggtcacagacattgaaggtttatcaatacaaaggaatttgtattacatacactttaaaaaagtgtagtcacagccctaccgaagcttgcaaaaccacattttatatattttttatttttaatatataacctttcttttatgtttagctttattgaagactttctacagaattatacgagacatataaaattatatgatgtatataaatcacatgagacttacaaatcatataatatatacaagctatataatttataaaaaattagacgagtaatataagatatatcaagtcaaataagatataaaataagcagaaaattttgaagtatttgtgcttcaaaattttctgccctttgtttttatttgcttattattgcggatttgcctgaggctttcgcttggtaaagcctgttatcggcaagattaaataaatcataaaactcatcggattctatttcgtcggaaccggcgcatccaacactgacagtcagttttatattattgccgttttcgtcggttgaatagctgcatgccggtgtaaaaatatcaaaaatcattttttggaattcgtcataattttcactttcgtatactataatgaactcgtctccgccatatcttgcgataaatgtgtttttataatctttaagtgaattattccaggattcagctaaataatttaaaatctgatccccggttctgtgaccataattgtcattgacttctttaaagttatcaatgtctaaaatagccaaacagactgaacggtttaactttttcattctgctgtagctgtttataaaatgctcttcaacatatctgcggttgtagacatttgtcagcggatcggtgataagctgtttgtttttatgttttaggtcgagtatggtgttaaacatttcgtcttcgctgaatataaagttccggctgatatccttaaccatttcaagtgcaaaactgcggccgtcaacattgatatatttggatattatataatataaattcttatttatattctcaaatttaacataaaaatccttgtctatcaaggttcttgcagaaatacagttggagcaccggctttcatttgaccagacgttaaaacaaaatccgtcttttccggtcaggccggccgatgataattcaggcatcagtttatccacagtatccgattctttcagtatttcctcagagataactttgcagataatagggtcgacaactctgactatgtcgaaggtatttcggaggatttttatttcacttattaattcgttataggtgtaattgtgtttcattataattctcctgctgttccggacaatatttgggattatccgcccaatctattatccaatttgttttatattataacatgttgtattttgtttgtaaataacagtcggttaaaatcatatatacaaacaagtcagacatatttattgattttctatcattatttaatattttaattttgagcttaaaaaatttcagtcattaaattttgtttgatactatgcgtgtagttttgcagtctgaattgaaccaaaaagcaacaaagccggctaaatatatgaactattttattctctgaattaaacgttgttttcatatggaaaaatctgccgaactgttttatatttttattacagccatttatttatgaaattaaataattcagtatttttcgctgaatgcagccgtatcagctttagatgaaactttctgtttgcttgaacattctttcgtgcacggctgcatttctttgcgtatcgaatgtggttaagcaacaataagttttgtttagtacctatttttatccatatacgtgtggaaatttttagtatgttttaaattatccacatattcgcagtatatcaagattatgattctgattgaatgtttctttttgtaaatttagccgccaatcagacgtacagattagcggctattagtaatttaacaatcttgtgatgaaaacagtccgaacttatttaactattttatatgttccgtatataacttttgaagcttccgctctcgtggcagaaccgcggggtttgaaacttccgtcctcatatccgttcataacaccgagacctacaagttctgcaaccgcgtctttagcatatgcggcaatatctgaattgtcagtgaattccagtatcacgccgtcgccgctcttgtttattgctctgtataaaatagtagccatgtcttgtctcatgataacttctccgataccgaagtattcatctgactgaccttgtacatatccggcgttgactgctgctgtaacatatggagcataccatttagtttcgtccacatcattaaaatgtgaggttgtgtctgtggcgtcaaggccaaacatctgaactaccattttgcagaactgctctcttgtgacgtttccgcttgggtcaaacttattgtcgcccataccgtttactataccggcatttgtaagaccgataatagattctaaagcccagtcatatccgtccaaatcagtatatggattttcgtctgcaaagttaggagctttggtgggatccggttcagtcggtgcggatgatggataaacggttccggaaccgttagtatctccgcctgtattgccaccggtacttccgccctgatttttgttcgggttaacagttttataagctgttactgtatcttcacctaaataatatgagatgtcattatatttgtaatagcatttaacgtgaacaacgtctccggttttatacatttttgtggtagacggcaaacttacggaaactgactcgtctccggctttaaaagccttttcactgctgttttggataacttcgccttttgagttgtatgcgtaaacctgaacagttgcgtcctggtctattatagcctttcttcttttgacggaaacagaccagctgtatcctatgtttataccgttagtgattgagaatatgggcagattgtcgcttacaacgtttccgtcctcaattttattgataattttttctattgaagacagcatatattctttatatgtgccgctgtaattcttattcacatcatcatataaactttgcgctatagtcttcagcgatgacagatatgttttatatagagtatgcaggctgaaactgttggcttttgagtattgaacttcaagagaagctatttttgtgttataattctcagccgttttgtcctcaagagttttcagcgctgtttcaatatatttattataatctgttagctttgataccacttcattgtattcttcagttgcttttgcggctcttttaagtgcgcttggaacagaggttgaaagattgtcaaatgtggtctttaagtattcatagtttaaagccgagctgtcgtcagttattccgtcataacattccggcatctgcataatccctgaaacttcctgcatagctttagcggctttttgcagggtataaaagtcagtaattgatttattgctgattgagagagcggtatcgattctttttttgcttgtttccatcatagaatcataaagctcaacagcggtgtctattcgtgcagaatagtagcttgagatatcatataaatcgtccttttcttcatccttataaaatgtcagcgctgatatttcaggcagagccattagagcatcataggatgactgttccttttcagtaaggtcaggcatatttgtgccttcaaccactgacagcgttgggttaataataagctcggagccgtcttttaaagtcgctgtaaatttgtcaatagacatgttatgcgaggtgattttattctttgatgtaacagacgcgtttgacaggacaaccgcgccgctcagggcggttgagccgttcttccaaacgtaagttatagttttatcgtccgttatggattttgaagtttcaccgttaccggcaaagctttcaccaaaggatacggagttaatttccgcattatcaaaagtggctgtaagctcaaagcctaaaatttcaggcagtgatgacgcagttttgaaaactaccttatatacgtcgtcttcatcggttgtataaactgttgcggtgactttcatatccatttcctgagcgccgggcgtggctgtgggttcaggagataccgtaggctcctcgggttcagcggtggctgacggttcaggtgaagccgtagcttcagtagtttcatcagtgagcacagtgtctgttgctgtgattgtttcattattattctctccggcagcaaagactgcaggagctgaaactgcggtagttaaaacagcggcggaaacaagaccgcagactagattgttcagttttttattcttcataactaacctcctgatatacaagaaaaattgtgtaaaacattaagcatagaattaattataacattcaaatatttaatatcaattaatcagcaattacaatagtgttacattcgacattatacgcatgttaatatatggtaaagccaaaacaaaaaatgcggaaactacttgatttataatattccaaatgttataatgtcaaaagctatatattgaaaggagcgatttttgtggctaaagagctgtcaaaaacctatgaccctaaggcggttgaggaaaaagtatatcaggaatggatagacggcgggtattttcatgcggaggttgatgaaacgaaaaaaccgtttactgtcgtcattccgccgcctaacgtgacaggtcagcttcatatgggacatgcgctggatgaaacttttcaggatattataatcagaacaaagagaatgcagggatataatgcgctctggattccggggactgaccatgcaggtattgctactcagataaaagttgaagaggatatgagagtcaatgaaaacgggctcaccagatatgatttaggcagagaaaagtttttggaaagagtttgggcttggaagaagaagtttggaaacagaattatagaccaattgaaaaagataggctgttcctgtgattgggacagggaacgcttcacaatggacgaggggtgcagcaaggcggtcagagaagtttttgttaacttatacgaaaaaggccttatttatcagggtacaaggataatcaactggtgcccgtcatgcaagaccgccctgtccgacgcagaggttgaatattcggagcaggaaggccatttttggcatattaaatatccgataaaggacagtgacggctatgttgagatagccaccacaagacctgaaacgcttctcggagatactgcggttgccgtaaaccctgatgatgaaagatataaggatttggtgggcaagatgctgattcttccgctggttggaagagagataccggttattgctgacgaatacgttgataaggagtttggtaccggctgtgttaaaataacgccggctcatgacccgaacgattttgaagttggaaagagacatggtcttgaggaaatcaaagtcttaaacgatgacgcaactatcaatcaatacggcggcaaataccagggtatggacaggtatgaagcaagaaaagccatagttgaagatttggacagacagggacttttggttaaggttgagccgcatgtccacaatgtggggggctgttaccgctgcggcacaactgttgaacctatcacctcaaagcaatggtttgttaaaatgaagcctttggctgagccggcggcaaaagctgttgagaacggcgagacaaagtttatccccgaaaggtttactaagacttatatgcactggatggaaaacgttcatgactggtgtatttcacgtcagctttggtggggacatagaatcccggcgttttattgccaggactgcggtgagacaattgtttctaaagaggacattgaggtctgccctaagtgcggcggaaaagttaagcaggacaacgatgtgcttgacacctggttcagcagcgctttgtggccgttttcaaccctgggctggccggatgatactgaggaactgaaatatttctaccctacctcggttttggtaacgggttatgatattatatttttctgggttgcgagaatgattttctcaggaatagagcatatgggtcaggttccttttaaagacgtgtatatccacggtcttgtgagagattctcagggcagaaagatgtcaaagtcgctgggtaacggtattgaccctctggagataatagacgagtacggcgcagacgctttaagatttactttggctaccggaaactctcctggcaacgatatgagattctatactgaaagagttgaggcaagccgtaattttgccaataagatatggaatgcgtcacgatttgttttgatgaatctttctatagataaatgcgaactgccggacagagataagctggagatttcagacaggtggattctgtcggaatacaatgatttggtaaaggaagttacagataatcttgataagtatgagttagggatagcggtttcaaaactgtatgatttcatttgggataagttctgcgattggtatattgaacttgtaaaaccaagattctttgaagagggcgagagcaatataaccgcccagcaggtgcttgtttatgtactgtctaacacgctgaaacttctgcatccattcatgccgtttataaccgaggagatatggcaggctttgcctcatgagggcaagagcataatgatttccagcttcccggtatataatagcgagtataaagacgaaaacgctgaaaaagaaatgcagatgataatggacgcaataaaaggaatcagaaatatcagaaatgagatgaatgttccgccgtccaagaaagccggaatctttataatcactgaggagccggagatatttgaaaacggtataccgttttttaagaagctggcgtacgcgtctgaagttaatgttataaaagacggcggcagcgttcctgagaacgtcgtgtctgttgtagttcccggagctgagattctgatgccgcttgacgagctggttgaccgtgcaaaagagatagagagacttgaaaaggaaaagaagcatcttgaatcagagataaagcgtgtcgagggcaagctgaacaataagggatttaccgaaaaggcgcctgccgcggtagtggaggaagaacgcctgaaaggtgaaaagtacagcgaaatgttaaagaccgttattgaaagtttggaaaagttaaaataaatattttatgcagtatatgtcggcgcttagggggctaatatggataatgtatcaatgggcggaggtttgaaggcggttgtatattgctctcataccggtcatgccaaaaaatgtgcggaaatgttctcaaatcgtttgggagtgccgtgttatgacattaagaatataaaagggcttggcaggaacagcaatattgtattctttggctggataagggctaacaaaataattggctataaaaaagctaaaggattttttgatatcaagctgatatgcggcgttggtatgtgcaaaggcacggacagcattatacaaagcttgattgagagaaatgatattgataagccgttttattatgttcagggcggagttaatacggaaaggctgagcggagtttataaatggatattgaatatagtccgatttggaattggaaaagccgttagccaaggtgtcagcccggacgaaagtttcgattctaaggctcaggcggagtatgaggataataaggagcttttaaaggatatacaaaataaccgcgaccatataaccgacagtgctgtggaagagctggttaagtattatcaggcgttaaagtaatgttatttatggcggcggggtatatcctgccgccatttttgataaaagattatgctgctgaggcatcaaaaaacgaattgttgggaggcactttggatgaaaaagcaagttaaaacaaacgctatgaggatattggagaaatcgggaataaattttgaggctgtattctatgacagcgatggatttatggatggggtttcggtagctgaaaagctgggtcaggatttaagggacgtatataagacgttagtgacagagagcaaaaatcacgagtattttgtgtttgtcattccggtggcagaagaactggatttaaagaaatgtgcggctgctgtggggcaaaaatcgcttgagatgatacatgttaaggatataacgaaggttaccggctacataaggggcggatgcagtccaatcggtatgaaaaagcagtttaaaacagtgatagacttgacggcagaggagcgggaagagataatattcagcggcggcagactgggagtacagattaaaatggctccaggaaagctggcggagctgataggagccgaatttttagacataacaaaataacaggcggcgaggattggaatgagaagtatgaaaactgatttaaggaatattcccggcgtcgggaaatcaatagagcaggatttaatagatataggtataaattgtgttaatgatttaaagggcagagaccctgaggatttatatctaagagacgcggctgtaaaagggatcaaatccgatccgtgccttctgtatgtgttcaggttggcagtgtattatgctgaaaatgaggagcgggatatggaaaaactcaagtggtggtattggaaagacaaaaaatatccgccggagaaataaggtgatgtattcggcggatatttttgataattctatttgattttttataattctatttaaagtattcacatattccggtataaattgcttctgcaagttttttttgatattcttcatctgtcagattttttaattcttcaggatttgataaaaatccgcattcaaccaacgctgccggaactttagcgtttttcagaatatatatcccggtttcgttctttttggcgacccggttattgttgttgtcaagattatttattaaagacgcttgtataagctctccgagttttttgctgtcctcactgttctgtgaataaaaaacctgagcgccgctgtattttggattttcaaatttgttcatatgtatgcttataaataaatcagcgccggaatcttcaatcagcgataacctatataacaggtcgtcttttttgacatatttgccgctggtgttattgagcagtttaacttcgtcactgtcacgggttaaaaccgcggtgtttccgtcagagttaataacatcgcggagtttcagcgccacagccagatttatgtctttttccagaattccgcttgcggacgcgccgccgtcaacaccgccgtgtcctgcgtcaataacaataacttttccgctcgcttccgcattggtagtaacagcagggtcgtcatttaagccgaaaatcattatacaaatggcggcaatcaccataagcgtacctaatcctattaaaattaaactattctttttaacagcaaaaaacacataaatcacctcagttgattatatgtgcgtctatcctatactagaacgtataaaagcgcctgcgtacaatataaataataaaataagatttatagacagtctttcaggctgggtcacagactttgtcggttagataaaacaagacactttgtatcatacgtgccgaagcttgcaaaaccacatttttatataaattattatagaacaattatatatttattatctaatgcggtgtatatagtgaacatcggtagggcgtgcttgcacgccgcgttaggtgagctgtcatctcacgcgaagcgtgaattacttatggaaggttgttataatcctttttaattgcaaattcatccatgactgcgcgccttacgcggcagatttcatctgccctgccgaagcttacaaaaccacacttttatataaattatcatagaataattatatatttattatctaatatgtggtgtatatagtgaacatcgggagggcgcatttatgcgccgcgttaggtgagctgtcatctcacgcgtagcgtgaattacttatggaaggttgttataatcctttttaattgcaaattcatccatgactgcgcgccttgcgaggcaaactacgtttgcattgagtattcaaattattgacattgtaggtaaatcaaaacaagtgattttgtataacatccaccttttcaggtggagtcacacctaccgaagcttgcgaaaccacatttttatataaattatcatagaacaattatatatttaatttctaatatgtggtgtatatagtgaacatcgggagggcgcatttatgcgccgcgttaggtgagccatcatctcacgcgtagcgtgaattacttatgtaaaattgtcataatcctttttattacaaattttcccatgactgcgcgccttacgaggcagatgaaatctgccctgccgaagcttgcaaaaccacatttttatataaattattatctaatgcggtgtttatggtgaacatcggtaggtgtgaccccacctttggtgggtttgatacaaagcggcttgttttattatagccttcaacgtcaataaattacttagttgtgatgtattgcgtgcttgcacgccgcgttaggtgagctgtcagctcacgcgaagcgtgaatattcacttattgtggtttgtcataatcctttttattacaaactttttcgttaaagaaataaatttgttttatccaggcggctgacagcagttatacgcataaacaaagttataaaatatctaaattaacagaattaaattaaaatcaccgcatatagttaaaatgataaaaatgtaaatttcatgaaaataaaagtattttaataaaacagcgagaaaaaaagagaaaatatcaattattactaatttaatcgaaaataatcggaaatatatgcgttgacttttggtctttcaactagtataataatcgatgttgctgttaagtgcggcacacgaaaagatacgggagcatagctcagctgggagagcatctgccttacaagcagagggtcataggttcgagccctattgttcccaccactatctttttaacatatgggagcatagctcagctgggagagcatctgccttacaagcagagggtcataggttcgagccctattgttcccaccatatgtggtccggtagttcagttggttagaatgccagcctgtcacgctggaggtcgtgggttcgaaccccatccggatcgccattacagcttaagcaaattaagctgttttgcctctgtagctcagtcggtagagcaggggactgaaaatccccgtgtcggtggttcgattccgcccggaggcaccattttttgcgggagtggctcagtggtagagcgtcaccttgccaaggtgaacgtcgcgagttcgaatctcgtcttccgctccaactgataaaagacgcatatttttgcgtcttttatcataattattaaagcaggataaaaattttaaaatgtgtgcataattatagaatacaaaaatataattaaataaggcgccatagccaagtggtaaggcagagctctgcaacagctttattccccagttcaaatctgggtggcgcctccaatattatcggggtaagtttgcttgctccgatttttttatgcaaaaatctattgtctgtgccgccgcttctcattttttacataatctgcggttttgcagaagccctgaaattgttggatgaaatgcaagatatttaagtattgccaatattatcaataatattttgtgctttatcgtgttttcaagattaccgtttttataggcgataatttttattaacttctttatatataattgtttttgtatctgtatatctgaatatctgaatctttacaatcttatcatggtatatcaaacattcaactatatcctagaattatcttaaattttttgttataaatcatattttaaatttactgattttcaaagtttgcgacagatgacatttgattgacatatctgctgtcttaaagttaagtatctgctttattgcgtcagttcatattatgatattgtatttattgataaaatgggtattagtcgtataatctgcggatatatccgtagttatttattgttttaagtcggttagactgcaaaattggacttaaacaacactctcaaacgcgaaggggttatcttagtatacacttctttgtaagcgtgaatttagaaaaaattgacagccgtattaaaatgaagaatagatgtttataaattatatgggggtgttgtaatagatttatgttagcgatatactgcaagtaaatctacggtagccgtgagtgatatatttgtaggactttttaattgtgtttcatttcaatcttatatataaacggctgtttgaagtgttaagcaatttggggatataaaaaattcagattaacgcacacagtttggattgataattttttatttctgatattgtgtatattaattcgcataaatttgtgtgacagggcagaatttgattgagtgaacaagtttgattaaatttatttcaactcaagtatcccgggcagatgcggattgtcttttatacaatatatattattgcaatattattttaatccacatcatcacaaagcttttaaccgtgttattttaggtatgaatttttcagtttacgaacctacacgggtgcggctaaagatagggaattcattggtgatattgccaacaaagcaaaagaactgactaatgttagccagctccggaacgataacaaagggtggtacttgccggcgtctgttttatcaccattataggcaagtggaaacatcaaacgtaaaaaatataaactaaaatacttactttgttctgtataatatttttatattacattaataaaggagatttttatataaatattttaatttacccgctcatgtagggtacggcaaaataaaaaacgcttacgcacctcctgaaagagattttaattcacgcaccattatggtgaacaacaaaaataaatcaaacttgatattataatatattaagctttcaattcacaccccagcaatggtataacaaaaaagccccgatttataggagcatatttatatttcagaattttgatagtagaggccatcatataatctttgcaataatatgccctcttcgttaaggtcgtaattatcatcaaaaccaatttctgttattttatcatctaattcggtcaatagtaaatcaatatcagtatatgactttttcaaatattttttcacaagttctttttgtttctcagtaataatcatcacttaaacttcttccttccggtcgttggtttaacctgtattaacacttgagtatcatgattaacggcaggcgttaacaagtcgtcaataaatatttgactttttccatgcttcaactttctaatatcacctaattttgcaggattctgaagcacgtctaatacatcattacattattacgtttttgttcagccggccatatcaccaataatataaaatgctttgatttatttgttatcttcatactgttacttgcagtaatgccaatcaagtttttatctatttcttttgctaatatttttacatttcaatccacagtcgagattatggtgggtttgactattggtaaaatataccacaggctgtatctgtgtccaatttcaatccacgcaccccgcatgggtgcgacggttggaaaatacaatatcaaaatatatctatgatatttcaatccacgcacccatgcggggtgcgacatattttctgcatatggcgtcaacaatggatttaagatttcaatccacgcacccttgaggggtgcgacaaaaaaggagagatatttatgggaaacatgatcatttcaatccacgcacccttgtggggtgcgactgcaaaaatatataaaaaataacatttgtattcctttaatctagtatattttgctttttaagcaaaatatataatataagattaattattacatacattttttattatatatctttgtttttaatggtgcgaacctcccggtaattttatgcgagcttaccattctcatctatatcattttagcatatttttagagataattttatatttataactttttaattggtttaatttcttaagcttatactaaatatgtttattttttcctgttacttattttatatcacataatgtaatataaagcaatatatttttttaaaatatgttaaaaaataaaaaattgcattaaaatataataaataatatgaagaggaatattataaatacttggaataacaaatggtttaatataaaataaactgcagaaataatatatcatattaaaaatgtttggctacaagaagatatataaataatttaatatttgatacttttatgatataaattttgaaaataataaaaattagggatgttaaaaattcactctgtagtttaacacagattatacaaaaattttttgtcattataattaaatataaaattttctcccataccgtatcgggttatattattagaatattctatgctcaataatcctttctactatatttttttataaattcagcatcttagaaaaatcttgatttacccaatcagccgggcataaatcagaaacagttgacttcactgaagtttttaatttatatgtatttaaaagatgaaacaaaataattaatggtgttatggataaagcaataaagtatttaggaattggcataactgataaaaaatcgattttgctgattaaatcctaatttgaatttaattgtttatcagaacttaaattcagaattatatatgatacttaagtaaattaagattaacaaaatatattgataattaaagttatactatgtcacgcactggcactaaagttaatttacaatgataatagattcatatatatgatgctccgctgtcatgagaaataacaattcacagcagttttgtggttataataatttgacagcgtaaatttaaaaaataataaaaaatttggggtggcattatcgtttgctgaaaaggcgggttgtaatgttgttccgtaacaggggtggcactgccgttcgtataaatcgggttgcagcgttgttccaaaggagaattcttatgggaaaagaagcatttgatttctttcctttagacgtgcatcttagtgataagatggagcttatagaagcagaattcgggttaatagggtttgcggtaatcgttaagctgtggatgagaatatacggcagcagaggttattactgtgaatttgatgaagaggttgcattgatgttttcccacaaaacaggggttggtgtcaatgccgtttctgaaatattgaacgcagcatttaaaagaggtatttttgacataattggaaagctccaattgactacatcaactcttttatcaatttcggtgaactcttttaatcttttttgtaacacatcattgacaaacctacagcaacaatcaaaaaattgacaaaattaccgcttctgttgattaaaatttgtgtatttacagcttctgaaaattatggtaatattggattaattctgtcaataatatctattgtttttatttaatccagtctataaatcagattcgtttttaaaaataatacgtataatattttagacaaattcttagagatatttggaggaagctcaatatggaaaaagatagatttgaaaaaatatattcacaaggaatactaaatactacagaaatttgggttgatacagaaacaggaataaactatctgtatcacagagattcaaatgcaggagggttaacaccgctgctcgacagagaaggaaaacctgttataaccgcggttaacagataatctcgtatataataaaatctttataaacaaaaaatttatgacatggaggggtatgattgcacgtgtttttagacatgtttttaacatttgccaaagtcggagttatgacattcggcggcggttacgctatgctgccgattctcgagcgcgaagtggttcagaataaaaaatgggcaaccgaagaagaacttatgaattattttgccgtcggacaatgcacgccgggagttatcgcggttaacaccgccacttttataggctacaaatacagaggggttcccggagcaattttagccacggccggtgtaatattcccatcgctcgttatcataattataatcgcagcatttcttcaaaacttcgccgatattcccttagtggctcatgcctttatcggaatacgcgctgtggttgccgcattgattataaacgctgtagtcaaattttttaagtcgggtgttaaagacttaaccggcgtggttattttcatcgcagcttttgcagtagccggaatattaggagtatcatctgtctacgtcgttatcggcgcattaatcgtcggtcttattgccggacaactgaggaggcgaatcaaaaaatgacatatctgcttttgttctatgaattttttaaaaccggtttatttgcggtcggaggcggtcttgcgacattaccgtttatttatgatatagccgtaagatatccagagtggataaatatgaacgatatatccaacatgatagctgtatcagaatcaacccccggacctatgggtgtaaatatggcaacattcaccggtttcacaaccgccggagtattcggagctctctctgctacaataggcttagtagtaccgtctgttataattatcataataatagctcactatttaaaaaagtttgaggaaagccaaatcgttcaagatatattttatggactacgtccggcagtagccggtctaatagcagttgccgcataccaggttataaaagtcacaattctcactttggatttatacaatgaaacaaaaaaacttatgaatctagtggatataaaagccctgatactttgtgccgtaaccttagttttactctatataaagcccttaaaaaaagttcatccgattatttatatactatgcggagcaataatcggaatatttattttttaaaaaacttctcatacggttttaacactaaaatttaacagtttacaaatataaaatctgatagcaaaattaagttaaagcaacaaaaactcccgcgaatgtactcattctttgggagtttatgttttagaatttattgggaagaaatctataaataatttttaaattatttaacttgttaataaaattttgaataaaactgcaggaggagatttcctcctgcagttttaattattattcaaaatcttgatatgtcagttcaatgttgtcaaaataatattccattttgttagctgtatcgttaaatacatccatgtaaatattaaagtataagttagataaatctatatttttcggatattcattgttattgccgtcagcgtccttagccgcaaccacaaaaggttttttatttaagatatatgaacctgcgtcacccgttttccaatctctgtcatacaacgttgtggttataatttgattttcaaggtcaatgtctgcaacaattctataccacttgttagccatattgttgcctctgttgaactgagtattatcaccgtttattctggtattatttgctgtgtatatattaaactggctccagcctttataaactccccagcgaacaaatctagtctgatcttcggctcttccgttgccgccgttctttgtgcttgttgcaaggtcaaaacctgattggttattcgggaaataatctgtgctttccattaagaaatcatagctgaatttgattgtcttagtatttgccagcgatgaaccgctcggaagcattgaagtcaggttaaaacttgcaccggtttttgcagctactttacttccttcattcttagtaagtttcagaaccttattgccggcctcgcctaaattagctgattcctttccggtaacggtataaataccgccgctgaagcctgacgctgagttaattgtcggaatatagcctttgccgtcaaaatcagggctgctgacaattatctcctgcatttttttagcatcaatatttaatgaaacaatgcttcctatagtaccatcgactttctgagattctgttgctatgttgtataaaggatcacctatagacatatacgcaatatatgttcctactggtaggttttcgactgtataagcctgagtttttgcacctgccggaacaattacatcaaccttctttatttgtgccgctccgctcataaacttgattgttaccgtaacatcactttctgatgcttgagaaagttcaatattaccggaaacggtgtatacatcttttgtgttagtagtaggtgtaattataacaggtattgtcttcttatcgccataaccattgttattatcccttgcatatagcacaacgctggactcaatactattttcgcctgcagcaggacggacaacagtcagcttagttccgtcactgcttacagtggcattttcagacgatgattcccatttaaatgaaactccggttggagccgtcggaagagtaattgttgtttcctcattctcaggaattacaactgttgctccggctattgcagcgtcaacgttctttaagttctcactaaaattcatcggatcccacgcgtcgcttctaaaactgttggtaaaataatttcttggattgaattcaagaatctgccagtcattaaggactgtacccatccctgctttgtctgccgcatttttaacacgctttgaaaggtctacgttttttccgctcttatttttagttccatattcaaagaaacgtgcctggtctttctttattgtcatatcattccatccgtcagcactgatagttactttactcttgcccgttgaagccgagtcatcaagagttgtattataataagtaacctgaggaaaatcgttccatggtcttccataatttgaatttgacgttgtattggaacgcatgttataaatctcacagttccagaagagataaccgtaagggttttcagccctggtgttagcggccgttattgttgcccccgacgttgcatttgacataccctcagcgcccagcttacaattgtcaaatactgccgttgcgtctccgtatatatagtctgttcctcctatcaaatcgcagtttttgaaatacattcttccatttgtaatatatactgaatcctgatttcctcttgcgcgaacattctctaatataaccttatcaccgtggagcgcaagagcgtgaccgcgctcattatatgaagcagactttgctaaatatgcgctctcgcccgctgttaaattagtcaaattctgaagagcctgtattctctttgaagcatttccattctcatcttttatggcaagagcatttttaactcttgttgtagcgtcttcaggagtgttctcatcgcatattgcaagattatcacgatatgggagaacatagcttgttgcaacacctgcaattctgtcaagctgcggcgtcaaatgagcatccttctcaccctgcgtcaccataacaggaacactgtttacaacattcaaatcttttacaataatattgcttgcattagagtttacaataagaacacccatttggtcatatgttctggtagaaccaagattgtttgcatttggtttaacatttttatgagccacaccatttttatcataatatgaaatagtcttacctgtaataacttcacctatctcatactttgtaaacttttcgtctccggccttataaccgttccaggtttcatcaagtgaccagtcaatatcaggattatagtttcctgcaaggtcacagtttgaagcgcagtatcctgtgcagtaataccagtgaagtgttaccttcccagttgtttccggcatttgctgcagcgttacataattaacgccgtcaaacttaacctgttcttcataatccccagggtttacgttaattgtaaccctttctgcttccgatttaggattaatttccttagccctagcaactgctccccttattgtatcatactcaccgacaacagtattattttgcataactgccgcctttttatcgtatggaaccatggttggagttgctgtaggcgcggctgttggtgttgctgtcggtacagcagtaggttttgctgtcggttccggtgttgaggtcggagcaaaagtcggcggaggagtatcccccggctttaatactccggatagagggttcaaggaatcaacaccgtcccaaatatatagtctaacggttccttttccaggcttgatataatcaagaccttcaaccgtcgttccctttatatcataactctttgcgtccagcattatttcgctgtccgcctcgtcatatgtaccaacgaacaactttcctgttggattcgcttcatttccattatatcttaacactacattcagttttccatcatttccaaaatatgccgataatatatcatatatatatccattcggatcagatgtaggatatacatactccgccgaaacatccgcgtttgcgttataataaccatttatatcagcagattttacatttgcatttcccaaatcaaaatcagatgttttatatttctcagacgccgccgtattcacctgttcatctgtctgatttgcagataacactgtgattcctggcatcattgtcaaaagcatcactactgacacaaccaaacttacccaccgtctttgtttcattccgtttctcctcctcaaaactataatttatattttatgatattattatatcaaaccggaaatcaatatcaatagccagttaacaaatatttttaaataccagtttgcaacataacaacacgtgttacagttttattgtcataaaacataaatattgccataaatatgcaaatatgtcaaaaccaaattcacagtataaattattattattttgttttcgaaacgtttttattataaaaatttaattaattatattaacataactttttaatagtataattaaacatataaactttgataacttaaatcatttatatttgtaattaaattatttttataattttaaataccagtttaaataaatgctataaaaaaagcggccggaaattggccgccaatgtttatattaagataattcgattatttaaacgcattgctcagttttactaactccgcataaactccgtcctgctgttttaagtcctcatgtgttcccagctgcactactctgccatgctcaataacataaattatatccgcattttctattgtagacagcctgtgtgcaacaacaataaccgttctgttcttcatcaggctttctatactttgctgcactatcgcttcgttttcattgtccaaagcagaggttgcctcgtccagcagcagaaccggggcgtttttcaaaaacgctctggcaatcgctatcctctgcctctgaccgcctgagagagattcaccgcgttcaccgacaagagtatcataaccgtcactgagttccataataaaatcatgggcatttgccgccttagcagcgtctataatctcttcatcagacgcatttgttttaccatagcctatattttcttttacgctggcgtcaaacaaatacgcgtcctgcggaacatatgatatcatatttctcaattcatccgcggaataagaatctatgtttctgccggcaaaatatatctttcctttaccaataggataaaactccggcagaagtttaataacagtactcttccctcctccgctgggtcctacaagcgcggctacggtgccttcctttacactcagattaagtccgtcaagaacaggaccgctgtcatcataagaaaacgaaacgttttcaaacgctatgtaatggtcgcttgtatcgtcttccggggctatagccggcttgcgctcttctttgtcagtattcaaaacctcatgaataagctcagacgcggcaacgctctcctgcatcataccccaagcgcttccaaaattcaaaagcatactgcttacatttccctgcacggtcaaaatagcaaacactgttccaaaatctgtgtagcctttagccgccataacagctccgatagtaataataacaaaagtgtttataaaattaagaagatgacttatgctgtctatcgtgccgactctggcaatcctttttattctaagcccggcagttttccggttggtctcctcatatttatttataataaatccgtctgtatcatagagcttaataaccctgaatcctgctaccaaatcagacagcctgcttaaaagagcagattcagaacgctgaattttgcctccgatttttcttagcggctcggcaaacttaatgtttatcagaactgtaagtccgcaggcagctaatgaaataagtccaaggcggacatccataatcagaataaaaacacacgagccaagcccgccgataataccctgaaatatgttaggacaatggttggtatatgctcttttcatgttttcgacattgctgtttagcctgaatatactgtcagcactgtgattttgttcaaaatatccaaccgataaaaattccatatgtctgaacaaatcatgtcttaaatcaagcattatatacctaatagaacgcatattaaaataccggtccaaaacgtttatcaaataaacgataaccgcagcaactcccagccatatagaagaaataaaagcggcgtaattcagacttgtcacagaattaattacacctttattaagcaaggccagcattacgtctgcacaataacctaaagatatatccaatatcaaagttatccaatacgcatacttgtgttttcccatcagagaaaaacagctctttaatccgtctaaaactttcacagagcttcacctccctgctggctatgcacgttttgaagctttgcatacaagccgtcttttttcagcagttcatcatgactgccgcattcagccactatcccattatctatcactgcaatcctgtcagcccccttaatggtagacagtctatgtgccacaactaaaacagttcttccgatgcttaaattatccaatgccttctgcacctccgcctccgcctttacatcaagcgccgaagtggcttcatcaagcaaaagtataggcgcgtctttaagcattgctctagcaatcgaaatcctctgtatctgccctcccgaaagtctggagccgcgctcacccactatagtatcatagccattttcggtctccataataaagtcatgagcatatgcagcctttgcggcagctatcacttcttctttggttgctcctgattttcccatagcaatattatcatatatagaaaacggaaaaaggtatgcgtcctgagacacatatgaaatcaaagacctgacagcctttaaatttctgtcgcccatgtctattccgccgattaaaattcttcccgatgaaggccggtaaaaaccgcaaatcagtccaagaattgtgctcttgccgcatccgctggctccggcgaatcccacagtctcaccctttttaattgataaattaaggttttttaatacgggcttatcttcttcgtagccaaaacttacattttcaaattgtatagccggaacgtctccgttaagcgaagcagaaacttcgctgccctcctgttcagagggttcatttataattgaaaaaactctctccgctgaagcggacgcggatttaagattaaaaaacatagaagacgcacgcataagcgggctcagcgtctgaccgagcagtgatgaaaacgctatcagtgcgcccaaagtcaaactgcctttgaaacacaaataacctccgaaaaccagacaggtcaacgttggtatattgcgcgccaaattaaaaataaacgaacctttatactgacacttatcatttttaagcgccatattggttgcgcgctctatacccgactggtatttgtcagcaagagctctctccatattataagacttaacaactgaaattcctccgaccatatcggcaacagtgttgctcaccttacccaaatacttcatgtatttttttgaaccaactctaaacggtatagcaaaactggctccaagtggaatcaagatcggaagagttgcaaaacacgctaaaaacaatatcggattcagccaaataagataaatagcataaaacacaatagtaaaaggaagctgaataagctgtatgaagtccccctccataaagctctgaaccgaatcggcgtccgtactcatttttgaaagaagctctccgctcctattagagttcatataacttaaaggaatttgcgaaatatgtcttgcgctgtctctcttaacatcacgcatcacgctggaagaaaaacgtccggccgcatatctgctcaggaaaatacaaaccataacacaaataattattaaaacggcttttaagaactcaggcaatatgccgttcacattcccgctctgagctaaatccacaattgctcttaatatatttgccttcattacctcaaggaatgaaaaagaaacagttgcaagcacggcaaccaaagcccacggaaaatatctgcgggcatagaaaataatattcttaaaaattttaggatttgatttctctttcataataacaatatattatcactatcccattttattgtcaaattaaactaaacccatttataaaagattaaaagccgcagttacgcggccttttgggaagaaatcaatttatttaattttttaaattaaatactaattaatacagctataaacaaagaaataatcagcagtcataatataaaacaccaattatttattgcttacttatacttattataaatcaacaatttttgatttaacaggtccagatgaaaaaatttttataggtccagtttgtatatagaaaaatatccgcgttgactgtaaaaaaataaagtggtataattatacaataaaaaagtaaaaatagacataatatcttaactcaattcaagcaaagaaggtgagagaatgaaagacgtaaaatacaaaattgacaaaacgcttagcactccactgtatcttcagctttataacgcgtttaagaacgatatagtatccggcagaattttggataacgaacgtcttccctcccgccgcagactgactgaagttttaggcctcggaaaaaacaccgtagatttggcctatcaaaaactaattgataacggttatgctatctcacagcccagaagcggatattttgcgagaaaacaaagtcctataaacactgacatctttgagccggatttttatgacctgcatggaatcagttttaacatgagccaaaacggcatagatttgccgtctatcccaaaaaacactctggtaaaactatatcgtgaaataatttacgacaagccggagctatttgaatacggtcataaatatggagaaaaatcactcagaaaagcagtggcgcactatttatatgaagttcatggaatatcatgctcaacagaccaaattataatcggcgccggcagcgactatttgattgaacagctatcacacatatttggcagcagcacagtatttggatttgaaaatccgtgctacgcgcgaagttatgtaccggtcaaaaattccggaaaacaaactactctgattaacgtaggtttggatggatttgatgcagaggacttatataaaagcgatatagacgtattatacatctcgcccgacgggcaatttccaacgggttatcgtatgacagcggcacagcaaaaagaaattttagactgggcaaacgaaaaacctgaccgctatataatagaagccgattttgacttagacttttccgacaaaggcggtctcgacccgctgtttctaagagatacttccgaaaaggttattttactgaactcgttttacaggtcaatagccccgtcaataaaaacggggttcctggtactgcccaaaaaactaaaagaacgttttgatgaacgtatgccatactacacaactcttaaatcaagaattgaacagcaggttgtcgcccaatatatacaaagcggaaaataccagcgtcatctcgagaagctatataatatatatttgtctaaatcgaaatatcttaaagacaaaatcaactcgtgttcattttcaaaatacgttactatacatcaccaaagcggcggaactcatattatagtttccgttgataacggaatgactgagaacgaactaaaaatatcggctgctaaaatgggggtaaaacttttgcctcttacaacctttctgataaagccaaaccccaaacttccggcaagcacatttgtaatgggatacggtcaattatcggaagctgaaatagagcaggcgataacccggcttgacaaagcctgggcaaataaaaaataatctctgtccgttttagacagggattattttttataattaatatacggcttattttgcttactcagaagactatctatatactttgtatgtggctccatataatatttattattttactttttgaaaaaaatatttatatactatgtatatgaccccatataaaaaattttattattacataataatggtgtttgaaccatttctttttctagcaagaaaaagaaacgcttcaccaaagaaaaagtgctgctcgcttaggtcgcctgacggctccaaggggcgctagcccacgctcatttcatcatgaagccatgcttcatgatgaaaaaagccctactactttcccgttgactttgtgtactaccgtgaataaagataatccgagttactattgatttacttatcaaaaaagcagggttttcagtgaactacggcagggcgcatttatgcgcctcgttaggtgaactatcatctgaatacgtagtattcaatatatacaaaaatttaaatctattttctagttttcaaactaccgtgaaaattgatatttcgagttactattaatttattcattaaaaaagctaagttttcaatctagattaataaacaaaaaagcaagtttttcagtgaacatcggtaggtgtgaccccacctttggtgggtgtgatacaaagtgacttattttactatagccttcaacgtcaataatatgaatactcaaacgcggctatgccgccgcgttaggtgagccattatctgaacacgcagtgttcaatatatcaagaaaatattcataaaaattaactttgtatataaccccatataatacatagtatatttatacttattttatcttctgttcgagtttattaaatatttctgacgaaaaaaactcttccaaagtcatatctaatccatcacataactttttgattaaaacgatagaaacatttctacgagtttcgtcaaacatactataaaccaacgacactataatattttttattaaagtataaaaaataaattttataattaataaatataaatagtttagtttagtttagttttgttttgtttagttttgtttagttttgtttatataatggtctactatcttgattactatatgaccaactgtattgcatatttttaattaactttttgctcattctataatttgtctgatgaccctttaagcattatctatggaactgcgtcaaacgccaaactcatattatctccaattttaaagtaagccggttctgttattgttatattaatacaaactttaaaaagtttatataaataatttatatttgattcctattcaaaaatactttccggatacatttttatttcattagttctatttaatatgtaatcagttgaagtattgtaaaagtctgctagttttattaaaaagtgtaacggtatagtttgaaaacctcgctcacaacgagagtatacagtttgttgtattcctaataaatctgcaatttccgtttgtttcaacccagcattcatacgcagaaattttaatctttttaaatacatttgaccactccatttatattcttatttatcatcttgtttatcttcatcaaaatagaaagaaggcaaattaagattaagcaagtcgccgggtttaacctccaaaatatcggcaatattaaagaaaacttctaaagaaaatgaagaagttatattaggggcttcaatagaacttaaatgtgaacggctaatatgtgctttctcagcaagttcatgttgagtataacctttagcctttcttaaagctgaaatcatcaaccccagttcaacaaaacggtctctgttttcaaaacctgcttctttacgcattttatatcctcctagaaaatgaattaatttggtttgtatattgaacactgcgtgttcagatgatagctcacctcacgcggcggctatgccgcgtttgagtattcatattattgacgttgaaggctatagtaaaataagtcactttgtatcacacccaccaaaggtggggtcacacctaccgatgttcacggaaaaccctgtttttctgataaataaatcaaccggaactcgtaatatctttattcacatcaacacacatactagaaaataaattaatatatttattaatattgaacactgcgtgttcagatgtttgctcacctaacgcgtttgctatcgcaaacctaccgatgttcaccaaaaaacctgcttttttgtgtaataatttaaactaaaaactttgttttttgataagtaaatcaattggaactcgaaatatctattttcacggtagtacacaaagtcaacgggaaagtaacaaggctttttcatcttgaaacgcagattcaagatgaaattagcaggggcgagcgccccttggagccgcaggcgacctaagcgagcagcactttttctttggtgaagcgtttctttttcttgcgagaaaaagaaatggttcaaacacctattataagtaaaataatatatattatatggggtcatatacaaagaaaagctcttatatttaatatatcaacccagtcatataatcaaataatttattgaacttattatcatcattcaattttatatatctttatatttcgttatattaacttataacaattttcttttagaaagtccatccaatataccttgaatataagaagctctacactcttcaaacattttcaatctattattttctataaattctataattttattacattcttcagcatttaacttttgtggatttgagcattccaaaacttgacgtaaggtttcatttgtttgttttattttttcttcattatttattaagtcgctatattttttactttctttttggagtttatataaaattttatatatatattcatccaattcttcatcaaaaaaatccccgataaattcagttatatttatattatccattaaaaatcctcttttcttgtgctgacagtatttgtatttaagatatttatatatattctacaagatttataattttaatttttttacttctttttgcgtatttatagctttgtcttgctccgcctttatcatttcttacatacgcaaccataaaatcagattcatcaatcattatacggtttcttttttgtattgctgatttatagtatacctgttctaattcaggatatattatctcatcatattttttatgtagatattccatattattactcagatatttagtcatataaggaatatataaaaataatttaatatgaggatatgatttttttaattcgcctatagcagactcacacagtctatcaaattcacccatacctccagaaataaacgtatcaacattacgatagttaattaaatattcaatagtttcaagtaacaatacaacaatcgaatttggtacttcccaatacctcccatgaccacaaaaacaacatttcatattatctctccttttaatatttggttacgcatttgcgtatattataacatagtttctaaaatcacgcaagcgcgtatacgcacaaatgaataaaattgtaaaatttatatgaggtgataatatgaatgcaaaagatgcagttgttaaaagattttgggaattatgtgaaaaagacaatataaaaaagaacgaattagcaagacgtgctggtatttctccttcttcagtatatagtttatttaatgataaacgtagagatgtatctattttaacaattaaaaaattgtgtgacggtttaggaatttctattaaaaaattttttgattctgatatttttgcaaatctcgaacaagaaattaaataattttttgcgccttacactcgcgtgcgtatacgccggtgaatataaaattttataattttattgaggtgatttttatgaaagttaaagatgcggtagttgagagatttaaagatatatgtgaatataaaaatttaaagccaaatgaacttgcaacaaaggcagaagttacgccttcgtcggtttatagtatgtttgacgaaactcgcaggaatgtttctatagtgttaattaagaagttatgtgatggtttggatatgactttggaggagttttttacatcagaaatatttaataaactcgaacaggagataaagtaaatatactatatgtatgacccatataaaaaatatataagttgacataaaaaaagccggcttccattttggaagccggcaatatatccccttttattcctctatttgtcttacctcaacaatctctccgcctgtcgtcgtatacttcgactgcgcattaaccgttgagccagcgcctatatacctattctcgttcgtataaaaacctaagctgttatactttccgtcaacctgaatagtcacatatacatcatacttcttcggcacaataagacttttgtatgtaccgtctactaaacttacttccataacggcatcctcagagcgcacacccgttacctctcccatatattcctttgtgtcctggtcatatacaggtccgccttttttaaacgcgtcaatcgtaaaatccctaactccctttaccttgtatacatactctatcttcgccttctctgatgaagaaaccgcgtcgctgtttgaagtgaacttcgcataaataccaaaggcaagaacgataacgcacagaacaacgattatgtcaataatactgatttttccaaataattttccatcttttgcaaatgtactctttttcttcataatctctatcttcctttcctaaaatatttacactactcgcttacgttcagctgtgtgacaaaaccatatccagcccagccctttgaacgaaccgcgtctgaatctccaacccttatcggactgttgtttatgtttatctgcttcccggtgtctaccgcgtcagcttccatggttacataaatgtcatacttcccgggtatctcctgccactgtgccgttccctgattcaaatcatacgccaccgtttcagccggaacaattctcacatctgtaaccgtagccggcatcttttccttaacgccaacagtaaccttgtcgccgattttcggcatctcggtcaaatattcttccttgttggcaaattcaacttcaaacgttgctttaacatttccgcctgccgattttccgcttgttccgccgcccatagtggacaccaagtagtaagaaccgactgcaataatcgcggcaatgaccaaaataattataaagtctattgcgttaaactttgctttcatatctctttcctccaatatataatagttaattttataccgtttaattaagcaatttcaaatagatatcttcaatccttttggtgttcacctcggcggtaaaacactcgttatatatctctaaacttctcttgctcatactttcatacaaactctcgtccgtcatcagcttctgcaaagcgtcagccatagcggcagggtcctttataggaaccataaacccgttttcaccatcccgtataacaccgggattaccgccgaaatcggtaacaaccgccggctttcccaaactcattccctggagcagtgaaagactggtagcttctgtaccgaatgaacaattagcctgaatatccatagcgttcatcaaaggctcaacatcatttaaaaatcccagcatcttgacagttccaatcaagccctcgtttttaatctgacgtttcagcgcctcagctgtatctcctgtaccggctatgagaaactttgctttaactccgcgctttttcaaaatctttgcggcttcaataaaatatctgtgccccttgacctcggtcagtctcgcaacaattgcaaccgctttttcatccggctcaatcccaaatcctgacctgactttttgtatatcagccgccggcttcaacgcttcaacgccgtttaatacaacgtctattttatcagcgctgacgcccgtggcggtcagattatcctttgccgcctcggcaacagctattatcctgtccgcggtatgattattaatccagccgtttaccgctttgccggggccctgagaaattttccttgacggctcaaacacgctgtgcctggtatagactgtttttatacggcactgtttggccgctatcctggcggacatgcttgcgtgagtatgcacaatatcaggctttatttccttaaacaattttttcaggcttccaatagccttcatatccagcgatttttcggccaggttgtccatttcataaaccttaacccccaaagcttccgcctccggcttcagcagtgagttcttaggcaggacaacagaaacgtcaaactgctttctgtcaaaatatttgagaaaagttattatacactttcccgctcccccgatattcgagtcagaggacacctctaccacttttatcactcttcctccaccgcctttactgctgattcctctttttcgcctttagcgatatacacggcggcgataccaagagcgagcactatccaaaatattaagaatacgcggtaattatagaagcagttatcaaacattccctgaacacagaacccggcaactcctgcgccgattgctacaatcattgcgcccagcttactgcctttgccggatgttgactgataaccgttaatcagcttcttaaagaacataacaatagtggttaagaaaacgcctatccccactattcctgactcgactaaaatctgcaggaacatattatgtgagtgaggagcaacgataccgctgtatgaatagaacggatataccgacttgaacgcctgagttccggggcctatgcccgaagcccaaaaatcttttaccattgccagcgagccataccaaatatatactctatacgaggttgacgaatctttcatatctcctacgctggcaattctgttaataatactttccggcaaaaccataggcaggaacggcaaagctatcagcgccaatccccaaatctttccgcatacaaacgtaacgaacagacctgcggttatcatgaaaccaatccagcatccgcgcgagaacgttaatatcagagttgcaaacataatgcctgccatggctatatataccagcttagcaagtttttttggcttctgccaaactaagcctatgcagaccggcagaaccaaaaggatatactcacccaaaacattcgggttttcaagagttgaataaactctcatttttatatcgctgaacatttcctcatcaacccatgcggcagacgtatcccagccgaaaatatactgggcaacgccataaaggcagaccaaagcgcctgaaactgcaaacactgtcagcacgtcaaacaactgtttcctggtcttaacagtgtttataacaacaaaataaaacgccataaacaacagataaattccaaaaatactcaaactgttaatcacagcaaaagaattcaggctggcaaacaaatatacagccaggaacccaagcatcaaaaagcctacgccttcaaaacgccatttaaagtttcggtctgacacagccttaacaagaactgaaaacagacaaagtcccacaagaccaactatagccatagtaggcatgagcggcgcaagaaatacagtcagataaactccggcctgaaccgacctgagaatgagaaagacaacaaacaagcctccaagtataactatcgtataaagcgggcttgtaaatccccctgcaactccggcggcaaacccaatcagggctgcaagccacaaacgtccgtttgactttgtaacgtccttttcaaaaatgtcatacttaaaatcaattccgctgagatgctcaattattctcattatccaggaacccgacaggaactcggttaaattagcattggcgacagacaaaacagctcctaatatcagcagtgcatataccagcagatttgtctgctctcctcctgctatcgcaggaacaacggctcccagtgttattccaaccagtaaaataccgatgaatctggtattaagcgccagaatattctttagataacagtcacagacttttactatacagcttgtctctatcttatttttcagtttttcacaatactttctttgaagccaagcgaaaaacgtaaacggagacctcaaaatccttgccgcagcaccgttccttaaaacatccgaagaaaaatgctggttacgaaaaaagttggttattctgcttcttttccaagcgcccgaaataccgtcgtacactttacggaggattttataaacaaagctctgctttatgtaaccccaaatgaacaaccaaaaggattgaaaatatcccatttcattcatatcctattaccattcctttctttataaagtatttttattaaaacaaatccctctaatcatgttttcttccaaaaataaacttcattcctatcatcatctctgtcactttaagaatccgagccaaaccaaaatatacaacacatgcaggcagtgaagcaacgcacagtttaactaaagtcattaccatacccgttcccaatacgccgtcgacagcaaggaatacatatttggctgttataaacgcgagcacaccgcagatgaaagttttcagcaggttcagcataaaagtgcctgttatcacgccttcacgcctcttgtttatcattataagcaatgctgcggcgattgccgttgagcttatagcgctagccagggccagcccttctattcctatatcaaaaactagaacaaataaagcggcgcacccgatattgactacaaccccaaaaattgatgtgaacattggcgtctttccgtcctgaatggcgtaaaagctcttattcaaaacctcgcatatagagtaaccgaccattccgaatgagtaaaagaatagtgcagacgcagttataccggtagattcagcggtaaacgctccgcgctcaaatacgactttaatgatagggcttgaaagtgcaagaaacaaggctgatacaatagtgattataaaaactatccagccgaccgacgttcttgttgttgacgcaaaggcttcattattgtcatcagcgttaagccttgataacttaggaaaaataaaattcgttatcgcgtaagcaaacactccaaccattataatatatatcttgtttgcccagtttagagcggacacagcgccgtttccgagacttgaaccaaacgacatatttataacgttgcaaagcggctgaacccaggagcttataagaaccggaagcgccaaaagcgctacctctttcatgctcccatctttaatattccaccgaggtttatacctatatccggtcttaatcagccatggaatttggaaaaacaattgaagagcccacgccgccagcattgatacagccacgcccataagccccagcttgtccccaaatataagcagatatgctatcataacaccgtttgatacaacgcttatcaaggacggaatagtgaactcaccatgcgactgcaaaattccgacaaccacataggcaatagcagtgaaagctatagacggaaaaaggacacgaagcaatctggcagtttcttcaaccttacccgggacttcagcatagccgggcaccatcattttaactataggctgggcaaataccgaccccaaaattgcggcaagaactgcaacagcccccactatagtgataaaattattagcaaaagcgtcagcgccggattttcccaccttttctaaatttttgttataaatcggaacaaaggtggataaaattgccacgcccagcaccatatcaaaaaataaaagcggaatttgggtcgcgctgttgataacatcggaagcatagccctgaccataaatcccggcaataagcatctctctgaacagacccataaattttgcaagaagtataagcaccgccataatactgattgacttaactgcctttccgccgctttcgctctttgtcatataaaattctccaattcaaattaatactaaaatataaacagtagacctaaatcagtctaccgtcatacattatataccagaatcgcctcaaagtcaatataacccagcacaaaaacacatactataaatacgttatgcttctatttactgagattatactgtttttattttgctgatttgttttattgaagtattttaaagagagactaaatttttaattgttatcagttataaaacaaatcaataacaaaaacattaagtttgatattatgagctttattgattattatattgttattattttaaagctttataacaaaaaacttttaattcattttttattttaagcctgttttaattatttcaatttttttagtataatgaagtattaaaagtttaaaatccgactagactaaaatgagatttcaatagtagattaaattagaattttatctgaacctgttaaacagaaaatataagaaactgtattgcaattacaaactgtaatcaaaattctttaaaaagacccataaaaaagctgtcaaaagttatagtaattgcacaaacaacattttattttctacacccaaattgtttataatgttaatttataaaaaaaataaaattttttgaaaatttttcttgacaaattattatatagttgatataatatcaaagtcgcaaaaattgaacgcgggtgtagttcaatggtagaatctcagccttccaagctgattgcgtgggttcgattcccatcacccgctccacctttataaccgcttccacaatcaagcggttataacaattttatgcgcctgtagctcagctggatagagcaactgccttctaagcagtgggccaggggttcaagtcccttcaggcgcgccagctttttatttaaatatggtgggtatagctcagttggctagagcgctagattgtggctctagaggtcaagggttcaattccctttacccaccccaaatactgggccgtcgtcaagcggtaagacacagcactttgactgctgcattcgtaggttcgaatcctgccggcccagccattaaaaaactaaatatgactcattagctcagttggcagagcacttgacttttaatcaaggtgtccggagttcgaatctccgatgggtcaccaaatgttaagagaatgagacaagccctttgttattatggagtttgtctcatttttgtttattcgttaaaatgttttttataacttgtcagacaccttgattatttggtttttttctatttaaccaaggtgtctgtttttttagcttttttccttaaaatcttaatattataggagttaaaaaaactgtatacatatttataggcatacatccactaaatattttgtattaagtgacggctctcttgctgaactgcaaattatgcacagctcacttgaaatggtaagacataatattaacatttatcaacaagccttaataaaagattttttaaattgaaatcctttagatattaatgcaaatgttatagaggaaaaaaatcaataaaaatgaaagaagtgaaaaatatcataaaatatattttttgtattgcagcaaaataatatttatggtatatttaatttgttgattattttgtttagggaaaaatttaataaaaaagttttgtgtgctttgtcggttcaagttcgaccttaagaccattataaatacacaaggtataaatctttttattaagatttgaaccttttctattaaaattgctttaacacaatagaagtatatacaaaatattcttaatttggaggaacatattatgagcgatgaattaaaaattaaaatgtacgcatttacagtagactgtaaggaaccttacgaattagcaaagttttatgcggatttgcttaagtgggaaatagtattcaatgacgatgactatgcttgcgtgggcgctcctggaacggaacaaggcgcgtatcccggaataacttttcaaaaaaataccgattatcaaccgcctgtatggccggcggagcctgacgcacagcaaactatggcgcatttggatttcgctgttaatgatttggaaaagtctgttcaatatgcgattgcttgcggagccacccccgcaagcaaacaattctctgatggctggagagttatgcttgaccctgaaggacacccgttttgcttatgccaaatgaagtcattaattgaaagcgccaattttgccttgctgtaaaatttatggtataataaaaactcttgagtataaataccaattttaatatgttgatataatatcagagagaagtataaaattaatatattataaattctatcagtcggtactcttcttaattaattgggaagaaacgaattaaagttgttttataaataactcacggagtgttatacaatacacaattccggtgttttataacctatatgttttttatataaaacattgttttgcttatgtaaaacatgagagtgcagtcaaaagtgcggtcaaggacaaatacttattttattttttgtataatgaaaaataagaaaagcccaattatgagcagaattcaaaaagttagacaaaaatctaataatttgaatgcgcttcatttttgggctttttctatactataaaaattaatttttccagcgttcaagtgtaggaagataggcttgtaactcttttcttgctgtgtcagcagtgaaatcttcccctgtttctttgttccattctttgagatatttaaggttgctttcaatcatttcatcaagagttatatcatttgtgaacgctccgttttgataacaataagcgcagtatttctgagttctgcttccgtcagattcagttcccatttgttccggtgtttcaagcggcataccgcagctttgacatatcggatattcattcatataaaaactccccttttatatatgcttatttattttattcagccggcactgcctggtatcttcccataaatagtatgtcgccgctctgattgtccattattataaacgtaaacggtttatctattgtgaagtcaatcggttcaggcggtagagcagaaccagccattcctattgaagtcacagctgcagcttcggttcccctttcatcaacatttataaacgtcttatgtattacttcattaacaaacacgttttcgcccaaaggcagattgataatcatgttcttaaagtcagctgtgttttggttaaacgccgtattgattcccagttgttttaacaagcagtcaccgtttgtactgccgattttctcatcatattctatcttaaatttcggtatagacagatttatataattagaactcagttttgacagataattatcataatcgatatttccgccgttatccatactgatatacatcgacgttttgtttcctttgtatggaagctccactatttgaacattttcatcggcgtatgtatcataataacctctatcattcataaaatcagtctcggtccgcgtgccgtctgcattgttaaaaacagatttggcggtattctcagtcataaattcatactgccatggagctttaaagtatacggcatttatcagttctgccaaaaagccgctgtcttctattatagtgggtatttttccatttgtcttttctgacgtccagccgtttattctttcaacagcgtcatcgttgtttactgtttcagaagtgccgtaatagctgtcttttacaatggcttcaaagtcaggactaaacgccgcgtcgcttcctgcgtaataatctttattcagccatatagaatttgcaatattaaattcaacgctcttgccgtttcttaattcgttagaaagttttttgtattcttcaaattcagcgtcgctatagtcaccgttgtttaatttgtcagaaagctcattgtagcgtgcataatcaaaaccgccgctgtatttttcaatcaatgcttttgttgcggcattaaattcgtttaagtctttgatttttagagtgtcgagtatttcagcctttgtttcgccgtcagcgccgttggcagccatagccaaagcggtttttaccgaaagcggcgaaaacatatagttcttgctcttgtccattttgctgttcatattgtaggcaaaagcattttgactttccgggtttgctgttggaaccggagcggatgaaaccaccgggtggttattaatattcccgtctataagcaagaggtacatcgtttcattgtttgtcagctttaatcccatagccaaatctattacaaccgacgcgtctcttcttgttatgaattgttcaggctcataatcaggaataaatgataaaagacctagttcataagcattcgtcaaatactcttcagaagttttagccgtgctgatatccagtccgtttttatagtctataagtttaacagtcgctgtgatataatcaataaaccttactttttcggattggttaaaggtatttgtgtttgagtccaatatacccaattcgtacaggtggttaacagcagtgtccgcatatgagccgttttgctctgcagccgtgtacggcttgtatccgtcggcgcgtgccaaaataactgccatttcgctgttgattaattcatcgaaaggtctgaacgtgcctgtgtcgtcgcccatgataatcccggaatctgttaatctgtcaagagctgcattgagatttgtgtcaccgtaatcagaatcactgaaggttaaggcgaaagcagaaatttgtaatattgataacaaaaatattacggataatacagtagagataagttttttcatattatcactccttaaaatttggttatatattttagactcttataaatatattaggttcccgaaatatggaaaataagcaaactatttttgcccggttaattctttgatttttaatatttgtcctgagaacggcggcatatttactgaaatatttgtgtttccgtcttcggttaattctgcctttatttcagtggttccgattttcatactgccgctgtaaatatcagcctcagtgtttattataagttctaggctgatttcattttctatctcaaactcaaattcttcaacgggcacatcggaaaagttgagaaaaacaatgtatctgccgtcttcgccgcagcctcgttcgtatattgccagcgctctgtctttggttcccattttgtgccatgtgaaagacttgctgttatactcgccgttatagagcgcagaagtgtttacatatacacggctgatgtcgcgtatgtatcgcataaatgaatcatgaagaggatatttctttaaaaaccagtcctgttcgcgcttttcatcccattccctgaactgaccgatttcgtttcccataaaattcaatttctttcccgggtgggtgtacatatacatatataaaagtcttgcctgaggaaatttttgttcataacttccccacattttttgaataattgtagcttttccgtgaacaacctcatcatgggacagaggaagcaaataaagctcattgtagaaatatgccatagagaatgtgagcttgtttatgctttttgttcggtataaaggcggaagtttaaaaaattccagggtgtcgttcatccagcccatgtcccatttgtagtcaaagccaagaccgtcatattcaacgggagcggtaactttaagataatttgtactgtcctcggcaatcagcattattcctttatgacgttttttgagtccctggttcatggtttgtataaattttatggcgcactcgttcacgccgcgtttcacatcgccgagccagaatattgctcttgataccgcgtccattctgagaccgtcaaaatggtattccttcagccagtaattggcggcggactggagaaaactccgaacctcgcccctgccaaagttgaaattataacttccccattcgctgcaccccacatggtcgctgggatattcatacaaggcttgtccgtcaaatttgccgagaccgtatccgtcaaccgcaaaatggataggaacaaaatctaaaataactccgatatcgttattatgaaggtgatttatcatctgcatcagttccgcaggggtgccgtatcttgatgtgggactgtaaaaacaggtgttttgataaccccaggattcatctgccgggtgttcggttattggcataagttccacatgtgtatatccgttttcttttaaatatggaaccagcatttctccggtttcagtatacgtgtaccatgaaccgtcctctttttgccgccatgaagcaagatgaagttcatatatattaaccgggttgttatagcccacgtcacgcttagacatccattcatcatcagtaaacttaaactcatccagttcacgtataatagatgctgaacccggtcttagctccatgccgaatccgtatgggtcagaatgttcaacaaattcgtcaggagtggaatagacccggtatttatacatcatattgggttttacatcggcaaaagttccttcaaaaaaattactgtttttaggccttataaggtcgtattcgagccagccgttgaattctcctattagtgtcacacgcacggcacgaggagcatacactctgaatgtataccctgaatctgctttgtgtgcgcccaaatatgtataatcatcaaaggagttgccgtcataaaagtcttttaggttaaataattgattttccatatatattatttatacagctatatgctgtatttcctcctctcgcttttaattattatataaaattattttaaattaagaaaagcggaagatactgtgtttccgcttttgtatgtataaaacatgttaaaaaaagataattttatttataaaaacgccataatagacaaatgtctattatggctatattatagtatatatttatatatttttcaagcgacaatataaattatttgtatattatcgcaaaaactgagatatttattttcaaatttcctatatttataagttgttactaaagatatttaattcattatatccaatatccgattctctttgcatataaccccatataatatatattattttacttataataggtgtttgtaccatttaattattactcaaaagactggatttgtagtgaacatcggtagggcgcatttatgcgcctcgttaggtgagctatcttctgaacacgcagtgttcaatatatcaagtaaatattcataaaaattaactttgtatgtgaccccatataatatttattattttacttataataggtgtttgaaccatttaattattactcaaaagactgggtttgtagtgaacatcggtagggcgcatttatgcgcctcgttaggtgagctatcttctgaatacgcagtgttcaatatatcaagtaaatattcataaaaattaactttgtatgtgaccccatataaaaatttttattattacataataaggtgtatgaaccatttctttttctcgcaaaaaaaagaaacgcttcaccaaagaaaaagtgctgctcgcttaggtcgcctgacggctccaaggggcgctcgcccacgctcatttcatcatgaagcatggcttcatgatgaaaaaagccttactactttcccgttgactttgtgtactgccgtgaataaagataatccgagttactattgatttattcattaaaaaagctaagttttcaatctagattaataaacaaaaaagcaggttttttagtgaacatcggtagggcgcatttatgcgcctcgttaggtgagctatcatctgaacacgcagtgttcaatatataagtcattatattatactaaactaattatttttattttcatctttaaattgcttttgtattcctaaaatatcattaattaaatatatcatattattttgtaagacaggttctaaattaaagaacaatcttatcagttcatccaagtcttgatttgctgcaaaatcgttattttgaaacgcaaaataacgagggcattgagtataagtacattttaagcatttatctttataatttttatcaatacaacagagtaaaaaatcgcattcgttacaacagcacggcacaggttttccgcctttataaaaatattttccattccctaaacaatctttccctaagtttcctggggtcaaaactattcccgtttcatcaataatcatttgcgacactccattacttataaattccacatgacatgacttatattctacatgccattccatggcaacaaataaaaaaatcaaatataatataattaatttaaaagtaaatagggagaaaacgaaatgtttgaggattatataagagaaagaataacagaattgagaatgagaaaaaatgtatcagaaagatgtatgagtttagatatgggacgttcacaaggatatataaatcatataacatcaggaaaagcaatgccatccatgagcgaattttttgaaatatgtagatatttgggaatgtatgtgatattatggtgatataactataacacaatttatgagttttccgtattctttttttctctttgtaacacatctattgtaatcctacaattttgtcaattttttgattgttgccatattgacaatcaataaacatagttgtataataattgaatagccacgttgaaatggcgtaatatccggttcggcgtgaataataaattattagtaagggagatgtgtttatatgatgaaaaacggtgccgatatagttatggaatgcttgctggagcagggggttgacacagtctttggatatccgggcggtactattttaaacgtctatgacgcattttataagtactctcataaaataaagcacattttgaccgctcatgaacagggagcggcacacgcggctgacggatatgccaggagtaccggcagaacaggggtatgttttgcaacatccggtccgggagcaacaaatttggttaccggtatagccacggcctatatggattctattcctcttattgccgttacttgtaacgtcgccactaactggctcggcaaagatacgtttcaggaggttgatattgtcggtgtgaccatgccgataaccaaacataactttttggttaaaaaggcttccgatatagcgcctacttttagaaaagcgtttagaatcgctgcttcgggacgtccgggaccggtgcttatagatataacaaaggacgctacggcggagcttgctgattatgagaaaaagatacctgagaaggtagataattataaaatagatagtgaagtttgtgattttgaaagagcaataaaacttattgaagaagctgaacgtccgcttatatatgcgggcggaggaattatttcatctgcggcgtctagagaactgtgtaagtttcaggaaatgctggacgcacctgtcacattgtcattaatggggcttggggcttttccggccagcaatgaagcgtttaccggaatgattggtatgcacggtacaaaaaccacgtcgctggcaattaaaaattgtgatttactgattgcaatcggcgcgagattctcggatagggttatttgtgacccggggacgtttgccagaaacgcgaaagtattacatattgatgttgacagcgctgaaattgataaaaatatcaagactgacgcttatataatcggagatgcaaaagcagttttggatgagcttaacaagagcttatcaaagcaaaagcatcctgaatggatgaaggagatagcagagtggaaagctgagtatccggttaaatataagggcagtgagaaattttcacctgaggatataataaaaacaataaaaagtgcagtagatgaagatacatatttagttacagatgttggacagcaccaaatttgggcagcacagttttttgatgttgataagcccagacattttgtcacatcaggaggtcttggcacaatgggattcgggcttggagcagctataggaacccaggttgcaaatcctgacagtacggttataaatataacgggtgacggctgtttccacatgaatctacaggaattgtcaactgccgctaaagaggagcttccggttattgatgttgttatgaacaacaatgtattgggaatggtaaggcagtggcaaaggctgttttatgataacagattttcaaacacaacacttaataagcgtaccaattatgacaaggttgccgagggtttaggagccaacgcttttacagtttcgaatgttgaggagcttaaggaagctctgagcgaagcgcttaaatcgaaagataagccaacggttattaactgtttgataaatcaagaccatacggttctgccaatggttccgggcggacagtcgatagaggaaccaattcttgaaatcaaagaagacggcggggaggtttagtattatgagtgataataaagagatgcacgttctgtcaatttatgtcgaaaaccatgcaggtgtgctcagccgaatttccgggctgttctccaggcgcatgtataatatagacagcttgtctgtgggtgagacagagaatcctaaaatttcacgcatgacaattgtcacccatgctgatgacaatacattccgtcagatacagaaccagttggcaaagcttgaggatgtaaagcgcatatgcgagcttcacaaggatacctctgtactgcgtgagcatgttttgataaaggttaatgcaaaagattccacgtcaataatgcagatgtgtcagatattcagagctaatgtagttgatgtatcaagggagcttttgacgcttgaactcaccggagggcccagtaaaatcaacgcatttatagagctgatggagcagtttgatattgagggcttggttcgtaccggtctcaccggtctcaagagaggtaagtccgaaagacctgaagaattgaatcagaaaaacaattaattttaatatacactgtataaataaaagatatttggaggtatttacaaatggcaaagttatatcacgaaagcgactgtaatttgggacttttaggcaataagaccgtagcggttatcggttacggaagccagggtcacgctcacgcgctgaatcttaaagagagcggagttaatgttattatcggtctttatgagggcagcaaatcatggaagacagctgaggaagccggatttgaggtttatacatcagcagaagccgctaagaaagctgatattataatgatacttatcaatgatgagaagcaggcaaacttatataaagaaagcattgagccaaatttggagccgggaaaagtattggcatttgctcatggtttcaatattcacttccagctcattactcctcctaaggatgttgacgttatcatgattgctcctaaaggtcctggtcacacagttcgcagtgaatatgttgcaggcaaaggcgttccttgtcttgttgctgttgctcaggacgctacaggaaacgctatggatataggtttggcttatgctgccggtattggcggagcaagagccggagttcttgaaacaacatttaaaatggaaacagagactgatttgttcggtgagcaggctgttctttgcggtggcgtaaccgctttgatgcaggcaggttttgaaactttggttgaagctggctatgacccgcagaacgcatattttgagtgtatccatgagatgaagcttatcgttgaccttatttatcacggtggattcagcgagatgagagcgtcaatttctgatactgctgaatatggtgattatgagattggaaagagaatcatcaccgaggacacaaagaaagagatgaagaaagttctcacagagattcaggacggtacttttgcaaagagctggataacagaaaatgctgttaaccgtccgcacttcaacgctacaagaagaattaaagctgaccatcagctcgagcacgtaggcgctgaaataagaaagctgtattcatggaatgatgagaaataatttcaggaatacttatataaagtaaaaacagagggtttttacagagattgttttgtaattataacagtctgtgaaaaccctttttggtacataatagcggattaaattgcctgacagatatggtggtgaaacggcttggatttaactgacagacatattggtaagaacatagaggtatttgattctactttaagagacggcgcccagggcgaggggataacattttcggttgaggataagcttaatatagtaaaagccttggattatgtgggagccgattatattgaggccgggaatccgggttccaaccctaaggatttggaatttttcaaagaaattgatttaggttctttgagacacgccaagcttgtagcatttggttccacccggcgtaaagatataaaagctgaggatgacgaaaactgtttgtcattattgtcggcggaaacagaagcggtggctgtgtttggcaaaacctgggatatgcacgtaactgatataatcaagaccagccttgatgaaaatctcaatatgatttcggatactgtcgcgttttttaaaagcaggggcaaggaagttatatttgatgccgagcattattttgacggatttaagagaaacccggaatatgcggttaaggctttgatggctgccgcggaggctggggctgacagactggttctctgtgaaactaacggcggatgtctgccgtttgaagtagctgagattactgcggaaacctgcgatatatttaaagacagcattataggtattcactgtcataatgacagcggctgcgctgtggctaatactgttgcggcggttcaggccggtgcagaacatgttcagggtacgtatttgggatatggagaaaggtgcggaaatgcaaatctttctactattatacctaatcttcaaataaagctgggttataattgtgtgcccgaaaaaaatcttgaaaggtttaccagaaccgcgcgctggatttcagaggtagctaaccagcctttatacagaggtatgccgtatgtcggcggttcggccttttcacataaggcgggtatgcacatagacgcagtcacaaaagagtcgtcatcttttgaacatgtggcgcccggaagcgttgggaatgaacggagatttttgatgagcgaggttgccggccgcggcacggttcttaaaaagatacagaaaatagccccggtgcttacaaaggattctgctgaaacctctgagatatgcaagcgagttaaacagcttgagtatgaagggtattcgtttgaggcggctgaagccagctttgagcttttggtcaaagaggttttgggtgagaaaaagaagtattttgatttgaattattttaagacaacagttgaccagcctaatggaaataattttagttcttcagctattattaaaatcactgtcggagacagaactgagattacggcggcggagggagacggacctgtgcacgctttagacggggcgcttagaagggtgcttgaaggattttatcctgagctcagcggagttcatctgacggactataaggttcgcgtgctggagccgcagaaagctacgggcgctaaagttagggttttgcttgaaagctccgatgagagcggaagctggactactgtcggagtatccacagatgtgattgacgcgtcttggattgctctagttgagtctgtggaatataagctgatgaaggaagaagaaaaaataaatcaggaaacaggaggttaaagatatgggaatgacaatgactcagaaaattcttgccgcacatgccggtcttgacaacgttaaagcaggacagttaatccgtgcaaaactggatatggtattgggaaacgatgttacgactccggttgcaataaaggagtttaaagcggcaggctttgaaaaagtttttgataaggataaagtgtctatagttttggatcattttacgcctaataaagatattaagtcggcggaacattgtaaaatgtgccgtgagtttgctgttgagagagatgttactaatttttatgacgtgggcgaaatgggcgttgagcacgcactgctgcctgaaaaaggtttggtggctccgggtgaggttattataggagccgactcccatacttgtacatatggagcggtgggcgcgttttctaccggggttggttcaacagatatggcagcaggtatggctaccggtgaggcttggtttaaggttccggctgctttgaagtttaatcttaccggaaagcccggaaagtggatttcaggcaaggatgttattcttcatataattggaatgattggcgttgacggagctctttacaaatctatggagttcaccggagacggtcttaaatatttatctatagacgaccgtcttactatggcaaatatggctatagaagccggaggaaagaatggaatatttgaggttgatgatataaccgaggcttatcttaaagagagggttagccgtgaatatacagtgtatactgctgatgaagacgcagagtatgagaaggtgtatgacattgatttgtctgagctgaaaccaactgttgcatttccgcatctgcctgaaaacacaaagacaatcgaccaggttggagaagttaaaattgaccagtgtgttataggttcatgtaccaatggcagacttgaggatttggaaaaagcggctgaggtatttaaaggaagacatgtagcaaagaatgtcaggactataattattccggccacacagaagatatatcgtgaagctatgaacgagggtctgtttgatatatttatggacgcaggctgtgtaatttctactccgacttgcggtccttgcttaggcggacacatgggtattctggcagagggagaaagagcgatttctacttctaacagaaactttgtgggacgtatgggccatccgaaatccgaggtttatttatcaagcccggtagtggctgcggcttcggcaatcaaaggttatatttgcagtcctgatgaattatagaaatatagattgatactataataaggaggttttttcaaatgaaagcacatggaaccgtccataaatatatggataacgttgatactgatgtaatcattccggctagatatttgaattcgtctgatccgtcggagctggcggctcattgtatggaggatatagattcagattttgttaataatgtgaagcagggagatataatagttgcacgcaacaattttggctgcggctcatctcgtgagcacgccccaatagcgattaaagcgtcgggaatcggatgtgttattgccgctacttttgcccggattttttaccgtaatgcgataaatattggtttgccgattatggaatgccgtgaagcggcagaaaatataaatccgggtgatgaggttgaagtggattttgataccggtgtgattaaagatataacgactggcaaggagttcaaggcggaaccgttcccggaatttataaaagacataataaataaaaacggactgcttaactctataactaaagagaattagtatatatattagcggcggtattagtcattattttatcagttgggttttgccgccggaataatgaattattagattttaccattacagaaaataaacaagcatgataagaatgcggcaaaggctgcattagtgaatttgaaaggattatgatgtcagatgaatattaaattagcagttgtaaaaggtgacggaatcggacctgagataattaccgaggctgaaaaagttttagataagataggtgaaaaatttggtcatagctttgaatatactgatattcttgccggtggctgtgctattgatgagacaggaaagcctcttcctgaggaatctgttaaaatagcaaaggagtccgattcggtacttttgggagctgtaggaggaccaaaatgggatactctccctggcaatctaagacctgagagagcgcttttggggctccgttcagaacttggactttttgctaacataagacccgctaaactacatgatgcattggcagacgcatgtccgttaaagccggaaatatcgaaagacggacttgatttggtgattgttagagagcttaccggcggattatattttggcgacagaggaagacgtcacagcggcaatgatggtgaagaggcttatgatgagttaaaatattctgaaaaagaaattgaaagaataggcagagtcgcatttaatcttgcaatgaagcgtgacagaaagaaagttacaagcgttgacaaggcaaatgttattgagacctcaagactttggcgcgaagtaatgcacaagcttgccaaggagtatcctgctgttgagtttgaggatatgctggttgataactgtgctatgcagcttgtcagaaatccggctcaatttgatgttatagtaactgaaaacatgtttggtgatatattgtctgatgaagccagcatgacaacaggttctataggtatgcttccatcgtcttctttgggagttggcacttttggtatgtatgagcctattcacggaagcgccccggatatagcaggtcaaaataaggctaatcctattgccacaatattgtcatgcgccatgatgcttagagacagttttggacttatgaatgaggccaaagcggttgaaagcgcggtaactaaagtgctgaacgatggatacagaaccgctgatataatggatgaaggcggaaagctcctgggaactaaagaaatgggcgataagattgttgaaaatctttagtttttaatttgtttagaaataaattaaagttgtagggctgtaaaagaataaagtcgtgataataaatcatacaaaaaactctataattgcgcgaaaacagcgctcttttcaaggtcaaagcctgaaaagagcgctgttttttgtacaatgtttttgaaaaatatagtattttatatcccatttttgatttaaatacagtaaaaaatagggaaccgaattccggttccctataaaatttatgaaaggaatgaatttttaatctcaaatgctgctgacaataaattatatcagtttgtctatgcttccgagattataaacgtttgtaaatcccatttcttttgctgttttcagtgccttttcagctcttgagccggcgctgcagtagaaaatcaaaactgtgtctttgctgtaagccgagagaccttcttcaatcgtgtcgaccggaatatttactgagccttcaacagacttttctgcaaattcttctgcagaacgtacgtcgacaaatattccgccattatatacgagagtctcagcttcatcggcttctatggaatctccgcctatgtcgctcatgttgatttccatatttttatttccgtcactaacgtacattatgccgttttctattctcatctctttaatatctatgtccgcagctttttttagcttgtagcacttcatgcaatcagtgaaaactataactaatccatcatcgcatcctgcataaagtctgcccttatattcagctaaattgtttatggtgaacttatctccatattgaaaatctatgtcagattcatagaaaaagtcagtgctgagttgcatgcgaatgccgcctgcagctatagtaaatacttttgtttcgccggttacatcgtttttggtaagaaccacgtcagtgtttccccattttgtgaactgtacaggtctgtcttcaccggctgcttccgtatcgttattgttggtgttagaatcttgtatgctattatcatttaattcggtgtttgtgttcgaagccgaagttccataatactcaacaattattgctgatacaaacttattgcttccgcttccgtaagtataaactggtgtggatatatcggttatttcagcgctgaaagctgtctttttaccagatacagatcttccggttgccagtttaacaccgttttgaacaatatattgttcgcgtccttctccgccgtcaaataaaactgttactttacatggagctttaggagtgaagtataaacagcgctgagtttcgtgtcccataccgcctttccaagctcttgtgaagctatagtcataagttttttcatttacatccgtatatgtgtatttacagctgctggaggaattttcaagtgaactgtatccgcttaaaccattaactgttccatagggctcaccatctgttgaatttgatggactggttaattttgtatagtcgtaatccttgctgtcaagtgaataaactactatttcgctgtcagccggcgttttatatgttttttctgttttttgactgagcggtttcatttcattcaagctgttccatataaataagttgactttatcgccgtctttggctccggtagaaatttcatattcacctgagccgttaacttcagttgttaacatatttttgagagcgccgtcagggctgtaaagcgctgatatcatagtaaccggagatgacagtgtgctgccgcggtagctcagtgtcactttcatatttccgtttgttttgtttaatactttatcgattacgtatggttcatcgtcattgttttctatataattcattctaaagtagtccaaattggttccgttagtctgaatatagacggttgcgcatccgtatttgtcaagctttccatttaacagagcgtcattcagaactccgtggtcgagatttaattctgcctcggaccatttattccaggctcctgtagctggtacggaagctgaggcaataaggttttctgaattcttatttttatcgagacttacgtatattgttccggcatttttgcccgcatatctcacttttagactgtttaaattagaaagtttaatcgacttgtattcaatccatgcatctcctgtgcttccggcgtcaagaccgccgctggtaccggattgtgcatctgtcaaatctgctccgttaccgttatcggcatattcgccttcaacttgcatattgatttgaaccattagaaggccgcaggtcattgattcaatattggctgctgttatttgaactattccgtttccgtatacagtaagaacacctgtctcgctgttaatgtcggcaacttttcgaattgagttgtcaaatttctgtatctgccaaacgagttttgaattatcaatagcattgccatctttatcataagcttgaagctgtattcctgtatatggagaagcgttcgtaacagttccggctgctccgtcataaattggtattccgtcttcgcgataatctataacgcctttttctatatattttggattttctgatataatgctgtagtcattttttagattatccataggtattgaattcaggtcgttgattgctttagcaagtgttgtgcttaaatcatcttttgttgtgactgcatctaaagcggaaactgcgttattgtaaatatcgtcaatctttgcaagattcgattcagaataagcctgtctgggaagtttatcatatgctgttttgaggtttgctttcgctgcagctatttcttccatgctaggtctaattttcagttcatttacaactgtgtatgaatctgattttgtaataccgtttacagtgacagatgcggtaattgttgcgataccttctgttacccctgatgttactataccgttagcgtctactgccgctatgtttgaatctgaactttgatatataacatctgaatttttaaggtctacccatacttcatctgtcattatagcagaaagttttgagtcgatttttgttatcgattccaaacctgtaccatcttcgcggattagaccgtgtacggttataccgtccggcatcgtttttacagtttttagagttgattcaagggttcctgtaacgttaaagttttttgttaaagcgttggcgtcagaagcatttttaccaattattgcggtatatgtgccattaggaacatatgttttttgatccttttcactgaataagtttaagtctttaacatttaatttaaattcaacagttttgctttcgccgggagctaactctattttttcaaatcctttaagctgtttagcaggtataattgaatctgtttgcggatgtgaaatatacagctgagcaacttcttttcctgatgtagttccggtattttttatatctgcgctaaatgttaaattcccgtttgcatctgcattttcggaggatattttcatatttgaatattcaaaatttgtatagctgagaccataaccgaatggataaattgggacgccggtataatattgatatgtatggcccggattttttccgtcactttggatattgtagtctgtatagtatccttcaatgccgtcaatagtctttttggttgagtttgcaagttccatttttgaaatatcggcatttttataccaggttgatgaaagtcttcctgatggattaatctgtccggtcaatatttttcctaatgcagtaccttgtgtctgtccattgtagcaggtccaaaggatcgctttacatttattcatgaatggttccacattcatttgacctactgtctgcattacaacaacagtcttttcaggataagcttctgcgatttgctgaacatgagcctcgtgagatggaagattaatatcatttctgtctttggattcagaagaatccgcgtctccaaaaccttcctgcttaggtatagttccggcgtatgcgataattacatctgcagcgtcaagttcatttttatatgtttcaactgagaatggagctattgccgggcttgcggtaatatacatatctgcaacatcactatagccgccgtcttcgcctgtgtatgcagcttcacaagaaatatatgtgttaaggtcagctgtagcttgtgatgaaaccgatgctacggtaggtccgccttgaccgtatgatatattaaatgagccgcccatctgtgtgcctgttgccatttcgattttaacagaagcaacatctttaaagtccacacttgggatataggctgaagcttttggcgtcatatttacaaattgtccgtttgacagtgtcattccactaacatttttggcttttgagatatctacatttcttgtttttccattctttaatacaagagtgatgctctttacattaaagagtttttcattttctgaaactgcaccaagatgttcaacctctgtatctttatttacgtttttaaattcctgagtgataccttctatcggagtaactgtatcagtaggagttcctgaataatcaccaagaacaagtttgtttgctaagtttcccacaacagctaccttggaggctgtatttttaacagggagaaaatcattatcatttttaagcagaacccatgactcctcagccgctttttcagctatgtcaacatgttcctgtttctccagttcgtcttttgtaatatctgagtatcttgagccttggtcaaattcacctgttctaaatctctgcaagaaaagatgatatacaactgtctcaaggtattcttcactcatatatcctttttcaactgcttcaacaccgttagtagtagcagcacatcctccgcctaaataacattctatatccatacctgagagaaatggctgtgcaatggcttctgcgttagaaacattgcttgaaccaagcataccttgcttataggccgcatttttaatcatatcttcaccggctccgcagtcgcttgttacatatccgtcaaagccccaatttcttcttaaaaggtcagttaagagatatggatttgcagatgatggtttatagttatataaaagctttccgtttctatatattgttgtagcgttatatgacgacattactgaagcaggcattgcttcttcagctatattttggaatacttttgtgtagtaatttctaaaattatattcagtcattactgatgagccgccgcggcggttcttttcgttattgtttgctgcaaagtgttttaatgttgagatggtttttaaatatttttcgtcatctccctgcattccgttaacaaattgtattcccagctgacctgtaaggtaggggtcttcaccgtaagattcttcatttctgccccatcgtggatcccttgccatatttacggttggactccaatatgataagtcagtattcggatttttggctcttgcttctgttgaagtagcgtcggctacttgaaataccaaatcacggttccatgtatttgacatagaaagaggtgaaggaaagctggttgctttgccttgtcttgctactccgtgcagagcttctctccaataattatatgaagatacaccgaggcgcggaatttcagatgctttgtatccaatctgtgaaactttttcttcaagggtcattcttgaaactaagtcagccgcgcgttcttcaaatgtgtaatttgtatcaaggtagattggtgtttcctgattcggatcagttgtcggagccggtgttgcagttggcaagttcgggtcagttgtaggctttggtgtggcggttgccgcttgactgttatatagttttacatatatatagtttccgcagtatgtatttgcaccttcgccagtaatgttaagagtgataagaccttcagcatcggttgtagtcagagtttgagtaaatacattaaaagtctcccagccgctggtgttaatattgcttaaagaagcaatttctgtatctccggcttttacaacaactgcagcgtttttctcgctggcaacgtataagtcaagtttgtcgtatccggaatttttcaagtttacacttggcaatgtgagaaccgcaatactgtcgtcattggttctgagattatccggtcttaaaattccgccgtgttctgagtcggtaacaatatcgcccctgttgcctttaacggtgatagaatcttgtccaaaattaagcattactgaaccgtcagaattttgggttaccgttccatagtcagtggcagctgtacttacctggttgttttctgtgtttgtattatcttcaatgctgactgcagaagccgatatcgctacgcatgacaatgccattgccaatgtcagtattaaagcaatacatcttttcattttcataaaaatacctcctgtttttttatttttattttatattttatacttgtattttaacatcaatcactgtataataacagtcaaacaaattatagttttagtcaattattgctatgtaatgagtatttttgggcaggcttgaaaatggttccattttataaattttaaacgatctgaataactataaagcaccttgagcgtaagttaagtttttatcagcatttgcacgaacatattaatataatatatatttttaataagggtcagcatattaatatagatacaaaagattatgtttaagcgccagtgagtctgctataatcttctctgacacagtttataaatattatcgtttgttcagttttcccttcagacacttttaacagagcttttaaaagtgtctataatatgtctctatgataatataagggaagtagaggagaactttataaatataatgatcaaaattaatgttttttaatgcggattaagctgcataatgtttggagcaagttgtgatattttaaattgcttctaaataaaattataaataaaagataattttaaaattaaaagtgtttatagcaaacagttttataaggcaggataatagaaaaaacagctcttaaatttaagccgttttggcaaaattaagaactgttcatatatgttttgattcaatttattgtttgataactatttttctgcagtttattttttaacataaatattgtttgcttaacttatacccaaatttcatctaagcttccgaatgtgtaaccttcggataagatatattgaataagacgatcgagaacgtttgcgttatcagatgaacatgcgtgaagcagcattactgcgccgtcgtgaagatatggcgctatttgcgtgaatgctgtatcagctcctttttgatttgcagtatcccaatctgagtatgcaaaactccagaaaactgttttatatcccatatcatccgcaagctgaagagtacggctgctgtagcttccttcaggaggtctaatataattcatattaactccaaacatttcagcaaatctattggataactctgaaatttgataagctgcggattcgggagagactgtcggaagaataggatgtttaaaagtgtgatttcctactgtataaccatagtccagcattctttcaactaactcagggctttcttttagataatcgcctgtaataaagaatgctgcgggtatattatatttgtttaagacgtcaataatttgatttgtgtatccttcctcataaccttcgtcaaatgtcaaataaatttttttaggtcttgcggtgtctctgaatattactttatgatttgagattaaagaaaccacgctgctgtctatctcagaatagccgggcgcttttctaaaccaccaatcgtttctggtgttatctatattgtaatacgatgaataatcggatataataggttttggttcgggagaggcttttgccagcggctcataatcagttgaagaaaacgcgtttatccaagctttcatagccttaagctcaggaacccaatagacttcgccaacttcattaagttcttccagacgtatgaaagaggagccgcatgcgttgtatacatcaatgctttttccgttaaacatcagcctagtgtcattcaatgtgtaacgtgaatattgtatgccggttttttgggccgggagcataacgttatctatgccgctaatctgagtttgattattttctgaagtttttaaatcaagattagcagtgcgcgtttcttcatcccagctcacgtcgaaaccatagtattccaaatcgcggactttaacaacaatatatccggtgtcagaagcatatgcaggtataggatagtggttgatatatgctgaaatatcggtatataataaacgtccggttactgaatcagcagatactgggaaagtatatactgatgttgtaatgaatatcataaaagaaactaagagcatactgatttttttcataagtaccaccttttatataatgtttaatatgtttccgcataaaaaatgcgggttgtgtttaaaatttaatgatgtaaaaatatttgcagttataaaaatatttttatctatacgaagacttctgctaacttattttttgcattttacaagcagcatcattggtcttctaagctcgtccgacattccgggaatatccatcatttcaggcggcggaaccgcttcctgaaccgcctcgagctgaaatcctgtttttattaaacccattaatatttgggtcagagtatgatgctgtttaactacttctttacctaagaagttggtttgccgttctcctgtataaaagtaattgtctattggccagtattgaatactgccgtcagagccataaatccattcctgatttacgcttccggtgaaaatcgggtgctcgatattaaatataaaagttccgccgggttttaatgttctatatacttttttgtaaatctcatcaaggtcatttatataatgcagaacgagatttgaaactacgcagtcaaatgtgtttttcggataagagaagttatccaagccgcatacttcatacttgattttagggtcgttatttttcttttttgcttcccgtatcatgttttcgcttaaatcaatacccaagatttgtttggctccgttttctgccgcgtatttgcagtgccagccataaccacagcctaagtcaagaatagttttgtttttcaggtctggaaataattcttttaactggtgccattcgcctgctccgccaagacctttctgacttcgaggcatttttgaatattctttaaaaaaatctttgttatcataaatattattcattttgtctttccttttttcaatcggagattaaatatatctcttgttatagttttttaagttttttagtgaaaaaataactccgtttgattctttaaatcctgcactgatatgaaacagtcggatagtttcgctgctaagttctcaatcactggcaaaaccaaaacagcatttatagcccattgcacacattcgtgcagtagtttttttgaatatcctttagcacggaaaatttcttttataaaaattccttcaagacacccaattgggctaatttcagttccttcaaaataattatatcataattggcattgtgcaaatccgaccggtatcagttcttcaaaaacgaggaagataacagagtttttggggagagataatctatgaaacttcagttttcaaagattttattatatgattatctaaaagcattgcggtcaaatttgcctgtatatccaggcagatagagttgcatttctaatcattttaaaaagtcacctttcaaacgctttaagtgatatactattttttatcttttttatttttaatctcatcttttctggctctcagcatggcctcggttgcctctatttcttcttcagttttaagctgcggaataaaacttgacgcaacctttcccttgccacgtgttcttatgtagaaaaatccaaaaatagagaatattattgcgccgagacagttaaccaacatatctttcattgtatctattaagccaatatccaaatatgaaccggttatggcataatcctgcggaacaccgtttattgttcccgatatgaccgttttggtaatatcttttattatgatagggtcgtttaacccactggggttcagcaaaacagaggaaatgtttggaacataccagtctttttgcatgtcggtcagaaaaaactgatccattccatattcaaaaaactcccaaatgacgcctatagtcatggaaaagcaaaacgccacaaacgctacgaaaagaggagacatattgatatgaaagtgcggatcctggttaagaatatctatcatagcaaaacctatagcggccatcataaatccgtttatggtatgaaggattgtatcccaaagcggaattattgtatagaagctttgaatctctcctaaaatttcggcagaaaaaataaaaaacattattacggcctcaagagcaataggcagttttatatttaattttctgtccacaaatgatggaatcataaataaaatcaaggtcagtacgcatgtaaagacatttgcatagttttccataaagaactgtcttaccataaccaaaatgaccaaaatactaagtatagtatgaattatttttcttttatcccgcttctttttaagagatacgtcttcattattaattcttcgcataatctctccccttttgaaattacaaatatagtctaattatatcaagtttagtcatcaaagtcaattatatatattttactgccggtaaagataaattttaagacaaaatataactgtttacttttattgttccaaatgttataatttatttattaaattaatatgtttggtattatattagtatgtagatatattgggagggaaaggatatgaggcaaaagatacagaagaagatgtttgaattttgttatctgctggaacttttaatttcctgcgtgataggtatagcagttgtgattttaggcgtcagattattccttgagatgataaacctcagcgtgttcagcggcggggataaaatattagagactattcttgacaaggcaatgatacttgctatcggtgtagagtttataaaaatgctttgccggcatactcccgaaacagtggtggaagttcttttgtttgcgattgccagacagttggttttggttcataaatcagctttggatattcttattgaagtggcggccattgcagcgctatttgctataagaaaatatttattgaccaagcgcgatgagagggaaagcgttggtgatactggaaagtctaaattaaacttttttaagaaagaggaagaagagaacaaaaaagttgatattctatgataatttaaaatttcgcctggctgaatgtcaggcttttttattagatttattttgtgttttaaattataaatgggtgtcggcggagggcaagataattctatattttcgataatgatactgctgcttagcgatgtaaacaaggtttaaaaaataacattaatgtttgcatatttgaattattgacactataggaatatcaagcagcagtagttgccgcattgagttttttatgtgaactaaatagttgtgtaaaaacggcacgctatatattatagcgtgccgtttaatatttaaactgtatttattttttatttgccggtgcgataactttataaactaatgccgctaaaattcctccgaccagaggagcaacaatgaacacccaaacctgtgccataggcaggctctttcctgcaaacagcattataagcgccggtccgaaacttctcgctgggtttactgaagtgcctgtgaatggaatacctaagatatgtaccagcgtaagggtaagccctattactaaaccggcaacagcggcgttttctattttagacgtaacgccgataatagctatgacaaatacgaatgtcaggattacttcaaccaggaatgcctgccacatgcctatgccaagagcacttgcttcaccaaatccgttttgacccaaaccattctcggttcctaaaagtaaagctaaaattgcagctccggctataccgcctaaaaattgtgaaataagatatccgatataatcgtttaccgtcattttacctgaaaccagcataccggttgaaactgccgggttgatatgacagcctgatacgtttccgatagaatatgccatggcaacaattgataaaccaaaagcaaatgctatcagtaatgtagaaagcgccagcgcgctgccggtcataaccaaattggcgtcaccaatcagattgttggcagcaacagcgctgccgcagccaaagataaccaatacggccgttcctataaactcagacaaatactttctcattttacttcctcctctaaagttttatttattaatatatatttaacttacagatgatattataccatatttttctaagaaattcaataaaaaaagacggcaattcagccgtcttttgttaaatttgtattactttttattcaataatttcagcttttagtccaaaatgcttgaatgcggcttcgagctggttgtcaacaattactgtagtgttctgtagcgcgttatacaactctctttgtgttgttaagtcaagcacaccatatgggaagagctcctgattgttttgaaactgagctacagcgctttcaagttcgctgtcaaaatacgggtcattgatgtttccgttatacctgccccagacattcagtatctttttagctttggatatattagcatcgctttcgccgggattatatattctgctgtaatcaaagtcttcgtaacctgaataatcaaacggcacggaaccattctcaacaacggcgtcaggcgttattcctattttatcaatattttctccgctcggcgtcagataatatgcggcagtatatttcatagcttcgccgtcttttaatgagacgctgctctgaactgtccctttaccgtaagtttttgttccaatcaaaactccaacttcattttcttttattgcggccgccaaaatttcagaagcgctggcagagtattcatttaccaatacaactacgtcatttttctgagttctctcattgttagacttgtatgtaatatcaaaaagatcaactttgtggtcctcagtaacgattacgtttccattcggaacaaagtagtttgctacttttaccgcctgggttatataaccaccaccattatcgcggacgtctataataatattatttatattctgactgtcagcctccttaacggcagcgtcaaactggtctgatgtattgtccataaaaccatagatttttatatacataacattagctgaattctgttcgttttgttcatcgggagcggaaacaattttatacgccactgattgtttctcaccgatttcttctctggtcaaagtgaagtacaaaacgtcgtcgacaccttcacgtaaaactccgacggtcacaggggatccaacctgacctctgatatatttctgtgcaacttctatgctaacgccgagaagattgttgccgtcagcactgtagagtgtgtctcctgtcaggattccggctttagccgccggggaattttcgtatactgaacctactatcaggtttccgttcgattcattaaatgttattccaataccgcctacggctccctcaagctgtgaaataaactgttcaaattctccgcttttataaaatacggaatgctcgtctattgagcctaaaatcgcactcataacggtttcataaagttccggatgctgttttaatatctcgagcagtcctgctttatataatgacagttggttaacaccatccttagcatagacagaaagatagtctataacctgacttacgtaatcagatataaattccccgtcttgagactgatctgcaggagccgcagtcgaaacagctgtttcaggctcgtccgccgttacggttccgccaaatggtagaaccaaacaggaggccgctatcgcagcggctaacaatcttttgaaatttttcatattatacctcctaaaataataaggggcagaaagcccccataaaatttatattatattgtagttattgatactattctataaccgccgccggcaagagtggctactgtaacttttacattcatatccaaaaaccatgcaagggaactgaggtccagttcttcaccattgcttccgtttttgatattccctccaaaggcaggaatttcagtatattcaagctgtgcggcaatagcagtgttttcttcattcacaattacaggttttacatttttaagaacgattccctcatctttccagtcagataaaaacagaacaccggtatatgacgataggttcgttattatcttgttttcatcaaacgcaaaggccggcatggctgaaactattattaatgcggcaataagcagtcctgctgttagtttcttcataagcacctcctacattttttcaggggcagtaatcttaagcatattcagaaccccggcaataacttgtcttgtgcagtcaatcaatttcattctgcagtcacgcaggtcttcgtcctcaacgttaacacggcaggcattataaaacgtgtggaaagcggaagccaaatccataacataacgcgtcatttttgacggctccaaactttcagccgatattcttatctcctcaggcaaatcgctgagcttctttaataaatccagctcggtttcatcagttaaaagttcgggctttatttcggcgtaaggtttgacgttaattccctcttcactcagaaggctcagtattccgcaaatcctggcgtgcgcatactgaacataaaataccggattgtcattgctttgttcctttgcaaggctgaggtcaaaatccaaatggcttccggcgcctcgcatattaaagaaaaatctagccgcgtcaatgctaacgtcttctaagaggtcgttcagagttattgcctttccggtacgtttagacattctgacaatctctccgtcctgcataagacggacaagctgcataagcacaatttccagtctgccggaatcaattcctactgctgagagcgcgtttttcattctggcaacatggccgtgatggtcggctccccaaatatttatagcaaggtcaaaatttctggtttcaagcttgtttatatgataggcaatatctgcggcaaagtaagtaggtattccgttttggcggacaagaacctcattcttttccagtcccatcttttcacagttcagccaaacagcgccgtcttcatcataagtatatccgtttttgcgcagacgttcaattgcagacgttacctcgccgttcttgtgaagaaggctttctctgaaccacacgtcataattgattctatatttttccaagtcagttttgagtgctgatatatttttttccagtgcataatctatcaaagcctgcttgcgttcatcttcgccgcagtccaggtatttgtctccataaagctttataaactcttttgcgtgttcggttatgtctccgccctgataaccgtcttcagggaactcaactgcatcctcgccttttaactgctggatataacgggcactgagcgacttgccgaacttttcaatttggttgccggcgtcgtttatataaaattcacgcgttacatcatatccggcgtattcaagcacggaggccaaacagtcaccgagagctccgccgcgggcgttgcccatgtgcataggacctgtaggatttgcgctgacaaactcgaccatcacctttttgcctttgccgagatcaatctttccgtaatcactgccttctttttcgatagattccatagttctgtacagccagtcaggggcaaggtaaaagtttataaatccggctcctgcaacctcgatatcttttatatctccggacttgtcaatattcgaggttatagcgtctgcaatttttctaggcgcggttttgagctgttttgccaaaaccatggctatgttgcaggcaaaatctccgtgagatttgtccttaggcacctcaagtttagcaaggctgcttatatctatattttcatcggtttcaggcaaactgccgtttgatacggcctctttatagcctgcgctgattttttcgattatttcactttttataccgtctatgatactcattcggttttcccctttgtaatcgtatatagttttattattaaatattttccgccgacggttttctattaaattccgtttcgcatttcaacacagaaacatcagaaaaccggagcggacaactaattaatttcagattttgattccgtgacgctgtctgttctaactgtaaccgtcatattattctttataaaattttggttgtcggcgtctaaaagataattcatattgagagttccgccgttatcgccaaagtcaaaatttatattttcggtagttattgcggcgccgacttgtccatacggcgtatttatcagacagagacttttttcacctgtcagataattcatttttgaagtataacgtccgcttctgcgaacgctcacgttaccgtcgctgacttttatggtagtggtcgtatcttcaaaaccggtcatgtcgctttcatcataaattatatatattttattgtttctgatagcatatttgccgactgtatcgagagcaattgtctcctgctcaccgtctaactcctggtttgtgcgtatggatataactgcattgttttccatattttcacctctcagtatttttctatatcgatttttgcaacgtcgccctcaatttttttagagagaaaaaggcttccgagttcttcaaatccgtgaactgtgtcgctgacataatattttgaattgcccatatcattgctgccggacagaagtccgtgcatttccatcatcctcttagcttcaccggccgcagcggcgcctgaatcaatcaaggtcacgccgtccccaaccacatcttgtattgtctttttcagcagaggatagtgggtacagcccagtataatggtgtcaacatcattctttagcataacgtcaagatattcctccgcaagcattctcgctattttagaatcagaatatccattttctaccaccggaacaaacatagggcaagcattagatatgacttttatttcgggatttaagttcccgattttttcggaatattttccgctgtttattgttccgctggtgcctaaaactccaatacgtccgtttttggtagcattcactgccaattttgaggcaggttccaccactccgataatatcggtgtcgtattctgttgtgatatgcggaagggcggcgctgctggcggttccgcaggctatgactataaattttatatcaaattttcttaaaaaatttatgtcttgccgcacatattttactatagtagcggagcttcttgtgccgtacggaactcttccggtatcgccgaaataaattatgttttcattcggcattatcttcatgacctcgcggacacatgtaagacctcctagaccggagtcaaaaatacctattggtctattatccattatatatcaccttatttattgtttttgtctagggcgtaatttataaggttgtcaagcagttcaaagttgccgacaccgctcttttcccacattttagggtacatacttatggaagtaaagcctgggagagtgtttatttcgtttaatctgactgcaccgctctccttgtcaacaaaaaagtcaactctagacagaccgccgcattcgcatattttatacgctcttatcgcatagtctttgagtttggcttcaacgtctttggtcacattggcaggtatggttattttggaactgctgtcattatacttagcgtcaaaatcataaaactcattagccggagcaatctcaccaatattttcggcaaccatagggtctgtgtttcctatgaccgcgctttcaacctcgcttgcggcaacgaattcctcaatcaggactttactgtcatgttcaaaggcgagattcacaccttcgataagctcttctctgttatgcgccttgctgatacccacagatgagcctgcgtttgaaggttttataaaacaagggaagcccagtttttcttcaacattttttatccagttatcatttgaaatatccgaggttttgacggtaatccagtctgcttggggtatccctgcttctttaaacagaattttagccacgcatttgtccatacaaacagcgctgcctagaactcctgaaccaacatatgggattccggcaatttcaaataatccctgtattgttccgtcctcgccgtttttgccgtggagaacagggataataacgtctatttttatattttcaatgtctccattatttttaaatcttaaaagccctttatcgctgcgtgagggagaaaggatagccttgtcatattttccggccggcagagtggatatttcagacgtcggtttatcaaaatacatccagtttccttcagtatcaataaaaatcttatgtatattatatttggcagtatcaagagagtcaataaccgtagcggcggatatcttgctgatttcatgttcgcttgacacgccgccgaagatgacgcatatgtttaatttttccaaataaataaccttctttccaaaaagtttcatgttattgcggatttgacagccgcagcactaaatatctattttaacatatttcgcgataatttcaataggtataatttataaaaatatgttaaaaatctataacatgatataacttatggaagaataggaagtttattacattaaaattttaaagagcaaaagttttaggaggaagaattatgccaaaagtaaatttgatgagagtattcggagttatctgcgctgccgcgctggttcttgtcacagcagtttcttatatttcgtggcaggtcaacgatattgaggatagtgtgctcagattacatatcgttgcaaacagtgactcagatgaggatcaggcgcttaaacttaaggttagggatgaagtggtggaaagatgcggatttttgtttgaaaactgtgtttccgcggaacagtcaatcaaaaccgccgctgataatataggatttataaaatatgttgctgagcaggtcataaccgaaaatggttataattatgatgccgactgtcaggttacgcagtgctcttttcccacaaaacaatatgagcggccgggagacggagtggtatcacttcccagaggggaatataatgcgttaaacataaaaataggcgccgccaaagggaaaaattggtggtgtgttatgtatcctccgctatgctttgttgacggggttgcaagcgttccggatgagacggacgagcttttaaaatcccagctgactgcgtctgaatatgagctgataaccgagtcagaccgtccggaaataaaaataaagtttaaaattgcggaacttttaggcggacagcaggactgagccggcgttcataatatttaactattgatatttttcacccaatatgttataatttactatatttctgcggggtgatactgatgaaaaatattaaatacagactggcgaatttgttaggtcttaatactgacgcgtctttgtttgaaataaatcatgatgaaatacaaaaaacaaacctattgtttttgcagcagatttcttttacatcgggtttaattatgctgctgctttatcttgttagtttagttttgccgtctatagccgatttgagaatgacttattttatggaatttttagtttcggcaattatatttgttttaacctgcgtggcttttgacgcactgctgccgtattcgcttgtgctgacatattttttgacgtcggtgataatggcgtatggcgcgatagccgggatttatcaaactccggagggcactgcaacggcttttattgttttgatttcgtttttgccaatgcttatatttgataaacaatcccatgttctgcctttttcggtggttttatggctgcttttctgtggtgcgacatttatgcttaaagattttaaatattcttcatttgatatattgaattcttccgcagggcttttaatgggtatcttaataaacgctaagatatttaaaataagaataagcggaataaacagcagcaggattttggcaaggcagacacaggttgatgaactcacgggtctgcctaactataaaaagctgcttgaggatttgtcgggaaagaacgatacgaggattgcaaaatctctctgcagtttggctattattgatatagatatgtttaaagaatacaatacaaaatatggacgggaaatgggagataaatgtcttagaaaaataggtaattgtatgctgaagatttctgacccgggtgaacttatcgtctacaggtatggcggaacaagtcttgttgccgtcagtctcatacatgattataagggaatacagcgggtatgccagggcttgtccgtccttataaagggtcttaatattgagttccagggaaccgaggaagaaaagattacagtaagctgcggttataccgacgttgtggaatgcgagtgcgacgagtttgaaaagcttttggatatggcaggcgaagctttgcagcaggctcgcaaagacggaggaaactgcagcgtcggctacttacaggtaaaagcgcttaaggaaaattaatttataatatgcggaatataataacataatttgggtgaagctgtttgattcatatgaacttatttgttggggaattgaacagctttttgtgtatgaaaaaataatttaaaaagacagcgtttggttaaaaatgtatttaaaatagttgaaatttgtggtgttgctttttaataaatacaagttgtcttgaactctgttagttgtgtttttcatttaaaaattggaattatagttgtcgtttttaataatagaattctatattttagtaaatatttgttaaaggggggggttgttatgaaatttaaaaacctgtatactaatgaggtatataaagaaaagcaattgctggctgataattatgaaaaagttgttgatagtaataatgactttacaaaggttatacttaaaataggcggattttgcttttttatgctttttattacgtctatgtttataccatcatattacaatctgagaattgtatattttagcgtatttttgattttagcagctttttatcttttgattaaacttcgtgagaagtatgttgggatttggagcatttacgtcgttttcacagctgcggttgtatgtttcactctaacaggctcttttattaccccaaatgatattggggttatggttttggcgcttttacttacatttcctattattgtacttgataaatcaattagaataatacttactgagttttttttcttggtattttatattagcatgatttatttacataaagcgccgtcgctggttattgatgaaatagttaattcaattttttcttttgtgttaggagttaccttaggtgaatattttagaatcgtcagactaaaaaattttgagcttgaaaggcaagctcatattcgtgaaacgacagatgttcttacacagctttttaataagcgtaaactttttgatttttttattgaatatgagaatggtgtttataaagaaccagttacagctatgtcgatactggatattgatgactttaaactatataatgatacttacggacatcagaccggagatgattgccttagacaaatcgggttatgtttaaaaaaattagaagggatttatcatttaactttttatcgatacggaggtgaagagtttgtagcggttttacatgatcctgatattgcggatataagcagtgtgttcgaaaaaataaatcaagccgttcggaatttaaatatttcacattctgctgtaagtaaaggtgttgttactgttagtattggagtggtacctataaaatataactgtaaaccaaattttgagcaattgcttgataatgccgacaaagcgttgtattcagcaaaacgaaccggaaaagataagactgtaatattttgtgatgattttaatgaacctgatattcatggacattacagcaaagttcatacataaaagttaaaaatataagttataaaatgttttaaaaatgaaaattctgtaaatttacggttacatggtcaaatatatcaatagataactaagtataaatataaaaataactttatataaaaaatagaaaaatgatatatttaaagtataatataatagtcaagtgaatatttttataataaaatttgcggctgaaataaatttcagccgcagtttattaatttaggcgtttaataaatgtataagaattagagcgccgcagaggtttaatcgacctaataaagtatctttattttccaaataaaaaattggttcttattgttttgtttaatttatatagataaactatgatgctaaaactctaattattatttaataaaatctaaaatttatccgctgccggcatgtcttgctgtagtttttgcagagtaaagtccaataagtagatgacaaattataaaaagactcttgttagaaaaatagaaaataatctgaaatagtaagttttttaatttattttatatgaatatttgatgtacatgattaaaataacataacaaaaaccataataaaggattgtaaacaggcaattgacaacgcgtaggtatttgtaatacataataaaaatttggtaatactaatattcggttaacactttattacaaatcaagcaaaattgacacaaaataaaaaaaggtgatataatataagttaagctctgtacttattttaggaaaattctggagagtgcagaggtatatttattttgtgaaacttgtaaattcagagtattattcaacttaaatttatatatagaggatgaagagaatgattcagcatattaaaaacggtgtggatttcagattaattccagcacaaaagtttaaaacaaatgttatcagtgttttctttaatattccgctttcaaaaagcacagtgacaaaagcggctttgctgccgtctgtcatgaaaagaggaacagaaaagcacaaaaccatgaatgagatatcaaaatatctcgacgaattgtacagcgcaactttgcgcgccggtatcaggagcaagggcgacggcgaggttatatacttcactgttgagtatataagggataagtttataggtgagaacctgacccaaaagattgtggacttgctgaaagaatttatattctgtccgcttgcaggcgatgatggttttgttgaagagtatctaaacggagaaaaagaaaatttaaagaatgctattgaggggcttataaacgataaaaaggaatatgttgaggttaagtgccgtgaagctatgttcggaggcgagggttacggtatgtttgaagccggttttgctgaagaattgccgaatattacctccaaaaacttatatgatttttataagcatattataaacgatacaaaagtcgatatttttgccagcggagatttttcggacgaaactgtggaaatgctgaagacggagctcgccggagaatttgagcctagagattcaggctatgttaagactaaaatcgctgttccggaaggaaaagaaataaacagaatagttgaggaaatagcagttgttcagagtaagctttgtatcgggttaaagtgcggtatagaacctacaagcaaagaatattatgcgcttatgctcggcggatgtattttcggcggcagtccgttttcaaaactgtttaccaacgttcgtgaaaaattaagccttgcatattatgcttctgtgagaacagagaggtttaagagcacaatgtttatcagcagcggtattgaaactgataaatatcaggcggcctatgacgagatactggttcagtttaataagatgaaaagcggtgatataactgacagcgaggtagtgaattcaaagctgtatctgactaatggtttcaactccatgaaagacggtttgagaacaatggaagactattatctatctcaggccattatggataataagggcgagatagacgacctgatagaaatgaccaataaggttactaaagaagaaattgttgaagctttcaacaaggtagagatagatactgtgtattttcttaaaggctgtgcaagtgacggaggtgacgaataatgggcggatacaatattgaaagactgtatagcgagaacttagacgaggaaatgctttttgcaacgcacagcagcgggcttagagtttatgtgttcccgaaaaaggggttcagtaaatattacgctatttatggaacggactatggatcaaccgatagagagtttgttgttccgggagagaatcagaccactgtgatgcctgacggaatagctcattttcttgagcacaagatgtttgaacagcctgacggcagcaacgcatttgacagttttgcgctgacaggggcttccagcaatgcgtttacaagttttgacctgacagcttatttgttcagctgtactgataagttttatgagaatttggatattttaattgattttgtaaatcatccgtattttactaaggaaaatgttgagaaagaacaaggaataataggtcaggaaataaaaatgtatgacgacgatcctggctggagggtgttttttaacacgcttaccgcgctttttcataataaccctgtaaaaatagatattgccggaaccgttgatagtattgctgagattgacgatgacgttttatataaatgctataatactttttacaatcccggaaatatgattttggtgctggcaggagatatagaaattcaaaaggttttagagagccttgataagcatatcagttcagacagaaatttgggaatcatagaaagacctaaaattgctgagccggaaagccgtgtgaaagagtttactgagcagaagctggttgtatctcaaccaatgtttcagataggatttaaggatataactccttttaacggcggagaagagcttttgtgccgtgaaatttcaacagatataattttggatatactgttcggaaagagcagtgatttctatatggaattatacagcgatggattgatagacagcagttttggggctgaaaccgagcttgaaaagcgctatggcttcacaatgatcggcggagaatccaaagaccctaaagaggtctacagaagagttaaggagcatattaagaaagcgcaggatacgggactaagtcatgatgaaatagaaagggctaaaaaggttgcaaaggcttcgcttattaaagtgtttaacagtattgaggctatgggaaattcatttattcggcttctgtttaaaggggttaatcctttggagtatgcggcggctatagattccgttcccgatgtggcggtaaacgagcgccttaaaaaccactttgatttgtcaaactgtgttttgtcaacaattttgccggacgatagccaaaatgagggggagaaataatgataaacaatatttctttccccaatttggggcttgatttcagcataaaccgtgcggctttcagtataggaaatgttaatatctactggtatgggcttataatagcgctgggaatgattattgctcttgcttacggcatacgcgaatttaaaaggtgcggattaaagcaggacgaccttttaaatatgtttttgatttgcgtgccggttgctataatatgtgcaagactttattatgttattttcagctttgaccaataccgggacaatctgctgagtatttttgatattaggaacggcggtatagcagtttatggaagtttaataggcgccggtattgtggtgcttgtatattgtctgaaaaagaaaataaatttgggagcggttttggatattcttgctgtcggatttttgataggacaggcagtagggcgctggggcaattttgtaaacggtgaagcatttggaacggctacaacactgccttgggcaatgacgattgcgtccgacggggttacatatgcggagtctgtgcaccctacttttctttatgaatcattgtgggatttagccggggttatcatacttcttgtttacagaaaacataaagggtttaacggagagatatttttaggttacattctttggtatggtattggaagattttggatagaggggcttagaaccgattcgctatacctaggtccgcttagaatttctcaggttgttgctcttatgtcagttttcttggggcttgcaggaatagccgccgggcggtttttaaaacataagaatatcaaaatcagcgttggaaaaccgaaagggactgaaaagagcagtcttgaagaacccaaagacgataatgatgacatagatgagtaatattttttgcgttaaaaattattttatttatattattttatgggaggattatattatggaacaggatattcaagtattgagacagcggatggctgagttggttaaaaatgagaacctgaaatatgatgatatatataaaatgaaacttgagatggatgatataatcgacaaatactattttgaacagatttaacaaaagtgactgaaaactttcaaagcagctgaacactgcaaataatatagtaccagtaaaaattgtatgttcggcgcttatgttttgacagggatgctgactgatgtatttgaagattattaattacgataacgtcaaaaatacttgacagaaacagtgtaagtatttttaaatgatttcctattgacctgttgagactaatatgttaaacttgtattaagatagttattcgttctgaccacaagggtttgcccgcgtgaaaaggcgaaggataaatggctgtcatgcgtttttatgacaagtttacgtgcgtgcatgggcgccttttttgaataaatcaaataggtgacagaatcctttcgctttgcgggaggattttttattttgtaaagagggtgattaaaatggaaaatgtaaaaaaacttgaagatacaaggatagcgcttgttggaattattgtagaaaatcttgatatcactgataaaataaatcgtataatccatgattacagtgattatatagtcgggagaatgggtataccgtataaaaaccgcggtgttgctattataagtcttgtaattgacgccccggtgaatataatttcatccttgtcgggcaagctggggatgcttgatgacgtatctgtcaaggttcagtatacaaaagtataaaacacagtaaatttttataaggagataatattatggaaaactataagtatgatgtgaagtcatcaaaggcagaggaatttattaatgacggagagataaacgatacgctgaaatatgcctcagaaaataagacaaacagaacgctgattaaatcaataattgaaaaagcaagggaaagaaaggggctgaatcacagggaagccgctgttcttctggattgtgaactggaggacttaaaccaggagatgtttgagttagccagggagataaaacaaaagatatatggaaaccgcatagttatgtttgctccgctgtatctttcaaattattgcgttaacggttgtgtatactgcccgtatcatgcaaaaaataaaaccatatgccgcaaaaaactgacacaggaacaagtgagagcggaaacgatagcgttgcaggatatgggtcacaagcgtttagctttggaggccggagaggatccggtcaacaatccgcttgaatatatactggaatgtatagacaccatctacagcataaaacacaaaaatggcgctatacgcagagttaatgtgaatatagcggcgactaccgttgaaaattataagaggctgaaagacgccggaataggcacatacatattgtttcaggagacttataacaaagaaaactacttaaatcttcatcccaccggtcctaaacatgattatgcttatcatactgaggctatggacagagctatgcagggaggtattgatgacgtgggctgcggcgtgctgttcggattaaatttgtacagatatgactttgttggtcttctaatgcatgccgagcatcttgaggcagcttttggggtaggtccgcacactatcagtgttccgagaatctgtccggctgatgatattgatgttgaagacttttcaaacgctgtttcagatgagatattccaaaagataattgctgttattcgaattgccgtaccatataccggtatgattatttcaaccagagagagtcaaaagagccgtgaaaaagccctgcagcttggaatttcacaaataagcggagcgtcaagcaccagcgttgggggatatgtggagaaagaaactgacgaaaataacactgcccaatttgacaggagcgatacgagaacactggatgaggttcttaactggctgttggagcttggatatatacccagcttctgcactgcctgttatcgtcagggcagaacaggagaccgttttatgcctttggcaaaatcgggagttatacagaattgctgtcagcctaacgcacttttgacgcttaaagagtatcttgaggattatgcttcagaagataccaaaataaaaggcgacaaagttattgccgctgaagttaagaaaattccaaatgataaggttagagaaacaactattgattatttggataagattgttcatggaagccgagattttagattttaaattataaacagccgcattttgatattgcttcaaaagttagaataaaaatcgagcttttgaagttagttcatttgcggctgttttttgtattttataataaaaatatcgtgttaatggagaagtgttactgtgtgctttcaaatgttattatatgcactgactttttttattaaacctgaaatgttagtaaccccaattgagttgtgaatatgtaaaatgttaacttattccgacaaatctgcatcaacattaatatataattaaagcagattttttgctggttagacgcgcattctaggtaagttttaaaatttactctatgttcatatcacacgctcatctatatatgctaagtgtgtgatgacaattatagtatacagaattttgttaaggtttttttattcaatatcaaaaaattacttagttgtgataatatacatcccgctattttcatcttgaatctgcgcttcaagatgaaaagccttgaactttcccgttgactttgtaaactgcctcgaaaaaagatttctcgaattccggttgattacttatcgaaaaactgagttttcagtataaaaaatacacagaaatgaggattttcagtgaacctcggaaggtgtgaccccacctgacgggtgggtgtgatacaaagtgctttgttttatctagcctgcaatgtcaattgtggctacacttttgtttaaaagtgtatgctatataaaccatataatgtcatataaactataaacgccgataattaacttagttgtcatataataaataacttagttgtgatgtattgcaaacgtagtttgccgcgttaggtgggctattatctgaaaacgcagtgctcaatattatatactttccaggttgaaaaattattattgcgttacgtgaaaaaataaaattattctgttaacaaatataaatataataaaaaacaaagataattttatataaatcgaaaaatatttataccgttataaaaaatgtgtgtacgtcaatcctattttattgtttattttgttttttaaatcccattgcttttttagaattatgttattataatattatatgaaggctgaatcttttcatcattgaaaaaggtttggtttttcattttagtttaacaaatgtttgttagacggggaaagaggatgaatatgggaaaggattttattatagaaaatttaaaaaacgccggaaaaaatattaaagaaaattttaaatcttatacattggattttatttttatagtgttgtttatatcagtgtttcaaacagtatttggtcaggaaaataatatagtcggagttatattaactatattgatggcttcatcaatgatgagagatttgacttctacgcctttaaaacatttagtgattcaatcttcggttttggtggctatggcggtttctgcctgtttggtagtgattcttaacccgtggattgctcttataattaattttattatgataacgataatattatattcttttacatatgagtacgctagtaatctatattttccatatattttatcctacttgtttatgatttttattggacctgttaccttggaacagctgccgaaacgtgttttgagtatgctggcgggcgctctgtgtataatggcatatcagtttgttaaaggaagaaaacgggttgttgatacaacgagggattcgctgactgtaataatagacgaggctttggtttgtacccagtgtttgattgacggagccggtaaacctgcagatttagaagaggtccgcaaaaatttgtataagctttgtaaaatggtctatgagcgcagaaaaagggttttatgtgtgtctgacgccaactttgccatgatagacagtgccaggggattagaaaatctaatattggttttatatgaaatgaccggtccgataacgcctgacagaattgagattttaaagaaagttaaagaaaaacttaaggaattccgtgcatttgtgcagcgtgaagtgaattgcttaaaagatatggatttctctgattttgccggaagcaattcttcggcggagactgaagaaatttttaggtgcgtagaatatatagctatacatttaaaacgaatgacagatcctaaacgtcgggttaaataccgccgaactgttttatcgtttgcggtgcgtttaaaggcggcattaaatctgagtcctgttcgtgttgtgtatgcgcttagggttgcagttttgctctcagcggcaactttaatagttcagcttttaggactgccccatggaaagtggcttttgtttactattgcctcagtttctttgccatatgctgatgatgttgggaaaaaggcgagacagcgttttacagcaagcgttattggctgtgtaataggtatggcctcatatgctttagttccgtcagctgtcgggcgtacagctctcatgatgttttcgggatatatcagttactatttttcgggttataccggaacatttgcgtgttcaacaatcggcgctttgggcggggctgtctttatgaacggttttggctggtatgacgttgggagcatggctgtggttcgaatagtgtatattgcagtaggaattctagcagcagtggcagcaaaccgtttgatattgccatttagaaggtctgctgcaacaaaacagctctggaagaagtatgagaatacggttaaacttcttacggtgatatgtgaaagtgacgatgcagatacacaattgtattacagtttagtaatacagtcgcacctgcttgaggaaaaactgttggagaatgctattaatgaaaattggaatggtattgataatatgcttagcgagtgccgagctttggtgcgcagcgctcacaggaaaaattcttttggtactttgattgcaaataatctcagctagttattatataaacttccaatttttatttatactattggcggcggtttcaaagtgatattttagaattcccaaatcgatttttgagtaagcgccgccaaaagacttaacgctgacttctaaatcattgagtgaaaagaaaaatttttgccggttcattgctgttggtgccagcatagcggaatttactcctgctaaaaaccagtcggggatgttttcattataatcgcagactttttctatgggtttgtttttatgcggtttcccttgggtctgaccatagcctagagtgattacgcagaccagtttttcaccgtctccggcagtatagctgcttttctttttcttatatgttgcagctacccagcaggtattaagacccagctgttgagctttcagcactaagtgttctccgtaataacctattttttcatcaagattaacatctgatttgctcaccatggcaaaatagtttgtaacatttttgaacatgccgtagtgtgccgtaaaaccactgaaagcttccggttcattagtaatcagctgtatattgagattgcttttgtgattgcaaacttctacctcagactttagttcctctataatattatttgggataatttgattagtatattttctaactgaatgacggttatttattgcttctgaaatattcatgaatattacctcctttagccaattatacacatataaaaatgaatagtcaaaataattttttataggataaaatatgattttgtcaaatggacagattatttggtgtttttgttgttacaattgaacaacatatagaaatgttcataaaaaatcgcttgacatgaatttaacggtaacttataatactatcattagataaattcacataaagataaataccatataacctatatggtgtattatagaaatgaggaaaatgtaatgaatgaagaaaagaaaaaagctcttgaccttgcactgagtcatattgaaaaacaatatggatccggcgctgtaatgcgtcttggagaaaagcctgatgcaaatgttgaggcaatccctaccggggctttgtcacttgatattgcattgggaatcggcggaatacccagaggcaggattattgaaatatatggacctgaatcgtcaggtaagacaactgttgccctgcatgtggtagcacaggtgcagaaaatgggcggagaagcagcgtttatagacgccgaacatgctcttgaccctatttatgctgaggctttgggagttcagaccgatgacttgatagtttcacagccggataccggagaacaggccttagaaataaccgaacagcttgtaagaagcggtgcggttgatgtaatagttattgactctgttgcagcgcttgttcctaaagcagaaattgaagggcttatgggtgattctcatgtggggctccaggcacgactgatgtctcaggctctcagaaagctggcaggtattatttcgaaatctaatacaactgcaatttttataaatcagctgcgtgaaaaagttggggttatgtttggcaatcctgagactactaccggcggacgtgcgctgaaattctatgcttccgtaaggctcgatgtcagacgtatcgaaagtcttaaaggcgacggcggagttataggaaacagaacaagaataaaagtagttaaaaataaggttgctccaccgtttaaagaagctgaatttgatattatgtatggtgagggaatatcaagagaaggaaatatacttgacgttgccgttgatatggatatagttaaaaagagcggctcgtggttcagttataatgaggaaaggctgggacagggacgtgaaactgttaagtctattttaaaggataatcctgagcttgctgatgagatagaaaataagattcgtgaaagcgccggactgcctatgattggagaagaggcggagagcatgtttgacgaaaagcctgttgcaggattagaaaaaccaaagaagaaaaaataaattgttttgaaaacttctatttaggtaagtgataaaaatgatggatgagatattaaaagggaaaaaacttgctatgagatttctcgcttcaagaatgtatacctcaagagaaatctttgataaactgcgccgtaaaggttatagttcagaattggcggagagtatagtaagtgaacttatcagtgaaggttttttagatgacaaacattatgctgactgttatattgctgatggtgtaaacataggatacaaggggacttttcgtatcaggcaggaactcttgcgcaaaggcgtatcgtcttcaataattgaccgcgcgtttgatgaggctgatgttgacccggagaatgctttgcgtgaatttgtaaagcaaaggctgcaggttgctgatattactacaagaaaagagtatgaaaaattcagaaccatgctggcacgccgaggcttttcactcagtgagataagaaccgttttggatgagttcgatatagagttttacttagaggattagattgaaatttaaggagaaagccgatttgaaaaaaatatctatggcgtcgctcggatgctcaaaaaatcagatagacagcgaacaaatgctgtcaatacttgaagaagccggttatgagatttgtgagaatgaagaggatgcaaatattataatcgttaatacatgcacatttattgaggatgctcagcgagaatcgattgactgtattcttgagctttcacaatacaaaaattccggcaatgctgaattattgatagtaaccggctgtcttgcgcagcggtataaggagcagatattatctgagatacccgaggttgacgcggttataggaactaacgagtatgacagaatagccgaggttatagaaagctgcctgaacgaagacgataaacctgttaaatgttcggagaagccgcttctttgtgagcacgaaagggttcgtaccacccctggatatacagcttttttaaagatagccgagggctgtgataaccgttgtacatattgtgttataccatctatccgcggaaattatagaagccgtaaaattgaggacattttagatgaagctcataaaatggctgaggacggagttaaagaaattattgtaatagctcaggacacaactagatatggtattgatatttatgatgaatatgcccttccgaaacttctcagagagctttgcaggatagacgggatagaatgggtgaggattcattattgttatccggagcttgtgactgatgagctgattgatgttatagcagaagaaaacaaaatttgtaattatcttgatatacctattcagcatataaatgataaaattttaaagcggatgggacgaagaacaggtaaggaacaaatagttactttgttgagtaagctcaggaggagaatacccgatatagttataagaacatctcttatcgttggatttccgggagagagcgagtctgactttttggagctgaatgagtttgttgaaaaagctgaatttgacaggctcggcgtatttacttattcgagagaagaggatacgcctgcatataatcttcctgaccaggttgatgaagaagaaaaagtgcgccgccaagaaatgataatgtttacgcaggcagaaatagacgatatgaagaatcagaacaaaatcggaagtattgtcaaagtgcttgttgaagggcgtgatgaaataataaaaagttattacggcagaacttatgcagattccatggagatagacggaaaagtgttttttaaatcgggaagaaagcttaatgaaggcgattttgttgatgttaaagttgaacaggcaatggatatggatttatttggatctgaggtataacttgtgcaattaatgatttataaaattgttttgtggaggaaataatatgaacttacctaataaattaactttgcttagagtgatactgataccattgtttatgattttattcttgagctgcggcactgttggtttatatttagccttggtgacttttattttggcggctgtgactgatttttttgatggtcaaatagccagaagaacaaacagcattacaacatttggaaaacttatggatccaatggcggataaacttttgacactgggagcattagtttgttttttggctgcagatgtgccttatataaacgcatgggttttgataataattattgcaagagaattgattgtaaccggtatgcgtatgctggctcttgaacaaaacagggttatttcagccagcttctttggaaagcttaaaactgtttcacaatttgcaatgattattgtggtgctgataaatcaaatagtaatggttggaaaagatccattgcaggggggattcggcaattttcttgtaatgatattggttataatctctgtagtgctgactgttctttcagggatagattatgtatataaaaacagggaattgttaacgtttaagtaacggggatgttacatgaatgtaacatgtattgaaattttgagagttttatattaatgtgttagcgatagataggaatgagaatatgaatataatagtagacgcgatgggcggagacaacgccccggaagaaattgtaaagggctgtataatggcagcaaatgattttggtgaaattattacactggtaggaaaaaaggatataatcagcgaacatttaaaaaaggccggatataacggagataggataaagatacaaaatgctgaggaagtaataagcggagacgatgagccgactaccgcgataagacagaaaaaggattcgtctttaagggttgggcttgatatgctccataaaggtcagggagacgttatggtcagtgccgggaacaccggggctttgataaccggagccactctgatagtcaaaagaataaagggagtaagacgcgtggctttggcgcctctaatgccggctgaaacaggctgttttttgttggtcgacggaggagctaatgttgagtcaagcgcggcattcttaaaacagtttgcaataatgggttctatatatatggagaaaattatgcatattaagaatccaagagtaggattagttaatataggttctgaagaagaaaagggaaccgaggatgttacagaagcaaacaggcttttgaaagaaataccgataaactatactggatatattgagggccgtgaaattccatgcggagcggttgacgttgtagtgtgtgatggatttacaggaaatgtaattttaaagtttatggaaggtatgggaatagtaataaaacgaatgttgaagggtatttttttcaaaaaccttaaaactaagattgcggctcttatggttaagggcggaattaatgagcttggtaaaactcttgattatactgaatacggtggagctccgcttttaggatgtacaaagccggtagtaaaggcgcatgggagttctaatgcgaaagcgttttatcatgcaatcagacagtctatagatatggtgaacaataatctagtggacactatttctgaaaatataaataaatattgatttaaagggatggattgatgcttcggcatagaatagtgttaaaaaatctatgctgtgaaaatattataggaaaggcaatgatgatatgagtaaaaagcatgcaaaaattgtgggcgtaggcagatatctgcccgataagatacttgataacgcttattttgagggtatagtcgaaaccagtgatgaatggattctgcaaagagttggtataaaagaacgccgaatgagtgatgaaaatacatttgcttctgatcttgcggcaaaggcggcagaaaatgccttaaaagacgccggcatggatgcgagtgagattgaccttattgttatggcttcggtgtcgccggagatgtatacgccgtcaggcgcatgtattgtgcaaagtaagataggtgccaagaatgctgcggcctttgatgtgaatgcggcgtgcccggggtttattttcgccattactgtcgctactcagtttgttgaaaacggagtttataaaaatgtgttagttatcggagcggatactctgacgaaaattactgaatataaagacagaagcacatgcgttttgtttggagacggcgcaggcgctgcaattttgcaggctactgatgaagagacaggggtcttgggttcagttttaggtgctgacggcgacgcaggggacgttttaactgtgtgtggattaaaagtttctgagcttgataaagagagacgtccgtttggaaactacagaactatttggatggacgggcagttggtatataagtttgctgtgaagacaatggtaagttcgacaatagaagtggttgaaaatgctgggtatacgattgatgatatagatttggttattcctcaccaagcgaatcaaaggataatacaaagtgccagaaagaggctgggtcttgatgaaagccgagtattttccaatgttgagcagtttggaaatatgtctgccgcatgtatcccggtagctttgtgtcaggctatagaggaaggcagaataaaaaaaggtcaaaaattggttatagtgagtatgggcggcggtcttacatggggcagtgtgcttattgaattgtaaacatgttctttaggaggaaaatatgaacagaatttgtgaattacttggtatagagtatccgattatacagggtggtatggcttgggtggccactgctgaacttgcggcggctgtgtcaaatgccggaggtttgggattgattgcggctggcggtgcgcctgctgacgtggtcagagagcagattaagaaagccagaaccttaacagataagccgtttggcgttaatgttatgctgatgtctccgttttccgatgaggtaatggaagtggttatagaagaaaagccggcagttgttgccacgggagcaggtaacccgggcaagtacatagaaagactgaaggaagccggaattaaaattatgccggttatagcgagcgtagctatggctaaaagaatggaaaaagcgggagctgacgcggtaatagctgaaggaaccgaagcaggaggccacattggtgagctaaccaccatggttctcacaccgcaggttgtggacgcggtttctattccggttgtgtctgccggcggatatgctgacagcagaggtactaaggcagcgtttgctttgggcgcagacggtatacaggttgggactagatttatttgttcaactgaatgtattgcacatgaaaattacaaaaatgctgttttaaaggccaaagacagagacgctgttgttaccggacgttcaaccggagcacctgtcagagctttgaaaaataagctgaccaaagaatatcagagacttgaaaaagaaggagcttctgccgaggagatagaagaacttggagtaggcggtttaagacgcgcctttcaagacggtgatattgaaaacggttctcttatggcagggcaaagcgcggctatggtgcatgagatacagccatgtgctgagatagttaaagattattttaaggatgttgaattttaaatatattgttgtatattagatagagttattgttttacatatgcggtcttatccggctcacggtaagaaacgcggtcttataacaatgtgagccagaaaggctatgataaatatgaaaacagcatttttattttcaggacagggagcacaggctattggaatgggtaaagagctttgtgagaactttcctgtagctgacgaggtttttaacagcgcaagcgaagctttgggatttgatataaaggatatggtttggaacggtgataaggacactttaatgataactgagaatacacagccggccatcttgactatgtctgtggcggctttaagagtggctgaaagtttaggtcttacaccagatgttgttgccggacttagtcttggagaatacactgctcacgtagcttcaggaagcatggagtttacggacgcggttaagcttgttaagaagagaggcaagtatatgcaggaggaagttcctttgggagtaggcgcaatggctgcgataattgcgttaacgcctgaggatgtaaaagaaatatgtaagcaggcttcaagcaaaggaatatgtgagccggcaaactttaactgtccgggacagattaccgtggccggtgaggttgcggctgttgaatacgcgtgtgaacttgcaaaggaaaaaggcgctaagcgcgctatgctaatgcctgtttcagcgccgtttcactgcagtatgttaaagggcgccggagagaaacttgaaaaagaacttgaaaatgtcactgtatctgaaatgaatgttccaataattaccaatgtgacaggtgattacataaagagcaaggatgaaataaaagagcttttggttcgtcaggtttcaagctcagtattatttgaagaaagtttaaaaagaatgatagctgacggagtagatacatttattgaaataggacccggaaaggctctgagcggttttgtaaagagaatagataagactaaaactattttaaatattgaagatatggcgtcattagaaaagacaaaagaggcattaagcttataataaaggttctgttttttcagatagagttagataaatattttttgaaaagtttgactgccaattataattaacaatcggaggtagtgaaagtggagtttaaggataagtgtgttatagttaccggaagtgccagaggaataggcagagaaatagctcttaagtttggcgctgagggtgcaaatgtagtcgtgtttgatataaatatagacggccaggctgaaaccgctcaggcggtatgtgatgaaataaaagcattgggaggagacgctaaatacatattgggtgatgtctcaaaaccggatgatactgacgcactgataaagtttgcaaaggatgaatttggaagcgttgatgttatagtcaataatgcaggtataacaagggataatcttattatgcgaatgagcgagtctgattgggacgctgttcttactgttaacttgaagggagcgtttaatgttattaaatcagctacacgtactttaatgaagcaaagaaacggcgttataataaatatggcgtctgtatccggcgtgacaggcaacgcaggtcaggctaattattcagcttctaaggctggcttaataggtcttactaaatctgttgccaaagagcttgcttcgcgtaatatacgctgtaatgcaattgctccaggatttatcagaacacctatgactgataagctcagtgaggatatacagcagtcttacaaagattctattccgcttaaaaaatttggacaagttgaggatatagctaatttagcagtattccttggcagtgacaaatcagaatatattacaggtcaagtaataaatgttgacggcggacttgtaatgtgatataactatttatagtaaaaataaatttatataaataaaaatgaaattttattttggaggagaattgaaatggaaatttttgaaaaagtaaaggaaatcacagtcgatcagctcggagtatcagaggacgctgtaactatggaagcatcatttattgatgatttggaagcagattctcttgacattgttgaattaatgatggctcttgaagaagaattcgacatagagattcctgatgaggatgctgaaaagattacagcggttaaagatgctgttgaatacattaaagaacatcaagactaattatgcaataggctggactgcggagattaaaaaatctccgcgggtttccagactcggtatgaattatatagaagtttgcatccggcttgatgttatgcggtgcaagtctctatatgatttgaccgtgtctaaatcgtatttgattttgttttcctgcatatttttgcgggcaatggttatttattttgatgctgtgcatcggattgaaataggaggataaatatgaatagagtggttgtaacaggcgttgggggagttaccccggttggtataggcagagaagaaatttgggaaaatattaaaaacggtgtatcaggcattggcactattacaagatttgacccaacagattttgcatgtcatgttggagctgaggtcaaagactttcaggttacagattatattgataaaaaagaagctaagcgtatggacttgtttgtacagtatgcggttgccggagctaaaatggctattgaggacgcaaaacttgatatggacagtgaagacccaactagagtaggcgttatggttggatccggaatcggcggaataaacaccttatgtgaacagcataaaagaatgcttgagaaggggccgggaaaggtttctccatttatgataccgatgatgatttcaaatatggccgtaggtcaaattggaattatgtttaattgtaaaggtattaatatgactactgtttctgcgtgtgcttccggaactgattctattggtcatgcaatgcttgccgttcagcgcggagacgctgacgttataatagcgggcggagctgaggctactataaatgaacttgctttggccggattttcatcaatgaaggctttaacaaccaggaacgatatacctgagaaagcatgttcaccttttgacgctaatcgagatggttttattatgggcgaaggcagtggtattcttataatcgaaagtttggaacatgcgcttcagagaggagctaacataatagcagaacttgttggatatggctcaacgaatgacgcatatcatatgacggctcctgctcctgaaggtgaaggcggtgcaaggtgtttagcactggctgtcaaagacgccggaataaaacctgaagatattgactatataaatgctcatggaacatcaacaccttataatgataagtttgaaactgcagcaattaagactgtttttggggatcatgcatataagctggctgtaagctcaaccaaatccatgacgggacatatgcttggcgctgccggcggagttgagggaataattacagcacttgctgttaaagacgactatttgccgcctacgattaatctcgaaacccctgaccctgaatgtgatttggactatgttcctaataagggcagaaagtctgaaataaattatgctatatcgaattcattaggatttggcggacataatgcttctatcgtgtttaagaagtatactgattagtaaatacataatatcaggtcgggagggtcaatcctcccgatttttatatgacaaagattaagaggttatttatatggtgattataataggaggagcgagccatagcggaaaaacttttttatctaaaaagctaattgaaaagtataaaattccctgcactagcttagaccacataaaaatgggattgatacgcggttttaatgactgcggtttttcagcagttgacagcgatgagacaatagcagaaaagatgtggggatttatagaaggtttcatcagaacctgtattgaaaataatcaaaatacaattttggaaggctgctattttccgtgtgaaaaggttaaaaaacttttatgtgatgatttaactgttgtttttattgtattgtcaaaacaatatattattgaaaactttgataagataataaaatacgaaaagatagtagaagatagaaaattcccggagagcagagaaattaaattttttattaatgaaaatgagagactaaaggaagagtgtattaaatatgaacttccatattttgagataaccggtaattatttcgaaggactagaaaagatacttgaatatattaaaagtaaagcggttaaaatttgccgttattcacataatgatattaatgaaatatgtagtatgttttgcgataccgtgaaacatatcaacaaaagagattataccgcagaacagattgccgcttggatgggcggtatagataaagataagtgggacaaatcattatctgagcatttttctttagaagtaaaggtaatggggaagattgccgcgtttggagatatagacggagaatatttggatagactgtatgttcataaagactttcagggattgggatacggaaaaatcattttgattcactcgaagagcaagctatacagtcaggatttaaaaggatttggacatgtgcgtctataactgcaaaaggtttttttgagaaatatggttataaagtgataaaacgtcaacaagttgaaagaaaagatgttttattgaccaattatgttatggaaaagcattttgaacaggagtatagcaatggaatataattataaatttaaaaataaaaaactatttgatttggcaatgacgcatatttcacttgccaatgaccttcatatagaaagcaatcagcggcttgaatttttaggtgacagcgttctctcgtttgtggttgctacttatatttataatgaatataagaaggtggacgagggagtattgacagaacttcgcgcaaatgcagtgtgtgaaaagactttggctattgctgccagaaatcttaaacttggagaggatttaaagtttggaaagtctgaacgtatgtcaggcggaaaggataaagattccgttttggctgacgcatatgaggcgttattggcggctatttatttagacagtggaatagaaagcgcaaaagactttattatggatacaataggcagcatgataggcgatacttcttatgttgaactggaaaactataagtctgaaatacaaagttattatcaaaagcgtgatagaaacagagaagttgttaagtatcgtttggtaaataaaaatggacctgaccatgacccgacgttttttgtggaagcgctgtaccgtgatgaagtaatcggcaaaggcgagggaaaaaaccgaaaaagcgcagagcaggaagccgcaaaagctgcgcttgctaaggttaagggaagtaaggaatagctatgcgaaaatataatatacctatttttattcctcatgaaggatgcggacatgattgtgtgttctgcaatcaaagaaagataacagggattcaaagttcggtttctcctgataaagctaaagaggaaatagctcggtatctttcaacaataaaatctgaagattgtcagattgaaatagcctactttggaggaagttttaccggtcttgatatggagctgcagcgagaattcttggaggcagcttcgggatttaaagacgaacggataatcggaataagaatgtctaccaggcctgactatataaataaagaaattttagagcaatgtgtggagtttggagttaaaacaattgagctgggagttcagtcagccagtgacagagttatcgaactgaacagaagagggcatgtttttgaagatgtaattcgtgcggcggaaatgataaaatcattcgggatagaacttgggcttcagatgatgctgggaatgtatggctcagatccggaaactgatattgaaacatgcaggaaaattatagagcttgaacccaaatgcacacggatatatcctactctagtgcttagcggaacagcgcttgaaagtttatacagctgcggcgaatacataccatatactcttgaaactgctgtcagcactgcgaaaaggtgtttgctgatgtttaggaaagcaggagtagaggttattagaattgggctttatccgggagaagatttaagaagcgaggggaatattgtggcaggcccttttcactctgcatttggggaacttgttgaaaacgctgtatacaaggataaaattgaggaagagattatacagaagagattaaaggactgtgattatgagataatagcgctgtcttcagagacatcaaaaataattggacagaaaaagtgcaataaggagtatttttttaaaaaatacggagttagaataaaagtaaaaaaccggttagggtgaaattatgcttgagatggagatgaaagacgcctttttttggtatttggattcaaaatatgagaaagtaagagttatagaggaaaaggtaatagggaaatcgcgtgcggatgttgttgcggttttaccggatagaataatagggtatgaacttaaaagtgacagcgacagttatcagcgacttttaacacaggttaaagactatgataaattttttgatttcaattacttagtggttggagaaagtcataaaaaacatgctggtgaacatgtgccggaacactggggtattgtgacagtatcaaaggatacgggagtaaatattatgcgcgaggccgaacataacaaaaaagctaaaatgcgctggcagctgtcattgctgtggaggagcgaacttctaaacattcagctcgagaacggactgcataaatacagtcaaaaaagcaaatattttgttataaaatatttaatggaaaatgttgaaactgaaaaattaaagcgtcagatttgcaatgaactttttgagagagactatacattgctgtcagaataataagatttatattaaacaggataggttatataacctatcctgttttaatattagtattttaaagtagtttatttaaactctttgcctacagcaaattttatcattgcaataaaggctgaataatctttactgtcacttactttggtaaaataaccaattgtaccgcggctgttagtattgataaagcagaagaaccaagagtctgttgtcagaaaatctccttccatagtataacattgacggttgtctgaagaatcagctgtaagagcgacgcatttgcattcaatactgtaggtactgtcagcgtctttgaatatgataactgctgctttagttgaattattaatactttctattttaatttcttcgactatatcttcaaaatctaaatctgccttagtaataatatttttatatgcgttatacattacatctaaatcgggagcatcttctaaaaatgtattatcaattatgtaagttgattcggattccagctgaatgttaagaatagcacgttctattgccaaataccattcattttttatagtgttctttaactcttccggtttttcgtttagatagttataaaaattatttgtattataaagtaaatatggaagcaatgtctgttcatatgaatatctcaaattttctgctgagtcttttagctttttcatgtcagagtcagttaattcacttgctttaatagacccttcagttgaagtgccaggcgttggtttagtaactgcagcagaagtcggttcgggaattggtgaaggagtgttttcagatattatagctgtgggaaccggagctgttccggttataataacttgctgtgtttcttctatccagtctacagctgcatcaaggctttctgaaacggctcgaataggtactaaggttctatcttctatcattctggcgggcacatctaaaattatggattcctcatttttgtacattatattgctgtctatagttattttaatcgtattgacatcttttacagctattgcggtttgtgttgtttcatcccaagttactgttgctcccaaagcttcaaatatagcacgcattggaaccaaagttctgtcattttcggtgacaggatcaacatcaaaattaatttgttctccgtcaacaaaaacagttattacatcagtggatgcaaaaatctgaaatgacattactgccgtaaacagtgcgaaaattactgcagcgacagaaatttttttaaaattctttttcataataatccctccgtttatagtttattatattataaatgaaatgtaatattttgtcaaatattgtaatttaatttaaaaataataaaaatagtatagaataaattttaaatataacttaaatataatattaataagaaatgtgtttctgataaatcttaatccttattcttgtcaaatgaattttgaatttaagttgaattaactttatcggtatggtacaatttagtaaatagaatcgtgttcttaatttataaattataagtatttaagactcttataaattgttttataagaaaggtggagggagctatgcgaaaaaggggagtattattattttgtataataattttttccatagtatgtactgccgtcctgcctgtgtgggctgacggtgaaaaagtgcttgcttttcccggggctgagggcggaggaaaatatgcaatgggagctcgtgcctcagaaaacccggaagtttaccatgttaccactttggaaagtacaggtccggggtctcttacagaggctgtttcaaagagcaacagaatagttgtgtttgacgtcggcggtacgatttcttatgataaatggaaacagctccgtatagaaagcaatacaactattttggggcagactgcgccgggggaagggattacaattgaaggcactgatttaagtgatttcgccgggaagtcaaacataataatacgatatttaaaaataagacccggtgatagattggaaaaagaggtagacggcatatcaatgcagtatataagcgacgttataatagatcattgcagtgtaagctgggctgttgatgagcttgtctcggtttattcaggaagttccgaaaatcaaagatatgagcttggaaaaaatgttactgttcagaattgtttgatgagcgaagcacttaatctttcccgtcaccaaaaaggcgagcatggttatgggtcaatttttggaacagataattccacgctttaccataatgtttatgctcacaacaagtcccgcaatccggctatataccgtgaaattcagaatgttaatgtagccaataatgttatttacgactggggcgggacagcttcgtatggggggcagcctcattcaataaactatttgacttttaagccgtgtacagtgaattatgtaaataacttttatagatggggaccaagctcaggtgcggaggttcgaaatgttttttacaatattgaaaacgagactccggatatatcaaagtcaagtttctatttcagcggaaacgtaattgatggagttgatactattactaatgataatcttatcggagttacaaatctgaacaacgctgtgatcctggataaaccgattgatttgggtgagtatgaagtgccgcaggagactgcttttgatacatataattctatacttgatactgtgggcgcttcaattccaaaaagagatgctatagacgcaaaggttataaccgatataaaaaacgggacaggacatattattaattctccaaaagaagttggagggtatataaattccgaacctgtgtatagacgttttgagatttctcaggactggaaagagaaaaatggaatgggcagttatgcagaaagtgatattgtttcggaaggaaaatggaaaggttatacttggattgaagcatacgtatataatatggatgagatgagcgggaggcctacaaatcctgatgttgttgtacagtctcctgcaatagcagcgaatcaggataaggttatgggactaacagttgataaaggtgaatggaaagttataaatgaaggtgaatcgtttaattattcagcagttgcctttcctaaatcaggcactcaaataacaaaaattgagctttacgatggtgatatgcttatagatacagttgagtcggataagatagaggttgatatttttccgtcaagcggcgttcattattatacctgccgtgcgtataacggtaaaaatgagtctgcaaactcagcaacggcgattgtttgcgtaaatcctgccggagtagtgcctgaagaatttaaatatgaggttttaggaaccaaatggtataaggaatctgctggagcgtctatggatgagaacggtattatcacggtaggaggttcaggcagaataaaatctaagaacagctgcggatttttataccgcgctgtcagcggagatttctcggcggttgtaaaagttgaggatattcctaggtataaagacagaataagagctggacttatgctgacagataagcctgctgataattcaaaacttgctatgatttctgacaatttggacagaatgggtgagaatatttctattattactagaaaagttgaaaaagagaatatagctcaagtttatatgcgtaataaaaatggcatggaaatttcaaattcaaattcagattataatactcagcttgaccagtataggatacctgaatatttgcgcatagagcgccgagacaacctaataaaattttcagtatctgatgacggagctgattggactaacaatccgaggcagccatatgagataatgtttgagtctctgcctgaaacattgtatgttggtttaggagttgagtctaatccgggaacatacccaaaacctctctattcaatggcaaagttcagcaattttaaaattatagaatataataagcttgctgaaactgaacgctgggaaattgaagatcttagagataatgttgtaagcatatcaaataagttgaacgagggtgaaataacgcctgacggaaaacatattaatgtttatgcagctgtgtatgatgatacggaatccggatgccttcttaaccagtgtgctgtaggttcgtttactacagacaaaaacttaaataaatacgatgttcagcttgataccgggagcggaatattagatattagtaaaacaaagttgtttttgtgggatgacaatatgagacctgttcagctttttcaacaacaggattcttaatagattaaaagcacttaaaaaacttatttattgattttgagcgttatattttggtttataaaatcttaatttattgaccggattatggaacagttgtaaaatatattaaaaggggaagtttgtatgaggccaaaaagaatcggaggggtaaacccagctattcaattaataatggcagtatttctgctggtagtcggaattcttatgataacggcgcctgagtcttttattcgatggctttttctaattgtatctgttggcatggcagcttttgggtttatgtctttgatttcggctgtatttggaaaaaatggaactagacttggatcgcttatttcaggtatattgtatatagtaatcagtatagttattttaactcaaaaagatttttttcaagccgctgtcagcagaatttttagtttgctggcactggtgcaggcggttacaaatttaataagcggctttctgctttataatgataaagtgtccggatatataagaaagtttttttggggtatagtggcgtttggattttctgtattgttgttctttgacccacttggtcatattagggcagtcgaacttatttcagggatttatctgatagtttttgctgtatcaatggcattggagtgtatagatagttttcttgaaactgattatgcaaataaaaaggtaaagcccaaaatatctcttgcattaccaatagtttttgcggcttttattccgtcaagagcccttaaatatataaatgataagctggaatccggacagatggaaaaggcaaagttttcaaagcctgaagacagttatggcaagttagaaatttttatacacttaaaacagggattgatagaaggttttggacattgtgatttctgttttgacggaacggtgtactcctatggctgttacgaccagcactcgcagaagatgggcggttttatctccggcggaacagcttctttaacaaaaagagagccatatattgagcattgtatgagctatgaagaaaaaatgctggtgggattttcgctggaactgggccgagatgattatatgaatcttaaacgtgagatagataggatgctaaaacaaactgaagtctgggaaagcgacctccaaatcgcagaaaaagagggccggccggcggaggaacagaaaaagtgcaatgatccggcaagcgagctttaccgggcttccggtgcttcatttgttaagtttattgatggacaatataaaacttattttgcattaggctctaattgtgttatgtttacatacgatattatgaaaaatgcagggcttgatagtttggctttcagcggagctatcacgccgggaacgtatatggctcatcttcaggatttgtatgaaatgaaaaacacaatagttactgatatgcacgtatatagttatggtaaaacaaaaaactgattttttataggacaaagttacttttttatgacaaatttatatattttatttacataattgcaaaaatgagatatactactatatatagtggtctgaatggacggattttgatgtttttacaatggattgtggctgcttttgattaatatttaaggagggctgtgtatgcgttgcatgtattgcggacatatagacagtaaggttgtggattcccggtcaacagatgatggcacggcaataagaaggcgaagggaatgtttaaactgcggcaagcgttttactacatacgaaaagattgaaagtgttcctataatagttgttaaaaaagataaatcaagacaaagttttgatagggaaaagctggaacgtggaattttgaatgcctgtgccagccgcccggtgcctcttcagactattgattctatgattagcgacatagagagcgcgcttcataatactttgcaaagagaagtttcaagtgaaaaaatcggtgaaatggtaatggagcgtctcagagatattgacgaggttgcttatgttagatttgcgtcggtttataagcaatttaaagatattgaaacctttcaggaggagcttaaaaaactttctcagaacaagaattgatatattgatttaacataagcagtatggtgaaaattatatattttgataaagcctgagtgaaatttactttataacattcaggtttttttgtttgttttattgtaattataatatatatttatgttttttaggaaatttactgattgactaatcgtatacaaaaatgctataatacattatatatataatagattgaaaggtgatggatggaatgaaaaagaaaagtatgagttttatttgcactttattttgtttattattggggattgttatattccttggtatgtctttatgcgtatatgctgaaggcagccgtgatttaataaacagcgctgcaggtcagggggatagagcgtacatagagtatcagggagacaatatgctgagtgttggacttcagcggcagcaatatgtaaacgtatatatgttttccggtgagacagcatattttggcagcagtgttgctaaagcaggttcaattgaggtgacagacccaaaaggtgagaccgtattatatgatgttaacgcggcgggaaatggatttataggaagcataactagtgaggcggcaggtccgaattataatggtttaatttctggcggatataatcctatttcatttgttgctgatagaaacggtatatataaatttatattttacagcagcaattatagttcttcaaaacctaataattctactaatcctacagcaacaaaagtttctgacgataattttgttgctaatcaaaaagacgccgctataggagcatgggatgttaccgttgttgggacagcgggagacggtactgctgaagtaaagaccggcagaatgtatgccgactatttgtcgttaaacatgggggcaaatgagcgtagcctatattcaaaagtctatgttttaacatctgatggatatatatattatacagactttaacggaatagacccgtttgggtttacatttttcggaaataacagaggtcttgtatcatccagaaccaatatgtcgctttatcattcaatggaggatgcgatcacaagcggtaatacaccggacctgaataattttagagatataaccgacaaaaatggagcaaaggacggaatgtatctgccgggacccggcaatacgtcgacccagcttgattcctcgtttaaaatattttttaacgaaccaagcggtgagcttcctgatagtataaagccggcgcctcagccgcctggaactattgattatttaaaatttgaaggaagcgtgttagactcaaatggaaatataatcgaaaatgaaggctatgtcggcggcggtggatattttattataaatgccagcaaagtttcaaactttgaggttaaaattgatttgagcaatatatattataagacaaatacagaaggaaaaatagacgaaaataattttatatatgaatatcccgtgggcagcggaaattatatgagtatgaaagatgactctacggttgttattgataatatatcagaatatattaatgcgggtacagtagtaatcggaaactcttgtgtagaggggataaacagaatattctggaatggctgtgatgaaaacggacgtgttcttcctgccggaacttactttgaggcgggaaagggaaacgcggtggcgattccaaaagccggagaatatcacttccctctgatagatgttgaaaacttgccgaatggtctaaagattacccggctgaatactccggatacctttagtaaagaatagagagattttgtagataatcataaatcttatctatattataacaacattgaaaacagtgtgttgagaaccggaaattataatggcgttgaccgccaaaaaatctggactgttgcggataagcttaataaacgttccggtgtgaacacggaggcgagcggcgcctgcattgtgacaggcaggagtgctgataaaacagtgcttgatttttggacagacttgcgattgtctgatgatgccggaaccaagagtaatcctgttgaattaatagacagaaccgacagtgttgagagcatgcttcttgcaggatttacattctttgattatgacttcagcggaacttatgatatgttgacaaacgactatgctctgtcaaatgtcaaggtcgaacttctggacaataatggaaacagtattgcggagacggtttctgattccagaggtttttatacctttgttgttccggataagtcggcccaatatacaataaaagtaactcttccgaatgatacatatttctgtacaaccgcaaatatggaacaaagtactgttcctcaagatatagtggttgggcaaaccgcttcggttgaagacgttggttttctggctagagaggcaagcccgattcgtataaataaaacctgggcagtgccggatgaagaacagccaaaaatggatgtagaatttttgattgaaggccgggatcaaaatggggacgaaaattcaccggtgctttattcaagaactgcagttgtaaaggattctgagggatattcaactttggttgaaggtcttccggctgtaatatttgttaatgaaaacgaggtagacttaagctatactgttaaagaagtgacagatataccgggatttaccggcactataacttctgagaccggcggtcttgtatgggattgtgtgaataaacctgaggatattagttttactgttgaaaagacttggtcagtcgcatcgaattttactaaaccggatgatataactgtcagtttgatgaagaaaaatgaaaaaggtgagttagtaaaagttgatggtgttcaggatcagcctcttaataattcaaataactggaaagcgacttttgagccggttccaaagtatgaggaatacgttgaaaatggggcagccaaatacagagcaatagactatactgttgttgagaacaatataccaagcggatttgcagcgtctatacaaaagtctgctatagaaacaaaaacaaatacttttattgtaactaatactgctgaaggttcagttaaactaataaaagtagataaggaaacatcttcacctctgcctggagccgagtttaaattggtgcagcttgatgaagacggtattagttatcttgacgttaataaattaaagccggtatatgattctttaaatgaaatcgaaaagtatcaatacgatgaaaattcaactatcgataaattagttacaaataaaaatggtgaaattattgtagaaaatttatctatgggaacatataatttcattgagacaaaggctcctgagggatatattactcctgcagaaaatgaggcgaagtcaagtgatatggttcttggcagcggagtaaattcatctcaagtgaaaatggaaaactctttaaatatcactccaactccgatacctacagcaacatcggcaccgacagaaactccaatgccaacggcaacagcgacacctgagccaacagcaacggcgacaccggttccaacggcaacagcgacacctgagccaacagcaacggcgacaccggttccaacggcaacagcgacacctgagccaacggcaacggtgacacctgagccaacagcaacggtgacacctgagccaacagcaacggcagaacctgagccaacggcaacggcagaacctgagccaacggctacaacagaacctgagccaacggcaacggcagaacctgaaccaacggcaacggcagaacctgagccaacggctacaacagaacctgagccaacggcaacggcagaacctgagccaacggcaacggcagaacctgagccaacggcaacggcagaacctgagccaacagtaacagcagagcctgagccaacggcaacggcgacacctgagccaacagtaacagcagagcctgagccaacggcaacaacagaacctgagccaacggcaacggcagaaccggaaccaacggcaacggcagaacctgagccaacggcaacagctggaccgcagccgggcgatattgtttctataaatgtatcaaaaatatgggaagacgcagaaggcaccgcgagtctaactccaccagcggaacttgatggaagtcaaatagaaattgttcttattaaaaacggagtaagaactgagcaaagtcttgtattaaacaatgaaaacggatttaatggaagttttaataatctcaatagatttgatgaatcaggaaatgttatagactattcagtccaagaagttaacgctccgtttggttattgtgcattctatgaaaatgacggaatcaacagctggaccgttacaaatgcacaggcgaatattacaggaaaggtattctatgatgctttgaataacggtgtttatgatttggataccgattcatttattaagaatgcaaaagtagttcttgaggatgaaaatggaaatcaggttggagaagctgttttaactgatgaaaacggatattatttctttagccgtgtaccggtgaatgatgatggaactgaaacaaaatatacagttagggtcatttcccctcttaatgatgtgaagtgtaccacaactgagaccggaaaccagactgaagaaattataggcggttctttaaatgtgacacagagcgttgcgctctccaagacagatatgattatagacgcttctgacacaggtctgtatggagatgttaaggatttagaggaacagaatataaacgttgcggttaaaaaagtttgggaagataataataaccgtaagggtaaacgtcctcaagaattggaagtatattataccttgaaaaacaaagagggtatcgttataatttctaaaactttgattctgaatgaagaaaacaattggcaggaagagtttataatgccataccgtgcaattgaagattctgaggttgtggagacccaagttgacggatataaggatcccaaaataacaagtacagttgataaagagagtgaaaaatttattataactgtaaggaattcaattgtttcaaattcaagttcaggcggcaatggaggcaaacctactggaggaagcacgggcacagagacgggcgcaccgtggccgacatctactgctaaaccgaatccaaatgtatcggcaactcctaaaccggagattcctgaacttgataagacgaaccattacgcttatattatagggtatcctgaaggcgatgtaagacctcaaaatgatatatcgcgcgatgaggtagctacaatattctttagaatgctgacggatgattcgagaaatgaattttggatgattacaaatccatatactgatgttccggcagacatgtggtcaaataatgcaatatcgacgatgtcgaacgcgaaaatactgaccggtgacccggatggaaaattcagacccgctgacagcataacacgtggcgagtttgcagctatagctgccagattcagcagtaaagagtataatggcgagaatatgtttactgatataatcggtcattggtctgaggaatatattaaccgtgccgcacaagaaggctggatttcaggttatccggacggaagcttcaaaccggaccagtacataacccgtgctgaagcgatgactcttgttaacaacattttaaaccgtcacgccaaagagagcggtttgcttaatgatatgctgaaatggccggataatgtgcccggagagtggtattataccgctgtccaggaagctacaaattcacattattacgaccgtgacagcgacggatataacgagacatggacagaaatcagagaaccgcgcgactgggttcagcttgaaaaaacttggtcggacgctaacagtgccggcagtgaagattcggtttatagcggagagtaatatttaaaataaattttctgcaataaccgttttggaaaaaaataataaaacccttgacaaaaggggttttgagtgttatcataatagaagtaaatgatatcgggcagaagagtgagggaaacctcactcttttgcattgtattatcaaagttaattgttggtattgagaattcagagaggagttgtggttttgggagcgatgacgttttcaaagattgaaaagattatattcgaccttgcggagccgatagctgaagagaatgggctttatatctatgatgtagagtttataaaagaaggcggacattggtttttaagagtgtatctggataaaccggaagaaaatgagtatatatctattgacgagtgtgaggagttctctagaaagcttagtgacgttttggataggagtgaccctatatcgcagaattattatcttgaagtttcctcaccgggaatagagagaaaaataagacgtgctgagcattttgaagccagcaagggcgagattgttgatgccggtctttacaaagcaataaacggcagtaaaacgcttacaggtgaacttatgggtcttgatgacgaagataatgtgcttttgaagatagacggcgagactgtgaagatacctatcaaacagactacggttattaggactcattttgaattttagtctttgccgagctgtttaaaattaattaaatatgtatatcaaatttcacatattatatagagaggatgtttaagaaaaaatgagcgcagagttgtttaatttgttggacgagatagaagaagagaaaggtataagtaaggacgttgtgctggacgcgcttgaaagcgcgctgatatcggcatacaaaaagaattttggcgcggttgaggatataaacgttaaattttccgatgacggtgatataagaatttttgctagaaaagaagttgtagaagaggtagaggacagggaaacacagatttctttggaggacgctcaaaaaattaaaggtgattataaggctggagatgttgcagaatttgaggtaacacctgattcattcggcagaatagccgctcagaccgctcgtcaggttgtttttcagagaatacgcgaggctgagcgtgagaaaatggtagatgaatacagtgaccgtgagaatagtatcgcgagtgctattgtcagaaaaatagagcgcagaaatgttatgcttgaaattgacggcgccgaatctgttcttatgccgaacgaacaggtgaaacatgataactatagagttggtgaaagatataaagtatttgtcgttgaagtagctgatagtataaaaggcgtgcatttggttgtttcacgttcgcatcccggtttggtaagatgtttgtttgaacttgaggttccggaaattgcacagggaataattgaatttaaaggaatttccagagaggcaggttcaaggtctaaaatcgctgttgcttctactatggataatgttgatcctgttggaacttgtatcggacctaagggaatgagagttcaaaatgttattgatgaattaagaggagaaaaaattgatataatcagatatagtgatgatccggcggagtatgtttcaaacgcactcagtccggctgatgttgtatcgatagaagtctttcctgaaaataaaatgtgtaaggttgttgttcctgaaagccagctgtctttggctatcggcaaggaggggcagaacgttagattagcggcaaggcttacaggttggaaaatagatttgagttctattccggacaatgagataaagaaaggtgacaaaactctggaagctgcttttgagcagttgggaaatgagcttttaaccgaagaggatatggaaaatgaggtttcggagattttgaacgacagttattgagtttattatattggagggaaatatgccgacaagaatgtgcgcagtttgcagaaaacgttttgaaaaatcagaactgaacagagttgtaatgtcagagtcgggtgagattttttatgaccgtacaggaaaggcccaagcccgaggtttgtatatttgcagagaatgtgtgagagaagcggaaaaaaagcgtgtttttgagcgtgaatataagcgcagagttaagccgtcggtctatgagagatttgtgtcggaggtggagtccgggtgagtgatgaaaaactattgcggtttatcggtcttgctatgaaagccggaaagcttatgcttggagacggcagggctgttgaatctataaggtcagggaaggcaaaattagttttaatttccaaagatgcttccgataatactaaaaagaaatatagaaatatgtgtgagtatcggaatcttaaattattggatatattttccgacagaaatgaatttggtcagtgtataggcagagattttgcggtagtggccgcagttgaggacgatggattcgcaaagagaatcgttgaacttgcagaaagggttgatgaataatatggaaaaaatacgagcttatgagttatcaaaaatatttgggtttcccagtaagaatatagttaatgttcttcatgaatatggggtatcaacaaaaaatcatatgagtgctctgtcagagtatgaacttgatgttatttttgaatactatactcagaagaatcaagcaaaggatttttctatctttgataaaaagaaagaagagccaaaagaagcagctgaaaatgttagtgataacgaagacttcactccggttccggaaatagaagtaggcagaaagctgcgtactgttgatacgcgcgtcaataatgtggatcttgaccgtattgatgatgaaaaaattgaggagcttattcctgaaaacgttaaacagggagataagaagcagaaaataaatcagaaaaagaaacagcagcagagacagcagcacagcactaaacaaaaacgcaaacctgaaaatgttataaaaaaggttgaaaagaaagaaaagaaggttgagccgctcaatgtgctggtaccaaatgaaataactgtaggtgaactggcttccagaatgaaaaagtctccggcagagattataaagaagctgatgcttttgggtattatggctactgtaaatgaaactttggattttgacacagcctcacttatggtagaagaatttggcggaatcgttgaaaaagaaataattttaacggatgaggaaatactatttgatgactttgaagatacagctgaacagctcaagccgcgttcaccggttgttgttgttatgggtcatgttgaccacggtaaaacatcacttcttgacgctatcagagacacaaatgtgacagagggagagttcggcggtattactcagcatattggtgctcacagagtacgtgtaggagagaaaaagattacgttcctggatactccgggacatgaagcgtttacggctatgcgtgccagaggtgcgcttgttactgatatagctatactggtcgttgccgcagacgatggaattatgcctcagacaattgaagctattaaccatgccaaagcggctgaggtttctatcattgtagctattaacaaaatagataaggacggagctaaccctgataaggttaagcaggagcttatggaacacggtcttgttcctgaggaatggggcggagatacaatatgtgttgaggtttcggcaaagaagagacagaatataaaagaactgcttgaaatggtactgcttgttgctgaaatgaaagagcttaaggctaatcctgacagaaaagctaaaggaacagttattgagtcgcagcttgacaaaggcaggggttccgttgctactgtgttggtacagaacggtactttgcatgtcggcgactatgttgtagccggaaccgcatcaggtagagttcgtgctatgaacaacgataaaggaaagtctgttaaaaaggccggaccgtctatccctgttgaaattttgggattgtctgaggtacctgagggcggagacgaattttatgttgttgaagatgagagaaaggcccgcagtgttgttgagaacagaaagttccaggagaagaaagaaaagcagaagagcgctacggctatatcgcttgataatttgtttgagcagattgaagccggcaagatgaaagaccttaatatcgtcgtaaaggctgatgttcagggaagtgttgaagctgttaaacagtctcttgagagaatttcaaatgatgaagtccgcgtaaacgttatacatggtgcggtcggagctatcaatgagtctgacgtcatgctggcgagcgcgtccaacgctataattgttgggtttaatgtccgtcctacaaacggagcaagcgatgctgctgaagacgcaggggttgaccttcgtatgtaccgtgttatatatgacgcgattgaggatattgaaaaagctatgaagggtatgcttgagccgacattccgtgaagaagttaccggccatgtagaaataagaaccacatttaaggtttcaggcgtaggaactattggcggggcatatgttttggatggcaaaatcagaagagacagcttggtgcgtgttgtcagagacggtattgttatacacgaaggtgagctgaattcacttaagagatttaaagatgacgttaaggaagttaacgcaggatatgaatgcggtcttagcgtcagcaattataatgatataaaagacggagatattatagaagcatatattatggcacaggttgaacccgaataatctgtgccgtaaaggctcggataagaggagatatttatggctaattacagcagaaccgacagggtttcagaagagataaaaagagaattgtcagcaataatacgcgatttgaaagacccgcgtctgccgcagatggtatctgtggtttcggtgcgcgtcacaaaggatttgaagtttgctaaagcaaacatcagcgttatgggtgatgaaaaaactaaaaaggatgcgtttgcagcacttaaaagtgcggccgggtatattaaaaaagaggtcagcaagagattgaatctgcgccaaacgcctgattttacttttgttgaagacgatagcattgaatatggagcccatatagaggagcttttgaaaaatttatagttgtgaactgcattaggacagacgtatgaaaagaggtactatatgtttgaaaaactgattccaataatagaaaaggcaaataaaattgcaatattcacccacactcatcctgacggagatgctatgggaagttcttatgcactaaaattggcgcttacgtcaattgggaaatgctgtaaggtatttttgcttgatgaccctgacgcttccgcatttggactgattattaaaggtgatgatatcgaactgtcacttgaggattgtgatttagccatagcgcttgactgtgcggactctaaaaggcttggaatgtatgaagagccgtttatgagtcatcctaactcgatagctatagaccatcatgttacacatgttgaatttgctaaatcggggactgtgtattctgatatttcatctacatgtgagctgatgtttaatctatttaaagaaatggatatcagtataaataaagaaataggaaataatatatacgtcggtctggcgacagacacaggcaattttaagtattcatgtatcagcggagataccttaagggcagcaggagaattgatagatttgggtgtggattttgcgagcatatcaaaggctgcatttgatacaaagcctaaggcgtattacgatttaatggggattgctataggaaagctgagaatggtatgcgatggcaaagctgcagcgctctatttggaatctgaagattttaaaaaagcgggaataaaagaatcagaggccaatggtatagttaatataccaaacagtattgaaggagtagaggttggggcgtttataagaaagcgtgacgatgatgaatacaaagtgagtcttcgttcaaataaatatattgacgtttcagaaattgccgctgagagaggcggaggcggacatgtgcgtgcaagcggatatagtgtaaccggaaaaactgtggatgagataattcaggatttagcagagggattggataaaagatggcaggattaagcggtattataaatgtttataaacctaaaggtatcacatcccatgatgttgtttataagcttagaaaaattctgggaattaaaaaaattgggcatacgggaactcttgacccggatgcagaaggtgttctgccaatgtgcataggcagagcgacaaagactgcggatatgctcaccgctgccgataaggagtatatggccgaggttacgcttggtttctcaactgatactcaggattcatcaggctctgttataaaatctgttgatatggatgattttattgttagttctgacgacattgaaaacgcggttactaaatatataggcgatataaatcagcttccgccaatgtattcagctataaaaattggcggtaaaaagctgtatgagctggcaagacaagggattgagatagaacgcaaacctcgctttgtaaaaattaacagtattaagcttttggatttttatccaaataaagaacatgtgatgaaatttaagatgcttgtgtcatgttcaaaaggaacttatatcagagcgctttgtaacgacataggtgaagatttgaagtgctttgcgcatatgtcaggacttgtcagaactaaaagcggcagatttgatttggagcattcgtataaactgagtgaaatagaaaacatggcggcaatcggcaatatgtcgttttttacacctgtagacgaggtgttttccgagtatggaaaactagttctatcagataatgctgcctttaagatgtgcaacgggacacaggttaaaagccctgctgaagcaaaagacggcgttacatatagagtatatgatattaatggtaaatttcttactatctcacgtgcggagaatggaaaaatgaagatattaaagacattttatcaggattaattggaggtgtgagcgtggagtattacgcacaggatgagttgttcaacaagcatgatttggataatctgcggctgaaaaatacagctgttgcgctgggtgtttttgacgctatgcacttaggtcatcttgagataatagatgatgttgtaaaatatgcaaaggaaaacggtcttaaatcggtagtatatatgtttcgtaatattcctaagagtgttattactaatacggatataaaaaatgttaacctgttcaaaaagagactacacattctctatgaaagaggggttgatattgttgttgccgagaggttcacatccgagtatatgaaaatggaatatgcggattttataaaaacttatctagtggaaaaattcgacgccaaatatgtttgtgcaggatttaattatcactttggatataaggggttggggaatacagaatctctcaaagaactctgcggaaaatatggcataaaggtacatattgcagagtgtaaggctcttgaaaaacctgtgtccagcactcttttgagaaaacttattgcttcaggagagatggaggaagcagcaaaatatctaggacggcagttttcggttactagaaaggtagaacatggagaaaacatcggacataagctggggtttcctactgccaatatacaactgcctgattttcatgttgtacccaagttcggcgtttatattacaaaggcgaaagttggtggaaagtggtataaagctataacaaatgttggaggaaaaccgacagtcgggacaaataagccatgtattgaaacatatatgcttgactttgaaaacgatatatatggagaggaaatagaaatagagttttatcattatttaagacctatttccaaatttgaaaatattgaggctttaaaaaaacagttggctcaagataaagagtcagcaagagtttattttaatgaaaaataaagttagctgaaagcggaaatagactgcgttatatgcagtgggtttcgctttcttttttggggagtaagataatgagtgaaaaagtaaataaatatgaaatggacatgtgcagaggtccaattttaaagaaaatgctgatttatgccattccgctaatgtgttcaagtatactccagcttatgtttaacgctgttgatatcgtcgttgtggggaaatttgccggtgataattctctggcagcggtaggttctaatacttcaataattggtctcataaccaatttatttgttggtctttcagtagctgctaatgttcttgtggcaagattttatggagcaaaggacgaaaaggctcttgaacagactgtacatacttcaatgcttctcagtcttttcagcggtataattctctcaataattggagtagccggcgccaagtggatattggttttaatgcagacgcctgaagatgttcttccccttgcaacgttatatcttaggatatattttcttggaatggctgctacgatgatatataattttggaagtgcaatcttaagaggcgtaggggatactaaacggcctttatactttttgtttggagccggaatagttaatgttatattaaatcttttatttgtaattgtatttcatatggatgtagctggagtggctattgccactgtaatttcacaatgtatatcggcttttttgatagttcgttgtctgatgaaagaaaacagcggtatacgtctcaaattgtctaagcttaggataaacaaaaataaattgctgttaatttttaagataggactgccggccggttttcaaggaatattattttctctttcaaatgtggttattcagtcgtcaatcaattcatttggttctgtggttatggcgggtaatgcggctgcacagaatttagaaaactttgtgtattttgctatgaatgctttccatcaagccacagtgacgtttacaagccagaattatggtgctctaaactataagcgaataaatagaactgtgattctaggtgaaacatgtgttgctatagtcggaattgtactcggaaatttacttgttctatgcggcggcggacttcttggcatttatacatcaagcccggaggttataagcgcaggaatagacagacttaatatagtatcgcgaacatatgctttgtgcggaatgatggatgttatggttggtgctttgagaggtattggctattcggttataccgatgatagtttcattggtcggggcgtgcggcttaaggctggtttggatagccgctttgtttggaatagagcagtaccataatgtgacaacggtatatttatcatatccggtttcatggcttttaacttttatgatacatactttatgttttgttttgctaaagcgtcatttagaaacgcatatgaaaaaattcggagcgggatattaatcgcgtaaaaatatatttttgcatgattgtattattataaaagggtatttaaactttaaaattcattaaagttttactgattactgttttaaaaatactctgataatttaactttaaaaagtttattttctattaaaagcttttttttggaaatagtagatatgaaaattaggggctatacaacaggtgtgtataatgattatgatagatttttgactatagtataatttataataaaataatatattatactatatttttggtatcatttaaacagatcggtctgtcaaatagactgatctgtttttttatgcaatttatcctctaacactttttatgaaactgcatatcttatattgtaagagttttatttttattaaatataaattaggaggaatcactttgattgaagcagaaagattagtgtcttcacgcccgtttattatgtattcgggaacggatgtcagcggaaccgtagggggtaatccgagtgttcaaagttactgtggcttggattatacagccgcgtcccgctatcgcttagacagacctgatcataatcaaatatttcaattttttggaaatatattaggcagtcagaataaacttgtttactgtcttgataaatttgcagacggtccatataataacgtgccatatgagagccgtccgtttgaaacactttttccgggggcaacggagagacaaaaagaaatgttgggatggattttggcaaatacatttccggctgtgagcgcggctgctacatttgcgcttgccggagtagatccgacagcagcaccggttcttgacaataatgatgcgtatgcagccgttcaagtatcattatgggtacttttggaacagatagcgcttgatgaagttaattttttagagtgcacatcaggcgaaactcatccaaaatctgaaaggctgagaattacagttttagaattgcttcgcctggccggtcaatttgttgataatgagacgctgcctgaaatatcaattactcatacagagccatgctgtggattaacctcattttttagctgctgtaataatagtactttaccgtcagacggcagttctccatatttagtttttgcgaattgtcctaacgaggtcagaacaatttgcggaaggcttctgatagggccgtttcgtgtttcatcaagtttcgcaggacagccgactataacggttacgcctttctgtaactgtggtgaagattactcggtatcatttatggatttctgtggtaatccaatttctaatcctgttataggacaggagttttatattgctatcagaacttgcaaaagattttcgtgctttactataaccgcttcatttactggaaatattacaagagtaataactttagaaccgcagagtacagcattaaactatcagcctataggtacatcttttgaggaccagtctattacattaaatgctgaattatgtatttgtgttgagtatccggcatcatctgaaagttttgttgataatggcaggtttggtataaatataaacaataacaacaacaataataacaataacaataataatagcggaggagggtatccgggtcagttcccttgtataccaatttgttatccgatttggcaaaatcctcgtccgccgtatccgccggaaccaccatatccacccgatccgccgtatccgccaagaccaccgcgtccgccatatccgccatatccgccatatccgccgtgcccgccatgtccaccatgtccgccggaaccaccatgcagaccagagccgccatgcagaccagaaccaccatgcagaccggagccaccatgcagaccggaaccatcatgcaggccggaaccaccatgcagaccggagccaccatgcagaccggagccaccatgcagaccggaaccaccatgcagaccggaaccgccatgcagaccggagccaccatgcagaccggaaccaccatgcaggccggagccgccatgcagaccggaaccaccatgcagaccggagccgccatgcagaccagagccaccatgcagaccggagccgccatgcaggccggagccaccatgcagaccggaaccaccatgcagaccggagccgtcgtgcagaccggagtcgccatgcagaccggagccgtcctgtaagtcaacttctgcttgttcttctaatccaccatataagacaactgcacatattaaaaatgaaaaaacagggagtcagattactaataaaaagcatggattttgatttacaaacaaaaaagctcaatctttttaagattgagctttttaattttatatgcaaataattttataatgcatacttatgtttataaaattcataatcctctctgtattcgcctggcatttcagcatgtagacgtcttaaatattcatgcctgtccaaagctctcttatcagatcttgcttgtagtatagcaactcctatgtttgaacagtgatctgaaattctttccacattactgattatttcaagaaatattacccctgcttcaacagaacatttctttgacttaaggcgtttcatatgcttgcgttctaacttttcctgaataccgtctacaacctcttcaagaggttctattttacagaccaaggatatatcatcccaagtaaatgcctggaatgtaagttccataatattttcaacagcgttaaacagaacttttagaccttcttctgcatcgggagagaattgtattttcccgtttatcagcttttcaatactctctctaatattgtcacaataatcacctatgcgctcaatgttgtttacaagatgaaaatatgctgctgatttttcattatcagactgactgagctgtgtatcggaaacttttgtaagataagcagtcagattgatttcatattcgtcaagaagttcttcgtttgcgagaattttctcagatatagacatatctttgttcttaatcatctttcggcagagcataacattttctttagctactccgcacatgtttgacattacagtatgtacattatttattgctatggatggagtagaaagaaaacggtcgtccagtaatgcaaacggactttctgtttcctcgtgttttgtatctttgattgtcttttgtgcaagccataccaatagccttgaaaatggtaaaagcattatcgttgaagcgacattaaatatagaatggaaaatcgatatatctgttgcatttattgccgaatgccaaaaaggcaggcccaaggtgtattgtaatgcataaataacaaccatgaatactatagtgccaattatgttaaaataaaggtgaatcattgcggctcgtttggcgtttttacttgcgccaacagaagataaaagtgcggtcacgcaagtaccaatattctgccccattattattggaaaggcagaggaaaataccacggcggtactggaagctacagcttgaagcatagcaaccgatgccgcgctggattgtataatggctgttattcctgttccgataagaattcctattacaggattattttgacctgcaaatacattctgaagcgatggaatagcgttaaatactacttccatagaatttgacatgtattccataccaataaatataagaccgagaccgactaaaaattcgcctatagtttttatatttttcttttggcagaagaaaagaagccctgctcctaaaataatagcaacgggagccagcgttgtaggtttaactatggcaaggtaccaaacatctccgggcaaatcgtttaagctgagaatccacgctgttatagtggtgccgatattggctcccataataattccaacagcctggcttaaggtaagtataccagcattaacaaaaccaacaaccataacggttgttgctgatgatgattgagtaagcgccgcaacaacggcacctaaaataactgacttaaataaatttccggtaactttctccattatctgacgaagcttgtctccggcagctctctcaagaccggtactcatggtgttcatgccaaacaagaacattccaagaccgccaaatagtgagagaatttgcagcgcgatatccataaaggacacctccataatttaatttaactcaacttccaccgactataatatatcatcttatacgacaaaatacaactcgtaatattgcatatattagtgatagtatttctttaggaaatttagtaaaatttttgtgttaaagaaaataaatggaaatatcgtgacttatttgagaagaatataattaaaagaaccatgtatagaaaaatacatggtcttttttttaaaatagtattattatatttgaattatagttaaatatataaaactgacataccaactccgaccatatcattgggaacatccccaattctccagccgggttcagtagtttcgatataatagtattgaattccatctaaggacaaattaccgttgcttgaagtctgtaaacctacagccatatggtcttcactcactaggagaactgcaccataacctaggagtttcagcattttagccaaaagcaccgcactgtcttcgcagtcaccgccttggtcgaatagtgtttctatcgggtatttagggtattctataactcctttgtaggttaaatcatcttgatattccaagccttgaacaaaagctgatataaatccggctatatcataagaggaggcgaatccattgtttattgccatatctctgagagtttcagcaagagtataaacagccgtctcgtcagcctcatcctgagcatatgcagagtaattattagttcttggttttgaaacaaaatagttatagtcataatatgaaatgcttacatccagtctgaaagtttctccatagaaaggatagttccatgaatacgacaacgattgataaggtttatcctgattaagagaaaacgaaattcttaagtctgtgttgattatacgtgataccattgctgcggcttcagaacgtaaaatatctgaagctggataaaacgttccatattcatcactaccggttacaactcctgattcataaagttttaatatctcttgataatatggatttgactctctgacatcaggtatgggagatatttcattaattttttgataacagtcaggcagagctttaaataacaagtaagctaactgttctcttgatgcggggtttaagtatcttccgctgaattgatttggttctattatcccttggttaaccgcatactcaagatatggcatgaaccaagtcatatttgcctgtcggttaacggagcctacaccgtttgtatttatataaactccggtttttggggtttgcgtcatagaatcgctgtcatttatttgaaaattgccgtttccgcttataggatatgaatatttgatattgttgttatcaagtgaggcaatgcttccgccagagtttaatttgttaattgtattgccgtagtatttagcattgagtcttgaagctactgttattgcctctgccagtgtaatgtttccgtcgggtgtaaacatattatcgccggttccggtcattattccgtattcataagcaaagcctacatagtaataataccaatcgtcatcgtaaacatcagcatatgtagaagaatcataatagtttgtctgttcaaattgtggaaatatttcggcaaatgctgtagcagaaacagatgttaatatacataatacgagaatagttgaaataaattttaatttatattttatcatgacgcacctcacttatatagagtgtgattaattgtcatcgtgatttttatcgtcagacggttcgtttatttcatcgctttcagaactgttttcagtatcgggttcaaccaaagtaacaacagcttcttcaattctgtggtcagcgactttggttacgtttattttcatagacccgaaagacagctcaggcatttctccatctgcggggactgttccaagctcatctaatattaatccggcaaaggtgttatattcttcgtcaggaatatctataccaagttcttcttcaacgtcttcaatttctgcgcagccctgaataagccagctgtcgtcttcgccgggaagtttaacaatttcttgttcctcctcaggctgatcgtattcgctgtacagttcaccgactatttcctcaatcaagtcttcttgtgtaactatgcctctaaaaccgccgtattcatcaagaacaatagcgaagtgagcatttttatcctgcatttgagaaaacatttcgtcagcttttatagactcaggaacaaaatatggctctcttaaaatatctctaagatttccattcctgtctttaagtaagaatttgtaaaaatcacggctgttcagaactccaatgatatcatctatagcattgccgcatactggatatcttgtatggtttgtttcatttataatttcttcccacttatcaggaccgtcatttatccacaagataactgcgtcggttctgtgagtcattatgtcttcaacaggtttgtcgtccatttcaaaaatattatgtatcatttctttttcatcgtcatcaatggcgccgctttctgacccgatatcaaccatcattctgatttcttcctcggtgacgtcatcatcgttttcgtctggccgaataccaaagattttcaaaataatttttgatataattcgaggaatccatacaaatggtatactcaaatatgttacaaagattgaaatgggagttaaggctacagaaatactttcagagtattttccggccagaccttttggaacaaaaattccaaatattaaatatactaaagttgtaatgaaagaaataattacaaaactcaatatacaagcagcaatgatatttatattaagctcggtaaagtacgaaaccagcggaatcaaatacatatatattgcacatccgcctattgagagcagtagtaagctgtttataaattgaatagacgctacaaaatcccctgagtttccatcgagaaattttgaaagccgtatggcttttttgtttccgctgtctgctagttttttaagttttgcatcatttactacaattgttgactgttcgattaaagtaaaaaacatacttaaaccaaacaaaatcaaaagaatcacccataacgattgcgtagggggcaacgtgtccaaaaataatcatccttccaggcgaacataacccataataatttttattgtccaccagtataacagaaaatatgataaaagtcaaattctatattgtaaacgtttagttaacttttaaggtatatacgttatatttataaaaacgttaataatcatattttctaatccgatgtatctaaaacaatatttttgaaacttgaagttttaattagggctaagatagaaatattttataaataataggttagctaaataatataataaaatatttttataaacttaaaaacgttttattacaatatggctgaaactaatccacagtatctaataacattatagcatatgtctttagaatggaacaatattaactactactttattaacgaggtgtaatatatgtattataaaaagtaaaaataagtttttaaaatattgtaataagttttaatgaaacaagtgtattgcaagcatcggtaggtgtgaccacacttgtaagaatagtgtgtgttatatacattaacttgttttgccattacttgcgatgtcattaatatgtatactcaatgcggacaaagtccgccgcgttaggcgcgcagccgcgaaaaataataacattattgtatttaattattttaatctaagcaagcaaattatatatatatgtaattaattatgtcaattcttaattattttatgttataaaatattgaaagctgtgattcacacagaaccacagcttttaatactacaataaacattcattctttttttatatcaacaccaagatttttaagcttttcaacaaagttttcataaccacgttcaatgtgttcaatatcatgaatcttacttgttccatcggcttttagcgccgcagcaactaacgcggcgccggctcttaaatcggttgctttgacttccgctccgctgagacgttttacgccttcaataaaagcggcgttgccctctgttttaattttggctcccatacggcaaagttcaggaatatgggcaaatctgttttcaaaaatggtttcaacgaccattccgttgccatcacttgtagacagcagtgacatggtctgagcctgtaaatctgtaggaaatccgggatatgggagagttttgatatctacagatttgggcttttggcagggttttaagtctataaaatcaagaccggtttcaaacatgaatcccatttctgttaatttagccaatagtggttttaaatgcagaggttcaatattctctgttttaattccactgcctaatccggcggcacagatgataaaagttccggcctctattctatcgggaataatcttatgattatttttgtgcattcttgtcgtgccttttattattattgtgtcacttccggctcctgtgactgagccgcccattccgcataggaaatcagctaaatcaattatttcaggttcgttggcagcgttttctatagtggttgtaccattggctaggcacgctgctatcataaggttttcggttgctccgacactgggaaaatccagatatattctagttccaaccagaccattttttgcggacgcttcaacaaatccatgaccctgcttgatttttgcacccattgcggcaaaaccttttaagtgaaggtctataggacgggctcctattttacagcctccaggaagtggtatacgaacatttccgaatcttgctaagcatggtgacataacaaggactgacgctctgagctttgaaaatagtgaataatcacgcaatcttttaggttttgtgatatttgccgagattctcattgaaccgtgcttgtctctataaatatcacagcccagaccttttataatttctgccattacatcagtatcagaaagatgagggacgttatctaaaactgattcttcttcggaaagaagtgccgctgccataatcggaagagcagaatttttagagccgctaatttttacatttcctccgaaattttcacagggaccgtttataatatactttgccatataaaatcattccttaacgtattatatttgaagttgagataataccggtgctttgtgggctttcacctgatatggccagtataggaacataggtttttgcagttaaaacaaaagcgcaggtcaaaattaatgatgttataagcctttttttcataaaatttcctccaaaaccgcataataaaattttaagaattatgccacaatagtattttgacctgtaacaacttttttataacttgtattttttaaataaaaagataatatttaagataataataaaaatattgttttaaaaataaaaatttatactaaaggtgaagaagcgtgttgttttatgcaaataaataatgacaacaatttgataaaaaacaataatttaaaataaaatataaagaatataagtcttagtaatacaagatattttcatataattaaaatataaaaatgatatataattttttaaattttaaaattattttgttcaatttaattatcataacataatgcaggtatatttgcgaacttcggcaggcttgcggagcaagcacgtaaggttcgccgccatctgaccgtatatagcggtcaagataaaataagctgtttatattattctaggttatgtaattgttaaataattatattatactcaaaccttttaattatcataacataatacatgtatgcttgcggagcaagcacgtaaggttcgtcaatatctgaccgcaataagcggtcaagataaaataagctgtttatattattctagatatgtaattgttaaataatcattatatactcaaaccttttaattatcatagtataatgcaaatgtatttgcgaacttcggcaggcttgcggagcaagcacgtaaggttcgccgtcatctgaccgcttatagcggtcaagataaaataagctgtttataatattctaagttatataattgttatattttacttcaaaaataaattagtaaataaagtttgcaaatattataagtaaactagtatataacatatcaatttattaaaatattctttataaaaacaataattaattttgttaatataatcttgaccgctataagcggtcagatgacggcgaaccttacgtgcttgctctgcaagcctgccgaagttcgcaaatacatttgcattatactatgataattaaaaggtttgagtataaaatgattatttaacaattatatatttagaataaaataaacagctaattttatcttgaccgcttattgcggtcagatgacggcgaaccttacgtgcttgctccgcaagcctgccgaagttcgcaaatacacttgcattatattatgataataaaaaggttagtaagtaatataattatttaacaaattgaattgcagttaacaatttacattaatggactatgggttaaaaggtacaaaaacataagtatgtatacaacaaattgagatgttgtaaataatttatattgatttattatagattaagagacatgaaatctaaggtaagaaaacaataattttataataattttcaatcttgtttgatttatgatactttaataatttacataaatagttagtaaaaatatgtaaaaataaaagaatgcctttattggcattcttttaatataaacttttacgctggatgagtcatatcatcataattgactaagtctttgtcaattttatatttttcagcttttctctgttcaaagaatttgactgcaacttggtcaaacagtgcatatgaaagtacatcttccggctgttctgtccattctgcacattctttcttgagcttctcaagctcaggctttattaggtcggcaggacggcaggtaattgccttttcatttcctattatcttctttctgaattcatcatcaatcggaacaggagttctgccgtattcacctttacaaattccctttgtctctttggttaccatcttatagcgttctcccatgagcacgtttaataccgcctgggtgcctactatttggcttgtgggggtaacaagaggaggatagcctaaatctttacgtacttcaggaacctcttttaatacctcgtcaagtttgtcttcttttccttgctgcttcagctgagaaactaggtttgacagcattccgcctggaacctggtattttaatgtgttaatatcaacgcctaaaacctttgtgctcataagaccggaagccaaatacttttctcttaaaggtttaaagtattcagcaatttcagtgagcaggttaaggtcgattcctgtatcgtattctgttccttgaagtgttgcaaccaatggttctgtaggcggctgagatgttcccagagccataggcgacaatgccgtgtctacaatatcaacaccggcttcgatagctttaagatatgtcattgaagcaacaccgctggtatagtgtgtatgaagctgtatcggaattttgacagcttttttcagtttctttacaagttcaaaagcattgtatggagtcaaaagaccggccatatcttttatgcagatagaatcggcgccgcagctctcatattcttttgccaactttacaaagaaatcattattgtgtactgggcttatagtatatgatatagccgcctgaacgtgacctttttcttttttagtagcattaatagctgtttgaagatttctaacatcgtttaaggcgtcaaaaattctgattatatcaatcccgttagctatagatttctgtacaaaatattcaactacgtcgtcagcataatgtctgtaaccaagaacgttttgacctctgaacaacatttgaagttttgtctttggagcggcttttctgatttttctgagcctctcccaggggtcttcattaaggaaacggagacaagcgtcaaatgtggcgcctccccaaacttccagagaatgataaccgactttatccattagaggcaatgctggcagcatctcttcagttgtcatacgagttgctataagagactgatgcgcatcacgacatatggtttctgtaattcctactttagccataatattttcctcctataattattttaagattaatgagcgaacatagcgaggaatacgcctgccgcaacggcagaaccgataactccggcaacattcggacccatagcgtgcatgagcaggaagtttgaggggttttcctcctgtccgactacctgtgatacacgggctgccatcggaactgctgatactccggctgaaccgataagcggatttacttttccgtgggtcagtttgcacataagtttgcctagcagcaaaccgccggcagtactgaaacagaatgcaataagaccaagcgcaactatacctagtgtagcaggtgtaaggaatgtttctgcctttgcggttgcgcctactgtgagacccaggaatattgttataacattcattaaaccattttgagcggtctttgctaatctatcagcaactccgctttcttttatcaaattgccaagcattagcatacctacaagcgctacagcgtcaggcacgattaaggccacgactattgtaacaatgatagggaacaagattctttctctcttgctgaccggacgaagctgttccataacgatagaacgctcttttttagtagtaagtcccttcattataggcggctgaataaccgggataagagccatataagaataagcggctatggctattgccggcagcaattcaggcgccagtgttttagtaacgtatatagcggttggaccatcggctccgccgataattccaattgaagctgcttgttcaactccgaatccgattgccggaatagctgcgcccaatgcgagagcaccaagaaaagttataaatacgccgaactgtgctgccgcacccaaaagaatgctcttagggttagcaataagcggtccgaagtcagtcattatacctattccaaggaagataagaggaggatagattcccaatttaactcccaaatagagcaagtccaatagaccgccttcagcaaaaatcctttgtatatccaaatgaccgtctatcaaatacgccgggtctgtaaaaaattcattgtgcattaatatagcgcctgaattttggaacataggcatatttgttagcagaacaccaaatgctataggcaatagcagcagaggctcaaattttttcactatagccagatacagcagaacgcatgcgataactatcataagcggagttcctataacttcaagaatatttccgcctgatgagatagtctcagatattgagtttatcagcgctgctataccggtgcttcctaaaaagcttgaaaaagcctgtaacaaaaaatcaccctttcatcaatatattttggttatgtttcggttggataataaattaaccaatagaaacaagggcatctcctgtattaacggaagcgccttggctggtgcagacagcaactattttaccagattttggcgccataatttcattttccattttcatagcctcgagtacgcaaagcacatcgccctcatttactgtgtcaccgtttttaacttttacagatacaatgcttcccggcatcggtgcttcaacagttgttgcgcccgaaacaggggctgaggctgctgaagcctgcggagctgcttttggagctgctgccggctttggagcaggagcggcagacttttgaaccggagcaggagcgccgccgatttcttcaacctctacctcatatgaattcccattaacacttatattaaactttctcattatactttacctcctggtattgagtttaaaatcttgaattgattacgtcggtcaggccggccttgctccagcttggcagagcgttgccaactcttctgtatgattttatatttagattataacttgatgtgttaagacttgcagctatagcggcagtcaaaacagctatcaattcgccctcgtccatctcaggggctgattttgcagtcgcgttggcagcctgaggcagtgtcttgttactgtttgagggtgtattttgttctttttttgaattatcattgtaaaatagtgttttcatacccattaaaacaaacataagaatgactagaactgcaaacacgatagcaagtccaacaattgtgacctgcagaccttcagatagtgctgcgcctattgtcatagctttattctcctttcatatttatgtttaacatctattacagaggaatattaccatgctttttggcaggtcttgtatctctcttgcttgcgagcatttcaagagcgcttataattctcggacgggttgagtccggctctataacatcgtccacataaccgcggcttgcagctacataagggttagcaaatttttcggtatactcttgaattttttcctgtcttgcgagaacagggtcttctgcatttttaatatctcttttaaatataatattagctgcgcctgacggacccattacagcaatttcagctgttggccatgcaaataccatgtcagcgcccaaatgcttgctgttcatagcaatatatgctccgccataagcttttctgactattacattgatttttggaacggtagcttcagagaaggcaaataatagttttgcaccatgtcttataacaccgttgtgttcctgattaactcccggtaaatatcccggtacgtctgtgaaagtaacaagaggaatgttaaaacagtcacagaaacggacaaatcttgcacccttatcagatgaatcacagtccagcgaaccggccataaatttaggctgatttgctataataccaatggtagaaccattcattctagcaaatcctgtaactatgttttttgcaaacttatcaaacatttcaaagaattcaccgtcatctacgatttcttttattacatctctcatatcataacccttgttgacgtcaaccggaacgatttctgaaagtttgtcagaaagtctgtttaaatcgtcttcacagtcataaatcggagctgtttcaagattgtttgaaggaagaaatgaaagaagaagtttaacctgttcgaaacagtcttcctcagttgcgaatgccttgctggcaacaccgctttttacggcgtgcgtttgagctccgcctaattcttcaaacgaaacgtcttcgcctgtaaccgatttaacaactgaaggaccggttataaacatctgtgaagtcttatcaaccataaaaataaaatcacagatagccggcgaataaacagcgcctccggcgcatggacccaaaactattgaaatctgaggaactacgcctgacgcctgtgtgtttctgaagaagatatctccaaaaccttttaaagcgtcaataccttcctgaattcttgcgccgccggaatcgttaattccgatgataggagcacccatttttgttgccatgtccataactttgcaaatttttgccgcctgcatttcacccagagaaccaccgataaccgtaaagtcctgagcgtatgcgtagaccaatctgccgtccacggttccgtatccggtaacaacgccttcaccgggggcttctgtctttggcatattgaattcgttgcatctgtgtttaacaaaagcgtcaatttcaacaaagcttccttcatcaaaaagcattgcaagtctttcgcgggcagtttttttgccgctttcatgctgctttttaattttgtcagcgcctccgccttgttctatagtacggcgaatctgctgcagctcttctattttttccaattgtattacctccttgtgtttaaattgtttagtgatttaaatcacatatgttaaaattaattatttttctgttataaaaactttaatgatgtctgtttccagactttttagtgctgttatttttgcttctttggataccatttccgctatagtgaggtttctttttggcactggttctgatttttggttttgagtttctcttgtgtttttcagctgcgtctttaccgtagatactctcactgttttctttggatgattttttccctgttccgatttttttcagcatatttacttcagattcggaaagctttctccatcttcccaaaggtaaatgacccaaattaaggcctgcctctttggtgcgtttcagacgttttactatacagccaaccgattcgaacatctttctcacctggcggtttcttccctcatgtatagttatttcaagtttagttccgagctgggtggctcctataacttcaacttttgcagggcttgttcgtatcccgtcaatcactactccgtttctcagtcttgttaaggtttccatattaatattaccggtgacttcggcaacataagtttttggaatattgtttttaggatgagttatattgtaagtaagctcaccgtcgtttgtgagtaggagaagaccttctgtatcataatccagcctgccgacaggataaagcctgattggtatatcagtgaccaaatccataactgtgtccctgcctttgtcatcacttacggtagtgacaaatccggccggtttattaagcataatataaaccagctttttttcaattctaacaggtatatcgtcaaccattaccaaatcgttgtcttcatcaatcttaacgcccatttcggtaacagtttctccattcacacggactcttccggaacgaatgatttcttcactgcctctgcgggatgcaacgccgcagtcagcgagatatttttgaagtctgaccactgaatcaaaccctttcttttgtttttaactgcggctagattattagactaaaataaccgcatgttatcataaacgctttgcttactattatagcctatttaaaaattaaattcaataaaaaccgtaatataaatttgactgatattactgttttaaactaggtatatattagtatttttgtataatttttaacaatcgtatatggcaagcttgaatgctggctttaaaaaaacgcatagtataaaaattataattgatttccatgcagaaatagtcttgatttttatttacagctataaatagaattcagacaataatagttacataatgttgtctgtttcaatatcttaaactttttatagaactaacttatttttatttatttcgttaacagattttattattttgataaacaatcagtgatttataaagagtgtctgctttggaaaaaatattttttatagagtgctattttatataactaaatttatacaaaaaaggaggcagacaattattgtctgcctcaaaaatatattttatttttctgataaaggaatattaagctttgaaaaggtgcgcctaacaaagactatacatagaataacagaagctatttcagctatcggtatcgaccaccatacaaggtctagatttccaaactttgatagtataaacgcgaccggcaaaagaataattagctgtcgtgaaatagatgttacgagcgaatatattccctggccgagagcctgaaggattgataaagttactatacaaaatccagctgctataaaactgatacttattattctgagagccggaacacctattgcaatcatatctgacgaggcgttgaacattccaagcagctgtgtggggaagaactgaaaaatcagcaaaccaaaaatcatgattgatacagcgtatgttatgctgagtttcatcgtctttataattcttgaatgtttttgagctccataattatatgcgattattggaaccattccgttgttaagaccaaatatcggcatgaaaatgaaactgttgagtttaaaatatacgccgaaaactgctgttgctgttgcggtaaatccaataagtattttattcataccaaaggtcattattgatgatatggctatcataagtatggatggcagaccgactttataaatgtttgccacaatgttcttttgaggaagtatttttttcaggtcaaactttaattctttgtttacttttgcattacaaatcactgccagcagcatagctacgatttgaccaagcaccgttgcaagagccgcgccgcttacacccattttcgggaatcctaaaagaccaaagatgaatatagggtcaaatattatgttaattattgcgccaataccttgagtaaacatagtataaattgttttacctgtggactgcagcagtctttcacccattatctgcccgaatataccaaatgagaaaatacagacaattgagagatattcatatccgtattgtataatttgggcattgtctgtctggattctgaaaaaccaatgtgatagcgttgaaccaaatagtagcagtaccagccagttcataattgcaagaaagatacttatattagcagctttattcgcgaatttgtaatctttagcgcccagacattttgaaacgaaagagtttaccccgactccggtaccgctggctattgctatcataaggttctggacagggtatgcaagggatactgctgtgagggcattctcgttgatttgggcaacaaagatgctgtcaacaatattgtaaagagcttgaaccaacatggaaataattatgggaagcgacatacttataagcagtttgttaacgggcattgtacccattttattctcctttacggagtcaagtgtgtcaacttcagtgttgataatttttgttttgttttttgacattactttacctctattcttaaagtgtaagaactattctaacatattatagaagaaaatgtcaaataatttatgttgaataaattttatctcttattgtttgctattatatgatgaatggaaagaaatgctgaaaaataaagatgtgtttctgccggtataattattttattgttaacaacagtacctatagttcttcaagtccggttattttcatttttccgccgctgaaacttacagtatatttgtacttttcacttatatctttgactgagccgtctttatataccactctgatagttgaacttcgtataacggttgccgcagtgtcagatattttttctccgccgtagcaattcaatgaaagtatttcttcgctttctacggattgacggatttgtttatggcttttgagttcctggtcagcagcagaacttgagaaatatacatcaatatatgaagtatcccctgtattgatgccgttaacaaatgaaacaagagcgccttcaataaagttttcagcagcattggtatcaacggaagcggccggttcctgattgtatgagtaggtattataataattgtttacaggcggcgcttccggctgctgaacaactattacctgaggcggagctgtcggcggtgcgggtggagcaggcgtagccgtagccgctgctgtttcagttggtttagcgttaaaagaattaaatgatattatcccggttgaaaataaaaggataaaaataagggcaaaaactaaaataactgataataacgaaactgttacgattaaaccagtgtttgacttgccatgtcccggaccctgttcattataatttggattatacaagcaaaacccctcccaaagtacgtacttatatattcacattatataccaattgtagaattttgtaaatatttattatcattaaaaacaaattaatactataattaaaatatatgaaataaaaaatattacttattttataatagaaaaattgtgtctcacactgaaaaaagtctttttatatagttagtttagggctgttcagttatatgtgcatatagtatttaaattgtctttggaaacaagttatagagtttatttatttcagaaatattaaaacaatttttacttcagttatttggataacagaaacgccctaaaataatatagggcgtaattaaagctttatttatattttttcaacttcttctttaataaacataatacaaaagctgataatcagaagaagacatgaaaaccaaattgcatgaattccatatattttagtaagcataccgccaagaccggcgcctgcggcaaaagtcagtaacacgcaaaaatagtagagcgattttctaagaacacttttttcttttgtataaaaaaaggtgtaaagtgattccatagcacttcttatgtttccgatacacattgtgcttgcataagggtgaccttcaatttttcggaacgtataaacctgcatagcacagacgaatgatactaatgaatttgccaaaatatcaagtgagttcggaataaatcctacggttaaaagtaagcttatttctgcagctataattaactgtctccaatgaatttttttcatatatttaaaatggcggtgtattacttgtgctagatatattccggtaataaacgccaatatcggaattaagtagcgcactgcattatataattttccctgaaatatgtatgaactcatcagcacaatatttccggtttgtgcattggcaaatacttcttcacggcaacagtaagtatatgcgtcctgaaaacctcctgagagtgttagaaagacagcgtttataatggcttcagacatttgcctggattttaatgacgaaattattgtgttaagctgcttcatttaataacttttcaagtgtaactatttttactgacagggcaaatatttttgttgccagttttatatctttcatgtttgcaaatgtaggagctatacggatattttggtcttcagggtcgtttccgtaaggatatgtagctcctgccggagtaaatgccacgcccattttgctgcaaagtgtaactgtgtcggatgcgcatccctttaaggtgttgaacgagatgaaatatccgccgtttggttttgtccattcagctataccgagcccgttaagttcatcatttaaaattttgtctactgcttcaaatttggggcgcagtatatcagcgtgttttgccatatgagcttttattccggttatgtttttgaagtagcggacatgtcttaactggtttatcttatcaggaccgatggttgcatactttaaaaatccttttatatcaatgaggttggcaggactggatgcaacagctgatattcctgaacccggaaatgttattttgcttgtggagcagaattcgtaaaccatatcaggatttccggctttttcgcattcactgataatgtcaggaatatcggtttcttcattttgatatattgagtgcacgcagtaagcgttatcccaaaagattctaaagtcctttgctagaggttttaggttcgcaaacctttgtatggtttcgtcactgaaaactatacccatagggttctcgtattttggcacgcaccatattccttttattgtgtcgtctgatgacacaagtttttcgacaacatccatatcaggaccgttttcattcataggaacagggataagtttcattccaaaatgctctgtaatagcaaaatgacggtcatatccgggagcggggcacaaaaatttcctgtcctcaacctgacaccatggtttctctccaagaagcccatctgtcatggcgtggcttataatatcatacataagtgtaagactgctgtttccgcctactataacgttttcagggcgtgttcccatcatatcagccataagctgtttcgcctccgggattccgtccagccctccgtaattacggcagtccatgccgctttcagcgtccagaatacttttagagtttaccgtgttcagcatttccattgataaatttagctgttccttatccggctttcctctggataaatctaaattcagttctaatgctttgatttcttccatttctgatttcagttttgataactctttttttaagtcttcagtgcttaaatctaaatatgacacttgaaattccaccttttttataatttattgtattattttcttgacttatgacatttaataaatataatataaaagtataaatatgtaaaatgtattattgatattattattatatcaattttgtataattgagtgcatgtatggaggaaataaaatgaatattaactatgattattaccgtatattctattatgtggcgaaatatggaaactttactcaggcggcaaatatacttttgaataaccagcctaatataacccgctctataaaaaagcttgagaacgaattgggctgcactttatttgtcaggtctaatcgtggagccacgcttacgcctgagggagagaaattatttgctcatgtatctgtggcggttgaacaattgcgtgcaggagaggaggagttgtcgcgcgataagagccttcagagcggtactgttactgtaggggttagtgaaacggcgcttcatggcttgctgctttctgtgctgaataagttccgctcaaagtatccgggaatcaggatacgtttgtcaaaccattcaactcctcaggctatgtcagctctgcgaaacggaagagtggacttggcggttgtaacaactccaacggatgtttcaaaccctcttcatgagtataggcttacaacgttcagagaaatattagtgtgcggaaaggatttttcccatttgcagaacaaagttcttcaattaaaagacttaacaaaatttcctttaatttgtctcggtaaggaaacaaaaacaaatgaatttttcagcagattttttatgagccacggtttagtctttctgccggatatggaagcggcgactacggaccagattctgcctatggtgaggaataatttagggcttggttttctgccggatatttttgcggaacctgctattgaaatgggagcaatatatggacttaagcttcaggaaaagataccaaagagagatatatgtttgcttaaaaacacagaacgtccgttaagcattgcggcaaaagagcttgaaaagatgctgctgcaggaaaagacattattggaatagtcatataggttataaaataagcaacggtaaaaataagattataaatatacaaagtttttccatataaatatcttgcttttaatataatatcaacgtctaaaatatttatgtcttgataattgcaactattggtaaaataaaattaattgtatgatttgatatagcagtataaaaagtgtttatataagtatattcattaacgtttttaaatgtaaaataactatcaaattaatttggtataaatatttgctaaagatttgtttaatacatgcagcagagagtgttaaaaagattacgtgaataaaaacagtattaataagagctgtaaacactaaatttatttgcggtgtgtttaattcaatattggtttggctctaacaatatttattgagattttatatttttattattagaattatttagattatgagtttatgaaagtctaagattgcatttaaatttattttacttacgctaagaatttataagatataagttgtatataaaaatttttattaaatcaaaataacgccgcggtagttcaaattaccgcggcgttattttataattatattatgcttttccgtttgaaccaaacagacgtattttttcaattactttagcttttacattttctctggcaggtccaatatattttctcaaatcaaataaatccggtttttctgcaaatatctctctgattttatcagtgtatgcacatcttaactctgtgtcgatattaattttattaactccaagagatatagctttctttatactgtcgttatctactcctgacgctccgtgaagtacgataggcatatttaggtctttttttattgtgtcaagcctgtcgaaatcaagttttggtatacccttatattttccgtgagctgttccgatagcaatggccaaatagtcaacgtttgtctcgtcaacaaactttcttgcttctgccgggtcggtgtacatagcatccttctcatcaacagagatattatcttctataccgccgagacgtccaagctcagcttcaacagaaacgccaacatcatgtgcggcttcaacaactttttgagtgagagcaatattttcatcaagtgaaagatgagaaccgtctatcataaccgatgaccagccattttttaaacagttcataacagttttaaagctgtcgccgtggtcaagatgaaatgctacaggaacactggctttgtttgctgctgttgttattaccgctgaaagatactcatatccggcatatgaaatagcgccgcatgttgtttggataaataccggggatttttcttcttcagcggcttctataatagcctgggcaacttccatattaacagtgttaaaggcaccgactgcgtaaccgttcttgtgggcgtcatccaaaatttgcttacctgtaactaacataaaatttcctccaaatataataaattttttatttttctatatcattttcacgataataataatacatatattgttgggcaaaaccggcgtaattgccgtatttttctgttacaaagctgtcagtttccttttcctcaactccatatacctgatttaaaatacgttttatccagacgtctttgggaaacagttcatatcttcccattgaaaacaaaagtatacagtcggcaacctttccgccgacaccctttattttcagcagttctttttttgcaagttcagtcggcatttcgggaatatcttttaagttaacttcgcctgacgagactttttctgcggcgtccatgatatatttatcacggtaaccggctctgagacaagctaaatcttctatgctcagactgtttaaacgttcaggttcagggaaagaataatactctccctcaggaataccaagtttactgttgtatttaaaatcaatcttgtctccgaattcacggcacatagtctcaagtattttttttatcctggggatattattatttgccgaaattataaatgatattatagtttcccaaatatcttgatgaagaattctgattccgccgccgaaatcaatacatttttttagagtttcatcgtggctttcaagatatttttttatttcagaataatctgtatcagcggaaaaataatttgtccaatattcattatcagaatcagggcagtatattgtgtcgtttgacactctgcaaacctttccgccgcaaatgccgatatagccgttgtctgactggttccagcggaagcattgtccgcattcaaacgtatgtataggatcaaagtcctgttttaagtaaatcatttcttaatctctctatctgtttaatatatattcttgatacatggagggttttaacatatatgttcacatattttactgttatagaagtgtgatattcaatagattctttaacggtgtctgcaatttttctcgcttcttcaacaacattgcatggatatcttaaagacagctcaatgtcgagtatgagacggtttcctttagtagtgctgctttttaatttaagcaatttatacatgctgggaaaccgggaagtttcatatgaacaaatatcaaaaatcgctttatgagaaattttgtaatctcccaaatagctgtaagtggggcgcataacggttttttcttcaactatagtatggtttttgcgattaaaaaattgaaccatagggtctataaaatatccggaaaactgtttttttacttcaaatgtaggaacaggaatcacatgctttccgtgtttagttctcatttcgttagcaattttcatctcttcaggagttgatacatcttcaatataaataaacttttctattggagaaactccgatagcgtcagctattttattcgccattctctcacttgtaccaataattaaaagcgattgtatattatagtccgtgatggcctttttcacttcatcctggtgaatcttatcactaaaaattgctcttcgcacagacgcaactttagttggttcgcgttttgcacttttgccggctataatttgattatccgagaccagcaagccgtcgtctatgatataatcaatattattttcccgggcgacccacatactgtgatgtgattttccggttccggattttcccacaagtgcatagaccttcatagtattactccttgtcaagtttctctttattttcacattctgaaatcttatatgaaagcctcataagactgtcgcttaaatgaacgttttcaactattattccttctgtttcagcaagttcggtatatgaaaaattcataaatgcctttattcccatgcttattaagtcctcagcaacagctttcatagcttcctttggaactgtcagtatagccattttgggatgattttcgtctataaattctttaatgtccgcataatccataaccgtaaagtcgctgacttcagtgcctataacttcaggacttgaatcaaatattcctataagtttaaagccgcggctttcaaatttagtgtttgtggcaaaagttcttcccatatgcccggctccgaccaaaacagcggtataaccacgattgagaccaagtatattggcaatctcagtcctgagcatctcaacgttatagccgtagccctgctgaccaaacccaccgaaacagttgagatcctgcctgatttgagaggctgtaactcccattctctcgctaagttctttagaagatattctttcggttccgctgctgcaaaggtctgttaaatgtctgtaatatctaggaagtctgttgatgacagaacccgatacttttttatccattgtttattctccttaagtgcactgccgcaaatgcggcagtgcaaaagtagttcggtttgtgaagctggtcagaaaagccgtagtattatgataattttgacattacataatctgcaaactctgcagaagttgctccggtatctcttccggttatctgaagcttcttttcagtgtacatacactcatcaagagcgttttcaagcgccttagctttatcggcataaccaatatgctcaagcagcataacagcagctcttatgatactgcatgggtctgcatatatgtctcttccttcctgaaccattcttggagcgctgccgtgaatagcttcaaacatagcatagcgttttccaatattagcacttccggcagttccaactccgccctggaactctgcggcttcatcagtaagaatatcgccgtaaaggtttggcagaaccaaaacctggaactgggttcttctcttagggtcaacaagttttgctgtcatgatatcaatataccagtcgtccagttcgattccgggataatccttagccacttctttgcatacgctgaggaagtttccgtctgtagtctttattacgtttgcttttgtaacacaagtaacgcgtgttttgccagcttttttagcatattcaaaagcggcgcgtgctattctttctgttccttcatgagtttgaacaacaaaatctatagctaaatcgtctgtaacgtttactcccttagaaccaacagcataaccgccttcagtattttctctgtagaacgtccagtctattccctcttcgggaactttcacgggtctcacatttgcgaataagtcaagagccttgcgcattgcaacgtttgcactttcgatattcggccatgggtcaccctgtcttggtgttgttgtggggccctttaaaataacatggcactgctttaattcctccaaaacatcatccggaagcgcttggttaacttcggcgcggtgttctatagtacagccggtaatttctttaaactctacttttccggcttctgtttcgtcttttagcaagaactttaatattctttcagcctgctctgtaatagccggtccgataccgtcgcctccgacaacaccgattactatcttatcaagtgtgctgaaatcaagaaaatctttttcagctttcatcttttcaacacggttcagctgctcgctgagcacctgaccgaatttttcttttgcttctgtgatttgtgctgtgtagtccatttatatctcctcctgtatattgtctgtcttgcctgctttataagttttggttaagcattctctttggtgtaatttaaaagtccgccggcgagaagcatagctctctgacgctctgaaaggtcaagtttcgcctcaaactcaaagcctttagttttgtctgtaatttttattatatcactgtttttaacttgttctcttacgtttgcgatatacaagtcgtccatttggtcaactttgtcatagtcagcttcgtttgcgaaagtcataggcaggattcctgcattaattaagtttgccatatgaattcttgcaaaggattttgtcaatacggctttaacgccaaggtaaagcggagcaagagcagcgtgttctcttgaagagccctgtccatagttgcttccgccgattattatgctgcgtttgagctctaaagcgcgttttggaaattcctcatcgcacactgcaaaacaatattcggaaatttttggaatattagaacgcagaggaagaatctttgctccggcaggcataatatggtctgttgtgatattatcaccaacttttagactgcattttgcgtctatttcgtccaaaagcggttctgataccgggaacggtttgatgttaggtccgcgaagaacttcaactgtgtccattttttcttcctcaatcggaggaactaccatattgtcatttatagtaaacacttcaggcagtttgaactcaggcatatcgcccaaacttcttgggtccgtcataacgccggcaattgctgaaactgcggcaacctcaggagataccaagtaaacctgaccgtcctttgttccgcttcttccctcaaagtttctgttaaatgttctgagagaaataccgcctgaattaggtgactgtcccataccgatacaaggtccgcaggcgctttccagtattctagctccggcatcaatcatctttgaaagagctccgttttctgctatcatattaagaacttgttttgaacctggtgcgatggagagagaaactcccgggtcaacagtttttccatctaaaatatatgcaactttgagcatatcaagaagtgatgaatttgtacatgaaccaatacatacctggtcaattttcattccggcaagctcggaaatctttttaacattgtcaggtgagtgcggacaggcagccataggctcaagttcgctcaaattgatctctataatttcatcatattcagcgtcagcgtcagcgctgagaggtttataatcggcttccctgtcctgagcttttaaaaattcacgtgtaatttcgtcagacgggaatatagaggtagtagctccgagttcagctcccatattagtaatagtagctctttccggaactgaaagcgatttaacgccttcaccgcagtattcaataaccttgccgacgccgccctttacagacaaaattctaagaacttcaagtataacgtcttttgcggcaacccatgggttaagctttcctgtaagctcaactttaactattttagggtatgtaatataatatgtgcctccgcccatggcaacggcaacatccataccgccggcacccatagctatcataccgagacctccgccggtaggcgtatggctgtcagaaccaattaaagtttttccggggattccgaaacgttcaagatgtacctggtgacagataccgtttccgggacgagaaaaataaataccgtgctttttacaaacactgccgataaaacggtggtcgtcagcattttcaaaaccgctttgcagcgtgttgtggtcaatatatgcgactgatttttcagtcttaactctgggaactcccatagcttcaaattcaagatacgccatagttccggtagcgtcctgggtcaaagtctggtcgatacgaatacctatttcctgcccttttacaggttcgccctcaaccatgtggtctctcaatattttttctgtaagtgtcaaacccactaaaaatcaactccttttcaatatacaaatactttttaattgttatgtattcattttatattaacatgcccgaaatgtcaagcgttatgttaagtttttcacaataattacagtgtttccaaacagtgggattattgtgaaattgggctgtataaatgagaatatattgaaatgaaaatcatataatctccatttgtttttaattacaaacgttagtttgatgtgcctagcccggttgcgcccgccggacccgggcgccgacacatatttttttattttattatatattaaatatggagtaactttgttaataatctattaaatataaaaatatataaaaaataaataagaataataacaatagaatgtctatatggtttgaaaagctaagaataaaagcaaaaattatttagcaaaaaagtttatttagcaacaaatattagcaacaaataatggtttggaaaaagaattagactgtaggtaaagtatgaagtgtttggcaagatgcacaagacaagctttagccccgcttgctcgaggatttaagaggcagctttgcggtttcaagaagaataaatagcgtttatgagcgttgccatttctcagctcagattcaacaatagttccttcatcggaggaatcttactttgtttattcaatgtttctcgtaaaattacctttttatatgctaaaataaattaaaaatttatgtttattatatattttaaattactttaatctatgtttataaaagtaaaatgaaaactataagtatatgaaatgattttatctataaaatatttcaaaaatccgatttaaaatcacattcatatttaatattcttgaaaagaataaagtatgtcagcgcccgggtccgacaggcgcaactgggctaggcacaccaaactaacgtttgtaaataaaagtaaataaaatctatttattaatttcagaattattagtccgccctacgagataatcaatagaaacatcaaaataatcagcaatagcggttatagtttttagactgggttgtgcagttccgtattctaaccgttgtacagaattaggctgaatatttatttgtttggcaagctgcttttgagtaataccgtttgaaactcgcaaatttcttaatttattattaaaactattcattaaaatatcaccattcttaatatgaattatataaatgtgtcagcgcccgggtccggcgggcgcaattgggctaggcatatcaaactaacgtttttaaataaaagtaaataaaatctatttattaattttaggattgtcagtccgccccacgagataatcaatagaaacatcaaaataatcagcaattgctattaacatatcatacgctggtttacgggatccttgttcataattttgaacgcctcgttcactggctcctataaattcagcaagttgtttttgtgtgacattatttaatttacgtaactcttttaatcttgtacttaagttattcattaaaatatcaccatttttaatatgtattaaataaatgtgtccgcgcccgggtctgacgggcgcaaccgggctaggcacatctaactaacgtttgtaaataaattatagtttatttattaatttctggattcttagtccgtcccacgagataatcaagagatacattataaaaatcagctagggaaatgagtatatcaaaagacggacgttgatcatctgcttcataacgttgataattccgttctgtaataccaatattagaagctacttgcttctgagtatattttaatgatacacgcatttcttttaaatgttctccaaaattaaacataaaaaataacctttcaataaattaatatatagaagcgcccatgcacaaatttgtctgctcaaaagattgggcatatcaaactagtattccgtaaataaaagtaaataaaatataatctatttatataatttgggattgtcagtacgtccaaccaagtagtcaatggatacgtcaaaataatcagctaaagcaatcagcacacttgccgtaggttcacgttgaccacgttcatagtattgatatgctcttaatgacaaatttacatcttttgcaatatctttttgcaaaaggtttttatctttttttaatttaataagtctgttagaaagtttattcataaaataacctcacaaattttgtaaaaaagtattgacaagcataaacgtgcatgatataataagttcgaaaagagcacatgtgtgcattcgttgctttggaaagagatgatgcaatattatacatatataaaaatatctaaaaactatataatataagattatttggtgtattgtgtacatagtaaaacgtagttgataataatcttttgtattattatagtttaacatggtttgacaaaataaacaagccttttattgggcttgtattaaaaaattaaaagaggagggagttataatgagcttctttttggaccctttcagcaaagtaaatattcagcagattgcttcatttattatgtatggggatgaatttacgatacctacaaaaggttcttatgaacagagaatagaagaagcctggaattcttttgttgaagaggcaaaaaaattatatccggatttaaaagaaacagacaggatttttgactctattattttttatgcttcggtagttgaggaaatatatatggaagtcggtatgaggtgcggagcagagctggctgtaaaactttttgaaaaagatatttaatataattattataaagattatacatcataattattacacagcatgtaataatttacttacatgctgtgctaattattgtatctcgtaatcaattgacggttaaattgatatagaaattaaagataaaatagtggcattacttagtatgataaactttgaggttaaaatagctttaaacagtttcatgatttgttataatgttataaattatatatttgattataaaaatataattattatacaaaaataatcttaaaagttttgtgattagaaaatagatgtttagtttataaatcaaaacattctcatgtgttccagtttaaactttatatttttaaatcttttttacgggtatacacaaattcgaaatcagaccgtctttgtcatttatctcagaaggagacgtgatatattcaagaaacaagtgtccgttaaaatcgtagccgtttatctccatccattcagctattgatttataaatgtcgcatatctggtcataccagcctgtaaatgtaacgcaggctgtgagtgtttcggggacttccttaaatttaagaatttcagagtcatcaaacttaccgttgacaccaatctgtacctcaatatccgggctttcatctttatggtcattatccatatagacagcgacaggagggcagtcatttgataaacaaatgtcatttttagcggcaagtaagtagattttcttccacagttctccttcgtctttatattccggtattgtttctcttaatgctgccactgagcgttttggtactgtctttaattcaacattatattttggcatagtctcattcctttcaagttttttaatagtcttatcaagcgttaaaagccgtttttcaatatctgaatattcagcctgcatttttattcggcattcttttataacggtcagcatagcttcaggagaatagttcagatgtttaagaattttaatttcggatatacttatacccatatccctaagaagttttacattagatatttcggaaagctgtttggtttcataataacggtatccggtaaatttatctatataagccggggatagtatcccatgctcatcatagtagcgcagcatacgtatgcttaccattgacagccttgagaaatcacctatttttaacattatatttccttctttcgtacatgtacttttagctcgtatttagtataatacctaacactgtgtcagagtcaacagtattttttgttttttatgaaaataaaaatttttttgaaaaattttcaaaaaaagtcttgacaaaaataaaattaggtattataatgcaagagttgactttggttcccctcgtgtcaacaattttgcgagcatgctggaatcggcagacaggcacgtttgaggggcgtgtgcttatggcgtgtgggttcaagtcccactgctcgcaccattatattgcctgattgtgtaagggtagcacaaatgactctgactcattttgtccgggttcgaatcctggtcaggcagccataaagcgtttgacacaatgtcagacgctttttattttaaaatttctgattggcggcggttatattttgtttgataaattgaaacagaaaactatgtcagcaaacgagtatgtcaaaacttttgtaaagtggatgtttcttgctactataaccggaggttttggcggtatagtcggttccctctttaatatgtgcattgtatacgttactaaaatgagaaataaaaacagctggctgatttttttgcttcctcttggaggactgctgatagtgtttctttaccggatttgtaaaatggataaaaattcgggcactaataatgttatcaaatcagtgagaagcgaggaggatgttccgtttcttttggcgcctctgatttttataggtactactgtcactcatttatttggcggcagcgttggcagagaaggagctgctcttcagcttggcggcagtattggagaaatgacaggtaagctgattaagctgaatgagaatgatatgcacattataagaatgtgcggtatgagcagcgtgttttcagctctttttggaacccctctgactgcaactttttttgctcttgaggtcataagcgttggtataatacactattcggcttttataccgtgtcttttgtcggctgtgctgtcgtataaagtgtctttattgttcggaatcatacctgagacatacttgcttccatacatacctttgttatctatggcatctttctttaagaccattgctattggtatagtttgcgctgttgcaagcataattttctgcgttggaattttcggtacaaataagctttttaagaagtggcttaggaatccttatctgaggatttttgttggcggagttataatagttgctttaacattttttcttggaacaacagattataacggagccggaatgaatgttattgaccgtgctgttttagagggaaaagctttgccttatgcgtttctgctaaaaatgatttttacagctatcactattggatgcggtttcaaaggcggtgaaatagttccgacattatttattggagcgacgcttggctgcgttcttggaggactgcttcattttaatccggctttttctgctgcgctggggatggttggtatgttctgcggtgtggtaaactgtcctatagcctctgttttgctgagtgtggaattattcggttccggaggtattgtgttgtttgcgactgtggcagctgtaagttatatgatgtcaggttattatggattatacagcggtcagaaaatagtttactcaaaacttagaactgagtttataaatatatatacaaaaaaagaatattaattttgcggacattcagtccgctttttattttgtcccggcgtaatatgccgggattttttattttaaagaaatattttaaaagttaaaaatatgtataggtttttattgtcaatcgtattgtttggtgataatggattatcaggatataattattcagtgattgataatgattttattggtgtaaggcattatattttctgctattgtaaaaggcgtttttgacaatagattttattagttttaattcgggtaaaattaatgtcgatatttttggataaaaaacttttgggaaataaaggcggaaataaagtctttgtctaactctatcaggtagccgtttattaaggattaaattataaatgtggacataaatgatatgagattataaaggaggaaattaaatgaggtatgaaacagaacaaataggaggggctttggtggtcaagctatacggcgagattgaccagcattgtgtaagcgagatacgtgacgacattgacagacagattgctattaggaatataaactcattgatagttgatttgggcggagtagaatttatggacagttcaggaatcggtatgataatgggcaggtataaaaatatggtcagccgcggcggaaaaatgatgcttgttcgtcctcagccacaggttgacaaagttcttgaactatcgggtattaaaaaactttttgaaaagaattgcggataaaaaggagtgaataaaatgaataactatatgaaactggaaataccatcaaagaccacaaatgaagcttttgccagagcggcagttggggcgtttgcagctcaggttgatttaactatagaggaactgtccgatattaaaaccgctgtttctgaggctgtaacaaattccataattcatggatataaagacgcaagcggggttatatttataaattgtaatataagttgtaaggatgacaagtatactattgagatagttatagaggataaaggaaaggggatagaggatatagatgtagcaatgcagccgctatatactacctctccgaatgacgagagaagcggaatgggctttacagttatgcagagttttatggatagcttggatgtaaactctgttttgggagaggggactaaagtagtaatgacaaaacgcattggagccgaaaatacttatgactaaattttctgaagcaaacgatgaattgctgaaacggatttcggaaggcgatgagagtgcgcgggaggaaataatagagcagaatataggtcttgttcgctccattgttaaaagatttttaggcagaggccatgaagctgaggatctgtttcagattggctgtatcgggcttattaaggctgtaaataagtttgacagaagctatggcgtaactttttctacttatgcagtgccaatgataataggagaaattaaaaggtttattagagacgacggcataataaaagtaagccgtgcgtataaggacatatcatacaaggctttcactgtcaaagaaagaatgatggcggaacagaagacagagcccactttggcagaaatagcaaatgaattgaatataactcctcaggagctgtcaacagcaatggaggccgcaaggtccccggaatctttgtatgctcagactgacgacggaaaatctgaggggcggtctttgatagaaaaacttccgtctgacgaggattatgaacaaaaaatagagaaccgaatattgcttagtcaggcgtttaaaggaatggatgaaagagagaggatgataatatatatgagatattttaggcagaagacacagtcagaaattgcagctgttttaggtatctcgcaggttcaggtttcgagaattgaaaaaaaggttctgatgaaaatgcgtgataaattaacaggatgatatgtaaaatttgtatatcatcagatattttaggtcataataattccagacagaataaaatggaaaaggagagaatttttatggccggatctcaaaaaaataaaaatcaggaatatcttgactatgtaaacagaacatcgcccaaaagtccaatgctcaaaaatatgctgctggcatttttatttgggggtctgatatgtgtaataggacaagcctttggagatttatacaaaaatgtttttcacatggatattgaaaattcaaagacggcagtcagtataactatggtgtttttgggagctttgctgacaggacttgatatatatcctaaaatagcaaaatatgcaggggcaggtactatcgttccgataacaggttttgcaaattccatagcttcaccggctatggagtttaaacgagaaggtcttgttacaggtatgtcagccaagatgtttgttgtagccggaccggtgcttgtttatggtataacaagttcaattgttgtcggaataatatattatctttataagattttgataggaggttaaatttatggccgttcgtttaggaaagcagacaatagcacttgaagctccggtatctatagtaaatacagccacagttgtgggaaccaaggagagcgaggggccgttggctccatattttgatgttcatttgaatgacgcagagtggaatgaagaaacatgggaaaagtcagaaagcaaaatgcagagggaagctgcaaaactggcaataagaaaagccggaatggaacccggaaatatagattgtgcatttgcaggggatttgcttaaccagtgtataagctcaggctttagtgcgagagaacttgaaataccatattatggcttgtacggagcatgttcaaccatgatagagggattgagtttaggcgctataagtattgacggaggaggatttgacagaaccatagcggtagcgtcaagccacttttgtacagctgaaagacaatatagaactcctcttgagtatggcggacagcgtaccccaacagcacagtggactgtgaccggagcgggagctgcggttcttgaaaaaagacagtttccgccttatattacccatataacaacaggaaaggttattgactttggagtgacagaccccaataatatgggaggtgcgatggctccggcggcaatagatacattaaaagcgcattttagagatacaaagagatcacctaaaaattatgatttaattttaacaggagatttaggaaaagtaggaagagagatagttatagatatgatgacagccggcggatttgatatggaacaaaattataatgacaccggctgtatgatatatgattttgaaactcaggatgttcatgccggaggcagcggatgtggatgtgttgccgttactctttgcggatatgtttttgaaatgatgaaaaagggtgagttaaatgatgtccttatattgggaacaggcgcattgttaagcccgacgtcgtctctgcagggagaatcagttccgggaattgcgcatgcgatttcactttcaacaacaccaggaggcggaaaaaatggattatattaatgcgttttgggtaggcggactcatatgcgtcgcagcacagattttaatagataagacaaatatgactccggcaaggattttggtactgtatgttgttataggaacaattctcggtggaattgggatatatgacaaacttgtggattttgccggagcaggggcaagtgtgccgcttgttggatttggcaatgttttggccaaaggcgttatgaaagcggttgacgcgaatggtcttattggagtaattacgggaggaactgcggcagcagccggaggtatagcggccgcaatattctttgggtttttagttgcattaatttttgatccaaaagctaaaaaataatttaaaatacttcttaataaaagcatattactttataataatattttatatttaatttaagtttttgacttaagatttaaaatttaaatttaatgtgatttattattgttataagttgtcagttatttaaagtatttttgcttgttttaaataatatttcagaaatgtgacaaacgtttgatataaaccatttattgtttttattttatggtaaaccattaaaaattaacttaacatgaatgtcaatgttacaaaagtattaaaagatttttggttaggatataatgattaacgtatttccagtaatcccatagtttcttatatattacattttaaaatttgctttttggatattgaaatgataacatatcaatttgaaaagtaatatatatatgaaatcagagttaaaactttattaggaggtgggattattgatggagagcggtgcgaaacatgggcataaaaacagcgacgggacttttggaattatcaaaagagaagtcaggcttgaaggctccgctgaatgcgtagaatgtgtatttgagggatttctcaggtgttgttatgaaatagaactgagggaacatgaattggttagtatagaatatttgctgactataggacatgataagtttcgccattatggaattaaagcaataatgagaaataaggataatgatattttagattgctctgttgctgaaaataggtttgctacactaactgaatgtattattaaaatgcagatgctggctaaagacaaagtccttccatgcactttgccctatgtagtataaattaaaccgtgttggtttttgtaatataaaaaaagactgccgcattagcggcagccacagaaaccaatatatacataaataaaaatcagtttattctattgtttggttggtgttgtcaacctgagcaggtgcgcttggaacaatatttccgctgtttctcatttcgtttctattgtttcttacaatattaacacattgttctaaatctttcatagaagacataacgactttttcaacagtttcaagaagattgtctgcgtaattaaaggaagaatcagtaacttgctgtgcattcgaacgagcgttttcgataatctgattgccttgaacgatagctttttttgtaatctcgttctcgttgaccatggcaataatcttatcttcagcacttttaattaaattatcagcctcagtttgagcttcctgcaaaattctttgtctttcttctttaatccatttagcttgttttaaatcatcgggaagctttagcttaatctcttgaagaacgtctaaaagttcatctttatcaagaatacagcgtccggaaaacggcactgaagcgcctttgtcgattatatcctccaattcatccaacaattctaatgcatccatataaaatacctccttgaaatattaagccggtctagtattttgaattttcgaaacggctttttataatagggattaagttgtccggaacgagaccgttaagacatccgccatactttgcgatttcctttacgatactggaacttaaaaacatatattctttacttgagtgcagaaataaagtctcaagctcttcatataaggtttgatttgtaagcgccatttgaaattcatattcaaagtcggataccgctctaattcccttaataattatctgtgaatcaattttcttcataaaatctaccagcagaccggaaaacgatgttatttcaacattttctaagtcaccggtaacaagttttaacatttcgacccgtttttcaactgaaaacaaaggattttttgaattgttgacgagtacggcaacaactactttgtcaaagagttttgaagctctttttataacgtccatatgtccgtttgtgcaagggtcaaaactgcctggatataccgcagttctcatataatcacctctgcataaccgttattaccgttttgccatatctggatgattttaaaatgtcaaacccggtacttgttatgtcttcgccgtctgtctctgtttcggctactataattccattctctgataaaagattgtactcataaatcttattcagagatttaacaagaagccccttattatatgggggatctaaaaaaataatatcaaatccgtgtgtcaatttaaacggaatacttttgccgtctaaagttaccataacgtccccgtcaaatagcttatccaaaaaattaattgcgtcagtctgatataggacagaaaactcctgaagacctgaaccattaaggttattgtttaccaattctgcggatttgcgactattttcgacaaatacagcgtagtctgctccgcggcttaacgcctctataccaagggcgccgcttcctgcaaacaaatccaaaaccaaacggcatggaaaacgcatttgaattatattaaacagggattctttaactctatctgtagttggtctagtgccgtcaccgagcggagaagcgagcttatatccgcgttttttaccagatataatacgcaaaacaaagtcccccttgccggaaatagagttaagtaatatattctatatatttatatatcaaatttgtaattttgtcaagcgttttaaacaaatttgtaactattaccaaaaaaagaaaaaagtcgaaaaataaatataccccacgattgccgtagaatggataaggtaaaaacctggaaaccaggtgggatcgactcaaaagcattacaagtccactgaatacccaaaggtatgaggcatgtgcgccgcttactgaagttttgatcccttataaaaattgttggttttacattattgccataaatacgtacaacgcagggaaatatttaattcatatcatattatatcatatttttttaaaaatacaacatttttttgattttttttgttacaaatttttggttttgtatttaagaaattcatttcgttaatgttacagggcgtttcgggaactttacaacctaataacaaattattatttccaaatatttaggattgaaataaaaaaatttttagttataattaattctatattaacatagattttattgagtatcggccgggtggttaaaaactgccgtactttaaattaccatttgctataatttgtctgtttcgtattttgtatatcaattagactaatattttttgtggttattatagcagaaaaattttcagggagattgttttatgaagattgagaagatcaatgagaataaaataaaggttttaatcgacattgacgaagcgaaagagtggaatgtgaatataaagaacatagcgtcaaatacacctgaaattcaggagatgttttggacagcgcttcgtcttgccgagaaggatgtggaattttcagttgacggagcaaaattatttgttgaggctataccgggacagacagaggggtttggaatgcttataactaagatatttagtgataatgacctaaatttggctgtttcaaattgttcatataagggtcgtgtcaaaaaaagaaaattgacgcctgggaggaatgagtgtataaaaagggctttggggaaacgtatattcaggttttgtgattttgaaaatgtttgccaggctgcaagtgcggtttatcgggattttgagggagaaagcactctttataaacttgaagattcatattatatgctgcttcttccaacagacagctcttctattattgggatagaaaaggttatgcttgagttttccgataaacagtctaagacgcttatatctcacggcagactcaatgaattgggcgagataatgataaaagaaaacgcagtaaatatattatcagaatatttttcataaactacataaaatatactttataaattcaaaatcggcagagtaataatcactctgccgatttttaagttatagctcttaatattaggttaaaataagtattaggtattaggataaaatacagcgtctaataattaagatttgtcaaacaagattattaccggcgctgattctaataacaaaaaatcttacatacgaatctatactatgactttgtacttaaagaagcgcaaaatacatatggattatataaatatcgtatgttcaacttatttgataaagtaaaacaagttaacgaaaataactataatgaaaataaataaaaatgtggttttgcaagcatcggtagggaaaacgaagtttgccgcgtaaggcgcgcagccgcggaaaagctattataaaaaagtttatgttaatattaagcggattgtttgataaacctacactttcaaaaaattacttagttgtggtgtatattcttgaacaccgagtgaggtgatcagccatatcacgtgaagtatgaacatacttagaataaattgacatagttttttaataataaacttttccgcggcgcgcgccttacgcggcagatttcatctgccattcgaagcttgcaaaaccacatttttatttattttcattatagttgatcttatatttgccttaaaatttctgtccatatattataacatttccaataaatcagttttcaaattttgacagcttataatacctctataaaagttatattaataaaaattaaatgggtgtaaaatcaataatttgattttacacccatttttttagttttcttcatattaatgaaagattatgaatatgaatgatataactggattaattaaaacattttaagagaagggaagaacttttatggagaacaatgaatcaatgggaagacatactgtcactattgaagaccgaaaacgaataaaaataaattgcgttgaggacgtggagagctttaatgaagaaaaagtagtagtttatacaagcatgggcgtaatgatagtctccggatttgattttaaggttaaccgtttgagcgttgaggacggacagctaattatcgacggagaggtagacaaggtggaatatatggaagttgcagataatgacgacaggggaggctcaggatttttcggaaaactttttagataaataaattacggaggaaaaacagatggatacaattacaaaagcaaacgaattaaattactttttttggtcaatgatatgcggcgttgcaatgacaatagtttatgactttttgagagctagaagaagagaaaaaaagcaggttggattatttatatatatagaagatatagtttggttttgcgttttaggggtgctcgtatacttgcttgcattcagacagaatgccggtatgataagatggtacagtttttttggaataggactgggggcgcttatttataaactattgctcggcgacaaacttatgaacgtgtttagaaaatgttattcatattttgtcagggccttctgttttctaataaaaattataatgtggcctgttagatttatagcagctttaattaagcggccgattggagttgtagtgtggcattcaaggaccggctcaagacagctgtcagatatgatgaaagtgtctaaacagcggcttcgtaacagaatgagatataaggcaagaaaaacaaacagcagtgaggaagatgaataataaagctgtgattataaaaataactaataatgggtagaatatccaagtaattttgtattgtaaattatagtatttgagagactttttcattgacaaaacgtatttgataatatataatatccttgtaggtttgtaaatttattacataatcaaatagctgtgaagttttcactgctgttaggaggatgagcgtcggtgaattctgcgggagaaacaaggagaacagataaaaacagcagaaatttttcgtcggtaggcgcggccgctgcggatgttaaaagcagggcaacaaaaacgataaaaaagactaagaatgttaaattcaatataaaaaggctggttgtgtctgtagccgtactggttttctgtgtatattttgtttgcatgatgataggtcagcagagcacaatcaatcgtaaaaataacgagatacggaacctgaatgagcaaattacttcggctaaccaggaaactgaaaggctgaaggaagagcttgaaaatgtaaatgacccggaatatcttgagagaatggctagagagaagctgggacttgtaggtccgaatgagcgtgtttatattgacgctaacagcacaaactaaagttgagttttagactcacattttaattgagtattattaatttatataagcgagagtattctctcaggagggaaatttagtaagtatgcaaattgaagttggaatggttttaaatgtaaaggttaccgggattacgtcatttggcgcttttgttgagctgcctgaaggaaagtcaggacttattcatatctcagaaattgcatccgcttttgtggaggatgttaatcagcacttgaaaaaaggtcaggttgtttccgcaaaggttatcggtgttgataacggcaaaatcagcttgtcaataaagcagctggaatccggagaaaatcaagctaagccggaaaagaagccaaaagacagaacaaagaagaggacttcaagtccccgcagcaatcaaccgccggaagagtttgaattcgtgtcaaataagaatagaactgacgatttgagttttgacgatatgcttcaaaaattcaaaaaagacagcgatgaaaaattccaagatttgaagaggaacactgataataagagaagcggcggttataagagggcatactaacagattgtaggtgattttatgacaagtgccggtatattttggataattgcggcagttttgttcgctgtgattgaagctgccacagttgcgttggttacagtgtggtttgcggtaggagcacttgcagcggcaatagcagcgcagtttggagcaagtattttatttcaggtcggtacttttgttgtagtgtcggctattttgctttgcgttactcgtcctgttttcaaaaagatatctgtgaaaaagccgcagagaacaaatgcggacaggtttataggcgaagaggctatggtcattaaaaaaattgatgatataaataatgatggtcaggtaaaaatagcaggacaagtttggtcagctgtatcggaggataaaagtccgcttgaagagggaacaatagttaaggttattgctatcagaggagtgaagctggtagtagaacctattaattcataattttattgaaaataatttgattttataaaatatatttatgaggtgaagcagcatggtatttctaattatattacttgccataattgttgttcttgttgtggcaaatataaagattgttccccaggcgcacgcatatgttattgaacgtttgggagcgtacagcacaacctggagcgttggtcttcatattaaaattccgcttattgaacgagtagcgaataaggttactttaaaggagcaggtagttgactttcctccgcagccggttataacaaaagataatgttacaatgcagattgatactgtagtatactatcagattactgacccaaagctttatacctatggggtagagatgcctatgtcggcaattgagaatctgacggctactacacttcgtaatattattggtgatatggaacttgacgaaagtttgacgtcaagggatataattaatactaaaatgcgttcaattttggatgaagcgaccgacccatggggaataaaagttaaccgtgttgaattgaaaaacattatccctccggcaggtatacgtgaagcaatggagaaacagatgaaagctgagcgtgaaagacgtgaggcaattcttagagccgagggtgaaaagaagtcagctattttggttgctgaaggtgttaaagaatccagaattcttgaagctgaggcagaaaaggctgctcaaatccttagcgctgaagccgataaggaagctgctatacgcattgctgaaggtgatgctgaggcaatcagaagtattcagcaggctaccgcggatggaatcagaatgcttaatgagtctgagccgggtgaggctgtattgacaatcaagagtttagaggcgtttgttaaagcggccgacggtaaagcgacaaagataatactgccgtcacaaattcaaggtatagcagggctggctacaactcttaaagaagttatgaaggattagttttactaaaataaatatgttattattcatttgcacagatgattttatttcatctgtgcaaatgctatgatatagataaaagacttaaattacagagatttaaaacataggaggaaataatatgtcaggacattcgaaatgggcaaccataaagagaaaaaaaggagcaatcgacgctaaaagaggtaagatatttaccaaaatcggcagagagctaatggtggctgttaaagacggcggacctgacccggacacaaattctaagctgcgtgatgttattgccaaagcaaaagctaataatatgccgaatgacactattcaaaggagcataaaaaaggcagccggagaaggcgacgcaggaacatatcttgaaatggtatacgagggatatggcccgagcggaattgctgttatggtggagactttaagtgacaataaaaacagaacggcggcagaccttagacactattttgataagaacggcggaaatttaggacagagcggctgtgttggattcatgttcgacagaaaaggtcttatagttattgagaagaccgactctgttgatgaagataccttgatgatggacgctttagaggcaggagccgacgattttaatgttgaggatgagtgttatgaaattctgactgctccggaagcgctgggcaagaccagagaagagctggaaagcaagggttatacattcgcacaggcagaagtaaattacatacctcagaccactacgaaattagataatcctgaggacattgccaaaatggaaaaactgattgatatgcttgaagaaaacgatgatgttcaaaatgtttatcatacttgggatatgccggacgacgaggaataatattatttatactgagctgcaaaaaaacagagcggcggctgaaaatgcggcgtgaatctgtttttctgcggctttatttataggaggtggatttgtggcacgtatactgcatatggcggatatgcattttgattctgcctttacctcgaacctttcaattaataaatcaaaacttaggcgaagcgaacagcgtgaagtcttttcaaggataattgaaatggttaagaccgaacaaattgatgttatgttgatttcaggcgatttgttcgacagtgaaaatgtcagcgaagaaactattaactttatggttagaaaatttgctgaaatttctgaaatacctgtattgattgctgctggaaaccatgacccttttaatatgaattctgtttatgaaagaatcagtttaggtgataatgttcatatcttcaatatagaaggcggattttatgattttgaaaatcttaacctaagagtttccggagtcagctttggcagcgaggacggaagcaatattaaaactccgaaaacacttcatcctgaattttcgaatatacttgttatgcacggaaatgttgtttctggtactgctgagagcggaataagatataatcctgtgaccaaacaagaaatagaaaactcaggatttgattatatagcttttggacacgttcattcttttagcggtataaatgtagaaggaagaacatattgggcttatccaggtatacctgagccgcgcggctttgatgaaagcggagaaagcggagttgttataggaaatgttttaaaagcgggttcagaatttaacttacgtaaagttttaaagagaaattatcatacattagaaattgagataacggcagatatttctgataatgaacaaataatcgagcttattgacagtaagataaaagagtacggcaatcaaaatatttttagaataatccttattggtaaacttcgatcagactttttcattgatattgatttgttgaaaagcaggaccgaaaagcttggtttttttgttgaaatcaaagatgagacagaaatggagtatgatttgtcggttgatatccaggataacagtttaagggctgaatatataaggttgatgcagaaaaaacttgatgaatttgtgcacggaacacgtgaatatagaattattgagaacgctgttaaatatggtttggacgcgatagaaggcaggcttaaaccataaggaacggaggtgagcaagattagaattacccggttagaattaattaagtttggaaaattcgttgactattctattgatatcagcgatggaatgaacgtaatatatggggataatgaggctggtaaatcaactattcagctttttattaaatttatgctctttggtattccttcgagaggcggaaagagagaaaaaataaaagacagagagaagataattccgtggcaggataataaggccgccggaaaactctttttgataaaagacggcagagaaatagaggtataccgggagttcagaaaacgtccttccggagatatagtaaaagtaacagacagatatactggagaaaattattttaacaaggaaataaagtctgaagacgtcggcgttttgctgcttggaatgagcagacagatgtttgagcgcacagtttgggtaactcagagtagtatttgtatgcagggcagtgatgatgaaataactgctaggcttataaaccttttggagagcggcagtacaagtgatgtttcaattaaaagcgctgtcagtgggattgaaacaaaaatagcaggattaaaggcgaaagatggaagaagcgctccgggcgaaatagatttgcttaaccgagaacgtatagagttaaataaaacgctgtctgaacaaagggcatctgagagaaagagaaatgaagtaaatcaagagattaacttgcttactcagcgtaaattaaaaattgatgatgaaataaagcatcttgaagcggttgaaaaatccgagcgggcaaaagaaaaaatattgcgtgttgacaggatagatggctgtgttcaaaaagaaatgcaaattgctaacacaaggcagtttcagctttttaaacacaatgctgttcctgagagggttgaaagtttgcgctcagattctgagcatattgatgaacttgaggtaaaggcatatcagacgcagcaagaacttttagctgaacaaaactgttttgcagcagaagagaaaaagagaaaaagactgttatattttttaattggagctgccggattggctgtaattttagctgtgttaggttttgtattcggagtgggaaaaaatatattttattggataacagcaggagcagttgtattatttctaattgctgcaggaattattttcggttgcattattcataacaatatagtaaaatcaaaagaaagtttaataagtgttgacaatgaactttcacttataagaaaagagatctctgaaactgaaaagagattttcagaaagtctatccattttggaatgtgatactttaaatgattttaatgaaaaatttaggttatattctgagggtaaggcaaaaataaagatggtgagagaactttatgaagaactcttaggtcaagacgattatcaggagttaaagagagaggccgataatcaaagaaagtttgttatcgaatctgataatgttgaacctggtaatattgaacgaaaactggattcattaacaaatgaaaaggaaaagatttccgggcgtattttggagctgaaacagttaaagatagacggaggtttggaaattcctttgattgatattgaaaataatataaagtttattgatgaacaaattattgaaaaggaagaggaatattcatcataccaagcggcgaaggagggacttatccaggcgtatgcaaaaattaagtcggattacactccgctgctgaatgcagagacagaaagaatattaacccggcttacgggaggccagcatgacagtataaaagtggcagaagatttttcactcagcttaaaagaaacagataaaaatattgatttgaaacaggcggagttttttagtacaggaacatataatcagatttatttggcacttagactggcaataattaaacttactttaagcgcttcagactcagtaatatttttagacgatgttttaacaacatttgatgacggaagaagcaaagacgcgcttgaagtaatcagagaaatttgcattaaagacgggtatcagtgtttattattcacttgtcatcaccgtgatatagagagtattaaaaagtatcctgatataaatataatggaggtattattatgagcggaaagtttgataattcaagaggaaatgtgaaaatagcgaacagcgtaattgctaaaatagccggttatgccgcaacaagctgttatggagttgtgggaatggcaacaagcggtggcaaggacggtattgcaaaactgcttaaacgcgaaatgatggataggggcgttaaagtaaagttaggcgagaacggtatagatatttctctttatattattgttgagtatggcacaaacatcaatgctataggcgaggttataaggagcagtgtgaaatataaggttgaggaaatgtccggcttaaatgtgaatactgttgacgtaaatgttgagggaataagagttaattagagcggattttataagaaggagaataaaatgatacagcttgacagtaaaagtttaaagttaatgatagcttctgcgtcaaatcagattctaaacaatgtcgagaaagtcaatgatatgaatgtttttccggttccggacggtgatactggaactaacatgagtatgacgttcagtgcggcggctaaaagcgttgttgatttggataataaaaaatctccggttgaagtgttggaggttctttcaaagtcagctcttagaaacgccagaggaaattcgggtgttattttgtcacagattttaagaggtctgtggcagggagctgaacaatcaggagaacttgacgttagcggagtgaagcatgctttatgtgaagccagagacaccgcataccgtgctgttatgaagccgacagagggcacaatattaaccgtaatacgtgaaattgcggagtatgcggaagctcattttgtggagtatgatgatgtcactttatttttgaaagctgttcttgaggccggtaggaaaagccttgccaaaactaaagagattttgcccgttttaaagcaggttggcgtagtcgacgcaggaggatttggcgttataatacttctcggcggcgcggtaagcgctttggaaagcggcaaggcggcggaacttgaagagagcggcaaagcgaataataaacaaattgcatctcagggaattaaaagcgctgaagcagatacttcggatataaaattcagatattgtacggagtttttgataaataaagacagcgagcgaagtgccgcccagttgatggcagccattaaacaaaaaggcgattgtatgctggtcattgatgacgatgaaattgtaaaggttcatatacacaccaatcatccgggatttgtgctggaacaggctttgaagcttggtgagcttaccagtataaaaattgataatatgaaatatcagcataatgaaattgttaacggaagccagaaagaagatgaggaattttcagacaatgaaaccgaactgaagaaatatggatttgttgccgtatcttcaggtgatggtttgagccaattgtttgaaagtcttaactgtgataaaatagttgcaggaggtcagactatgaatcccagcacacaggatattttagacgctgttttagatgttaaagctgaaaacgtttttgttctgcctaataataaaaacattatacttgccgctgaacaggtgaaagaactggctgacgtgaatgtaatagttattccaactaaaaatatgcctcagggtatagccgctatcgcagtatttaacgaagacgcagacttggacgaaaacatttctgtgatgaatgagagtgctgatttggtgaaatgcggacaggtgacctatgcagtaagagacactaagattaacggagtggatgttgaaaacggagatattatggctgttattggcagtgatttgtctgtggtaggctctgatgttaatgaggtggcaaaagagttagctgaaaagctggtagacgaggacagcggtgtaatctctatatattacggcaaggatattgaaaaggagaaggcaacagaactttctgcttatttagagaacaaatattccgatttagatgttaatttaaattatggcggtcagaatgtctattattatataattgctgtggaataagtttatttttaactataatttatatattcagagatataataacctttatatctccattttgtttataaaattcaaaatcggaaagttatgatagcaactgataaatggtgtgatgaaaaatataagacaattttagcttcgtacatatttatggtaataatttgtttggtttgattgaattagataaacgacatctattttgaatttggactgtggaatggtgaatagttttgtttgacagattggctgagcggtgagaatggtctttacgattgtactaaaatgtttattaaaaagaccttcgaaaatttcactgatttatgctgtgatgagataataaatgaacagtgcttggattgaagaataaactttatggaaccgtgtattgttgattatggctgttaaaatgcaaagctataaaagccggataaaacaggactttaaaaaataaaaatgctgttaaaaggaagatttttatgttgcttagtgacagtgtgcagtatttaaaaggaataggagaaaaaagagccgagctttttcataagctgggtattttcaccgtggaggatttgttatatcatctgccgagaggatttgaagacaggacaaatataaaagatatttcggatttggcagaaggggaaacagtttgcgttaaaggcgttttggctatgggcttaagaaagttcagagcacggaacggcacttgggttattcagaccaggctctctgacggaagcggagttatgcagctgacctggttcaatgctccttatgttgaaaaatcgctggaggacccgtctgcagaatatattttctttggcagagtttcctataggagaatgtctcctgagatggtgaatccgataattgaaaaagtggacagcggaacttccaaaatgggtaaaatagttcctatatatccggccacaggaggattgcagcagagaagtatcagggacgccgtgacccaggcggttttaaaactcggcgaaaagcttcctgaatcccttcctgaagagataagacaaaaatacgatttaatagatatagagagagctattcgttcggtacatatgccggaaacttttgatgatttttatactgccagaagaagactggtctttgaggagtttttaaaactgcagctaggtgtggcaaccgttaaagcgcataaacacaaacagtctgcggttgttatagaaaatgtgaaatgtattgcggattttgctgcttcgctgccttttgagcttactaacgcacaaaagagagtaataaatgaaatatctgcagacttaaaaaattcggttccgatgaacaggcttgttcagggcgatgttggttcaggtaaaacaatagttgcggcggcgtccatgtttgctgtggcaaaatcgggatatcagtctgtcatgatggcgcctactgaaattttggcggaacagcattttgccggtttaaagaaatattttgaaccgtggggaataaaggttgcttttttaagcggaggacagaaggttaaagaaaaaagagaaaatcttgagctgattgaaagcggtgaagcttcggtcatagttggaactcatgccgtaatcacggataaggtgaattttgctaatttggctttgagtataactgatgaacagcacaggttcggagtcagccaaagaacaaaattggcagggaaaggaataaacagtcatacgttggttatgacagctaccccaattcccagaacgttatctttggttatttacggggatttggatatttccattatagatcagcttccgccgggaagaaaagaaattaagaccatagctctgacagaagccagaagagcaaaaatgtatgagtttattctccaggaattaaacaaaggcagacaggcgtattttgtttgcgctcttgtggaggattctgacgcggttagtgcaaaagccgcaactgattatgtaaaaagattaagcaacggtgttctaagaggaaagagcgttggtcttttgcatggaagaatgaagtctttcgaaaaggaagatataatgaaacggtttgcggcaggagaaatagacgcacttgtggctacaacggtgattgaggttggcgttgacgtcccaaatgcaacaattatggttattgaaaatgctgagcgttttggactttctcagcttcaccagcttagaggacgagttgggcgcggcgctgaacagtcgtattgtatcatgtttggcgaccaaaaaagcggtgtggctaaagagcgtatggcggtaatgtgtgaaactaatgacgggtttaaaatagctgaaaaggatttggagattaggggaccgggagagttctttggaacccgccagcatggtttgcctgaaatgaaaatcgggaacttttttactgacatggatattctcaaagagacccaaggagctgcggcagaaattttgaaagaagacccaatgctggaaaataaaaagtatgatatattaaacagagaagttgttaagacatttaataaagtcggcgatgttttaaattaatatttttatatagataaatttgtttaggatttagaatatatataatatattttgtgcagttgcttgaatttagttaattgaataaattgccggaactctattaggcattataatttaaattttttgtgattattcttttgaattagttttattatttatattagaggttctgatatttttttcaaaattataaagtttagtctgatatataaaattgtcagactaaactatgtttggtaattaacttttatatttaaatgctgctgtcatatataaaatatattatgtgttttattaataaaaattgatggtgttagttaagataattttagttgaaaaaaatcgctgtctgtgtagggatggtcatattttattgataagtcttcctgactaaccttattaaacccggccttttcatagaacttgtgtgccctttcggtatttttgggagtgtctagaacaagctctttaaatttatgctcatatgcaaaatcaagtaattcagcaaatagttttctgcctaaattataaggttttccgcggtattgctcatttacaaagaatttttttaatattccaataccatttccatagttcataagtccaatagtaccgactagtttattgttctctgatgcaatccaaaaatagccgccgtttgtgaaatattcctgatttatatttagcagttcaggttggtctgcaatactgactattggtcttgtgccatcattttggcagctcagcacgaggcggataacctcatcttgatatttgtcttcgtatttttttatttcaatcatttttgtttctctccaatatcttaaaatatcaaatgattttgaaagtcctttatataaatataaaaacagttttgctaagtatatagattgttaacagtaaaattattaaataataattttaaatcatttgtagtacaaaatcggaattgctgtatttatatattagtttagcaaataaaaattaaagttttatgtaaaatgggtaatatatttgaaaacttagcatttttagattatattatttttatgtataaagattatactgtatattttattgttcacttttatatttcttctataaaatgcaccggatatttatcccagtattttttatatacataacctttggcattatttatgtctaattgatacattctaaaaataacttttatatttttaggctgccattgttcctcatatgaatacttatatttcataccgacttttttcataacctcgccgctgccgggattttttatatcatgtgttgccgtaatatacggcaaatctaaagtttttaaatatttaattaatgcggccgcggcttcggttgtaatcccttgattccaatattcttttcttacagcatatccgaggtcatgactttcatcatggctgagttttatgtatcctatagggatattattagatttcagacatattgcataggttaaatctttagagttaattatattgtttaaatattcttctgcctcatcaatactgttaagaggaaacataggcagaaatgtgtttacctcattatcacttaaaagagtgaagagcgcttttgtatcatccttattaaactttcttaaaataagccgttttgttttaattatattatatttctgcataatattttctacctttattttattagttaatttccgcgtttgtatatccctgttatatttccgtattgaattatatgtccgtttgccgccgttaaaaaatctttcttttttgaatcgggactcaaatttaaaaaacagtcaagcgcgtaaatatgaaatatatatctatgacagtttcttataaaaaattgctgtttaggtcctttgtattgattacgcccgtatcctatcccttgcattgcgtttcccaaagcagtaacaagttttccatgaggtatgttttcaggtatttcatttaccgccggtatattccaaataatccaatgattaaatgcttttataaaaggaatatcaaagtcgtccataacaattgcaatagagacagcttctttacttaaacctgatatcgtgaatggaggagatatatcttcaccaaatccggtatgccttttggggataaatgaattgttgtcaaatgatttgcttgtaatttctaaagtattttctttaatagtcatgataaatcctcttttattttttctttaaaattgtcacggcagcataatgaagaatttcgaatttttcaggagcaattgtttcgagcatttttatatgttccttctcaaatttttcaatttcagcatccgtcagtgaggcgccgataccgcggcaggctttcatacgtccgttccaggatttcctggtaaaaggcacatttatatcaaacacttcgcttttttctacttcgaaatactctgtataatcatcatcaatctgaatgttatggcgggtttcccttccgcctgtccaatctggattatattttaaaataagattttcactttttcctgctatggcgtcttcaaacggaagccacgccatatataaaattacaaacttacctgatgctttaagtattttgtgtattttaggagcaagcacagggtgattaaaataatcaaagcactggcatgctgtgactatatcaaatgattcaggggcaaactgaagttcttcggcaggagaagagaaaaattcaatattcattttatctttttcggcgagaagtttagcttgttttatctgattttcagatatatctataccggtaaattttgctccgtatttatataagttgcgaggtaaaacaccggtaccggtgccaatatccaaaacattctgaccttttgtgcagatgccgttttttattagatactgataaaattcatcggggtaaatatctctgaattttgcataatcatttgaggtccttccccaatcgaaaccttttccgccgtcaatatttttattaataatcatttttacctccggtataaatatggtattgttttgtatttattttagcttatttagtaaatgatggtatgtaaatgtctttttagaatttgattaatgttttgtgtattataggaaaaacaattattatttaaaacaaatcatttgaaattatgacgtataacagcctagtaagaatgtgagtcatattatgtgattttatatttaaaaaatataattatcttacgggtatgtagtcaatagctgattcctcatcagttgcttcaagtttgaaaataaccggccgtagaccgtcattacagctgcaaattgctactcccggcgtttttatccaatcgccgtaataaaatgtacccgctcccgcgccatgcgccagtgcaaaaacatactgatatatagctttccaggcctcgtcgcataatccatcgggttttgcataatccgcgtagaaaacctgttcttttttttacattggacaggcggttaagttatcggctccatattccattgccaattctttatctaaggtggtttttaacactgttatttttacctttttcatatttgtgtcctctttataaagataaattatatatcaaaccgacctcagcattactgtcgctgaggtcggtttaaagaagttttatttttcaagtaatgattctccggtcatttcgtcaggtttctccagccccatcatatctagcaaagttggggttaaatcagcaagacgtccttcttttaatttagcgtcttttctgccaatcagaatcagcggaaccacatttgttgtgtgggctgtaaacggctcgcctgtctcatagtctaccatttggtcagcattgccgtggtcggcagtaatcagagcttcgccgcccatttccaaaagagcgtcaactacttgacctacgcagttgtcaaccgtttcaacggctttaacagcagcttcaaaaactccggtgtgccctaccatgtcacagtttgcaaagtttaagattattgcgtcgtatttgccgctcttaatccgctttacaacttcctcggttacttcaggagcgctcatttcgggctgcatgtcataagtcgcaactttaggcgagtttatcaatgctctgtcctcgccctcataaggctgttcaacaccgccgttgaaaaagaaagtaacatgtgcatacttttcggtctcggcaatacggagctgtgttttacccagtttgctcatatattcgccaaatgtgtttgacagcgactcaggcttgaatgcaactttaacatttggcatagttgcgtcatactgtgtcatagtaacaaaataggtgttgaaaaagtctctttcaaatccttcaaagtttggatcaactattgttctggttatttctcttgctctgtcaggtctgaaattaaagaagatgacggagtcattctctttaatggtgccgagtggctcgccgtccttttcaataacgcatgggacaacaaattcgtcagtgactttatcattataactattctgaatagcctcaacagcgctttcagctgtgtttcctatacctcttacaagagcgtcataagttttttgaactctttcccatctgttatccctgtccatagcgtaatatcttccgcttattgtggcaatgtcgccaacgccgatttcacgttcctttgcgataagctccttaatatattcctcagcggaggaaggggggacgtcacgtccgtcaagaaatccgtgtacatgcacatctgtaagtccgttcttctttgccagctctagcaatccatacaggtggttttgatgactgtgtacgccgccgggtgaaagaagacctaaaatgtgaagcgaactattgttcttcttacagttttcgatagctccaataagtgcttcgttggtgaagaaatctccgtcagcaattgattttgtgattcgggtaagttcctgataaacgatacggcctgctccgatatttgtgtgtcccacttcggaattgcccatttgaccgtcaggaagaccaacgtccattcctgatgcgtgaacaatagaggtggggcattctttcatatacttatcaatattcggcgtgttggcagcatatattgcatttccgtcatgacggctgttttcgccgaatccgtccataatgattaacgcgtatggctttttgctcatattcaatgtctccttaaattcgttttgttagtcagcggctttaatgatagctgcaaaatcatcgggtttgaggctggcgcctcctatcaaacctccgtcaatgtttggcatagacaagagttcttccgcgttgcctgcattcatgcttccgccgtattgtattctgattttttccgctgtgtcctcgccataaagttccttaatagtatttcggattataccgcagacttcgtcagcttgctgggctgtggcggttttgcctgttccgattgcccaaattggttcataagctataattatattttcagcgtcgtctttctgaatattcaggaaagcaagttttgtctgccggcatacggtttccggcataattccgttttccctctcggaaagactttcgccgacgcagactattgggataagaccgccgtcaacagcggctttagttctaaggttgacggtttcatcagtctcgccgaagtattgacgcctttcactgtgtccgataatagtgtataaggctcctgcgtctttcagcattgcggatgaaagttcaccggtataagctccgctttctttaaagtgaacgttttgtgctccgacgcttatgctgcttccttccagagctgatacaacacccggtatacaaacagcggtggggcaaacgaccacatcgcattttgcatctgatattttattgcggatttctgaagctaaaactgctgcctctgaaggggttttattcattttccaattgccggcaatgattttttttctcattaaattccacagcctttcttttatatatctcaactcttattgtataaatatatatacaaataataattagaaatgttcatataattttaaaactatttatataggataataatttatttatcatcaagagcagcgcatcccggaagaatcttgccctccaagaattccattgaagctccgccgccggttgagatatggctcattttgtctccgaatccgagaatatttactgccgccgcactgtcgccgccgcctataattgttgtagcgtctgtatctgccagtgcttgcgcaaccgcaacagttcctttagctaaaatcggattctcaaatacgcccataggaccgttccatacaactgtttttgcagtctttacggtatctgcaaaaatttctcttgttttttcacctatatcaagacccattttgtttgcaggaattgcgtcagcactaacggtttcaaccggaatttcagcgtcaatagggttaggaaattcagctgcaacaactgtgtctacaggaagaagcagagtctttcctaaactttcagccttttccatcatttctttgcagtatgagattttctcttcatctaccaaagatgttcctacctcataacctttagcttttagaaaagtatatgccataccgccgccgatgatgagagtgtcgcatttttcaagcagagttgaaataacattcagcttatcagaaactttagcgccgccgagaatagcaaccaggggtcttaccggattatcaattgcgttgcctaggaaatctatctctttagccagcagatatcccgaaacacaaggactgaggtattcagtaactccaactgtagaacagtgagctctgtgagcgcttccaaatgcgtcgtttacaaaaacttctgcaagagaagccaattctttgctgaaattttcttcatttttggtttcttcaggtctgaatcttgtgttttgaagaagaacaacgtctccgtcgttcattgcagcaacagcagcctttgcattttcacctacaacattgtcgtcatcagcaaatacaacatctttgccgagtttttcagacaggcttttggcaacaggcgccagtgaaagactttcaactacctgaccttttggctttcccatgtgtgagcaaagtataacttttgcaccttcgtcaacgagtttctgaattgtcggcatagcgccgtttattctcgtttcgtcagtgatttttccgtcttttataggaacattaaaatcacagcgtaccaaaaccttttttcctttaacttgaatgtcatcaacagtttttttattcattaaaatacctccaaaaatatgttaagatttaattatttttaatttgttaaaataaagtattaatgtaattaatttatttatgcttatttactaaggataattttaccctaaccgcctaaatttatcaaccctttttttctaaaaaaacttctcaaatttgtaaaaacagcagtcaagagtttgtgaatgttttaacaaattaaattataaaaaatatattgacaaattctgtaaacggtgttatcctaaaataagtatatgtatttttagtatacattatatattttacatattagggaggatgttcttgtgagaacaaaactaaaaactaaagatttggttatttctgcactattaatagccatcggaattttaataccaatgatttttacgggtccgccgtttagaattgttgtaggaccgtacagcgcaacgcttatggctcatgttccggtgattattgctatgtttatctctccgtggactgctgtgttcactgctgttggaactactattggatttttctttacagctccgctggttgttgcggttagagcggcttcacatatcgtgtttgcaattatgggcgcatatatgttgaaaaagggtatgaatcttactgttacaggtttggctaccggggtagttcatgcagtgtttgaaggaatagttgttcttatattctttgctgtaggcgcgtctacaagcagcagttattcaaacctggcgatgatgtggataacaataggaggaacatttgctcatcatatagttgattatgttatagccgttattgttggctctgccctttcaagagctcatatgataccgtcgcttccgccgatttggggcaaaaagcagcttgcaaaataaagtgttgattatttataccgccgtgtattcggcggtatttttttctttgatgattattgttcttgaaaatacagagcaaatatgatatattaatatctgttaagaaatgaggtgaagcagtaaaatggaaaacgagtttttaatgggaaatgaggcaataggtcttggagctatgcacgccggggttaatcttgtatgcggatatcccggaaccccgtctactgaaatattggagagtgttgcaaaacgcaatattgataaatcagtttatgttgaatggtcaataaacgagaaggcggctatggaagttgccgccggagccgcatatgccggagcatatagtatggttactatgaaacaggtcgggcttaacgttgccagcgacccgcttatgagcttagcctatgtaggaataaaaggcgcaatggtggttgtagtggctgacgaccctgggccaatatcatcacagacagagcaggatacgagaacgtttgcgatgtattcaaagctgcctgtatttgacccgactactcctgaagaagcttatgagatgataggcgaagcgttcgaatattctcataagtatggaacgccggtaatattcagacctaccacaagaatatgtcatgcgtgtgcttccataaagcttaaatcaggagatgaaataaggaaaaatacacctgacggatttgttaaggacactatgagatgggtgatatttcccaaaacttcatatttgaatcatataaagattgagaacagaaataaggagctttcaaaagttttttctgaagaatatcaaagaaatgagtattctgacaatggcgatacagttttgggtattgcggcaggcggagtaagctacgcttatgttaaggaggctttgaagcttttgggcgatcctaatgtacgccttatgaaagttgcgacgccgtttccgttcccggaagaaaaagcgattgagtttatgacaggattaaaaaaagttattgctattgaggaactcgacccggtgattgaaagggctcttttacatatttgcggaaagtatcatttagatgttgatattgttgggaaagagagcagtcatgtccagtgtgccggagagaatactgttgagagtgtaaaaaaagttatagcggaatttttggatattaaacttgaagagacgaagaatgatgatacagatatgcctgaacttccggttcgtccgccggtgctttgtgccgggtgtcctcaccgcgcttctttctatgcagttaagaaggctgctgagggaaagaaagctgtgttcagcggtgacattggatgttatacgctgggaaatgccaaacctcttgatatgactgacacatgtttgtgtatgggcgcaggtattacagtggcgcaaggcctccatagaatagaagatgatgctttaaacttctcatttgtaggagacagcacgttttttgcgtcaggaataaccggagttataaacgcagtttataatgagactgatataatccttgttgttcttgataattccacaacagccatgacagggcaccagcctcatccgggaaccggaaaaactatgatgggcaatgttgttgataaagtagatataaaaaagatattggaagcagtcggtgtaaaacgcgttgagaccaccaatccattagaccttgaaaacgctgtaaaaaccgtgcagtcacttatggatggaagcggtgttagggcggttatatttaaggctccgtgtattgcggttgccaaaccggacccaagctatacaattactgatagctgtgtgtcatgcaaaagatgtatcacagaactgggatgtccggctattgtgcttaaagacggagcgccgtatatagagccgtcgctgtgttatggatgcggtctatgcgagaaagtatgtccggttggagccatcaaaggaggcggagaaaatgaaagataagataaattgtcttctttgcggcgtaggcggacagggaacggttttggcttcgaggatgattgccgcagccgctatgaagagaggtttgtttgctgaaaccgctgaaacaatcggtatggctcagagaggcggcagcgttgtcagtcatgtcagggtcggcgagaatcagtattctccgctgataccatatggaaaagcggatgttataattggatttgagccggcagaggctgtgagatgcctgccttatctaaagaatggcgggacggttgttgtaagcagcaaagcagtgctgccggtgaccgccagtcttggtatgggaagctattccggttcagaagatatgctcggctatctggataataaaacagaaaatttgatagtcgtggatacagatgagatttgcaaaagattaggtagtgcaaaagtgatgaatatggtgctgctgggagcggcagcgtcttcaggcgctttaggcattacattagacgagcttgagtcggctatggccgagagattggatgagagattccacgagcttaataaaaaagcgctccgtgccgctgtgcaggagtaaattattcggagagtgagagatttattatgaaaatgacgcaggaacaatttgatattataaaggctcagattaaaaaacttacatctatggattgtttttataaagagaaatttgatggaattgatgttgattcgatacagtcccaggaagattttgaaaaacttccgttcacctggaagggtgatttgagagaagcatatcctttgggattaatggcggtacctgaggaggagatagtaagaattcattcgtcttccggtacaacaggaacccccgttattattccttacactaaaaaggatgttgaggattgggcaaaaatgtttgcgcgctgttatgagctggccgggataaccaataaggacaggattcatattacgccgggatatggtctgtggacagccggaattgggttccagctgggagcggaacgtttaggcgctatggtaattcctatgggacccggaaacactgataaacagcttcgcatgatgcaggatatgaaatcaacagttctatgcgccacatcgtcttatgcgcttctgcttgcagaggaaatagagaaacgaggaataaaagataatatctgtcttaaaaaaggggttataggttcggagcgctggggagaaaaaatgcgcggccgcatagctgatgagcttggtgttgaattgtatgatatttatggtttgacagaagtttatggacccggtattggtatgagctgtgattctaaatgcggaatgcacatgtgggatgattatatatatttcgaaattgtggatccgaaaaccggtgaggttttgcctgacggtgaggttggggaattagttataacaactttgaaaaaggaaggcgctccgttaatcagataccgtactcatgaccttacaagaattatgaccggggattgtccatgcggttcaaaatatccgagaattgacgttatactgggcagaactgatgatatggtaaaggttaaaggcgtaaatatcttcccaagccagatagaggaatttttgagtacaatcgaagatgcttcaagcgagtatcaggttatgatagaccatcttaacggcaaagatatcttcactctgtttgttgaggttaaaaacggaactgatatgaaggtttttgaaagaaatgtagttaaagagtttaaagaccgtataggaataacgataaagtgtaaaccagtattggttggagatttgccgaggagcgagaaaaagactgctagaatatacgataacagatattaatgtgataagtcctgaacagatataattgttcgggacttattttttataattttgcttgtgcaatatgcacaaaaatatttttgaacattgtgcagttttcggttgaatgttttattaaaatgagttaaaattaaaaagacagtttggaacgtcattatgttcctaaaaagtaataaaattatagtaaatattaaaatacatattttggagggctgaattttgaaacaatacgagacatcaaaaattaaaaatttctgtttgctgggtcacggaaactcaggaaagaccagccttgctgaggcaatgctgtacactgccggaaacattgacagaatgggaaaaacgcaggaaggaacaacggtcatggattttgaccctgaggagataaagcgtaagttttctatttctgcatctctcgcttcgtgcgagtggaatggtactaagtttaatatcttggacacgccgggatattttgattttgtcggagaggttcagcaggctttgcgggtatctgatgccgctattatagttctttcaggaaaatcgggtttgacagtcggagctgaaaaagcctggaagtattgtgaagaatatggtattcctaaaatgttctttataaataaggttgatgacgaacgtgtggattatcaaaaagttttgcagcagcttaaagataagtatggtaagaagattgcccctttccagctgccgcttaaagagggagataaaataaccggatttataaatgttgtcgagcaggaggctagaatatttgacggcaaccgtactataaccggagaaatgccggcaggtattgaaggcgagctggagccgctccgtgaaatgattaaagaagcggtggcagaacagtccgaggagctgatggacaaatatttttcaggtgaagaatttactttgcctgagatgtattccgctcttcgcgagggcgttgctgaaggcgatatagttccggttctttgcggaagcgcttatcataatcttggtataccatctctgcttaatgcaataagcgcatacttcccgtctcctaatgcaaaagaagactttataatagccaagaaaaaagacggcagcgaatcccgtataaaggttgacagcaacgacccgctcagtgcgttagtgtttaagacggttgccgatccgtatgtcggcaaaatgtcatactttaaagtcttttccggagtgatgactcctgatactacggtttataatatgaaccgtgatgtaaacgagaagataggaaagatttttactatgcagggcaagaagcaaattgaggtagagtgccttaatgcaggtgatataggtatggtctcaaaattatccaaaacaaaaacctgcgacacactcagcggacttaatcacccatatcagcttgagggaataaaatttgcaaagccaaatatggagcttgctgttgttgccaaaaacaagggtgatgacgataagatagcccagggattgataaaactgatggacgaggataaaacatttgcttttgaaatcaacaaggagactagacagcagcttttaaaaggtcttggcgaccagcatattgatgttattgtttcaaagctaaagaataaattcggtgttgatatatcatttgagaaaccaaaggttccttaccgcgaaacaatcaggaaaaaagttaaggtagaaggaaagcataagaagcagtcgggcggtcatggtcagtacggtcatgtatggatagagtttgaacctacggattcagaaggcttggtgtttgaagaaaaaatattcggaggcagtgtgcctaagggatatttcccggctgttgaaaagggtttgcaggatgcaatggagcatggtgttttggctggttacccaatggttggtttaaaagcaacgttggttgatggctcttatcatgatgttgactcctctgaaatggcctttaagatggctgcaaacttggcgtataaggccggtatgcctcaggcatctccggtaatattagagcctatcggtcatttaaaagtttatgctcctgatagttataccggtgatatcataggcgatataaataagcgccgcggacaaatgcttggtatggagccggtcggcgatggtataactatgatagagggagaaatccctatggctgaaatgcactcatatgcttccgatttaaggtcaatgacgcaggctcgcggcgactttgagtttgagtttgacagatatcaggaagctccgcagaatgttatagataaaattgtggaggagagcaaataaataacataataaattcaaatgttactgaacggactcagaaaaaattaatattatcaaatggcaccttctatggactattttaccatagaaggtgttttatatgtcatgaataaatgaataaaaaatagataataagtaagatgataagctttctttaacatttttaaataataaattttatgttttaattagtgttttggaaaactaaaattttaaggtcagataattcgcatttcatgctcagatggtggctcacctaacgcgcgaacttcgttcgcaatacatcacaactaagttatttattgacattgtaggctagataaaacaaagcactttgtatcacacccaccattcaggtggggtcacgcctgccgatgttcaccattttacccacttttattatatgtaaattaattatatatgtatttgatttcgaaactaaaatttatattataaattagtttatgttgtcctattaggttggtttgagtgaattttaattagttagttttataattcgcatttcatgctcagatggtggctcacctaacgtgcgaacttcgttcgccttccgatgttcacattatacccacttttattatatataaattagttatatatgaaattatatataaaatgtcaaatttatttttattaaactattcttctagtttatgaattattaataaacacatttattaggtaaaatttaaatcttaatcttattaaatgacacttttataataaaaaatattactaataccaaaaaacaattttgtataaataaacttattaattgaataactcaacagaacacattaactcttcaaacataaaatataaaactatataaataaaattaaaataatcaaactaaacaaaataaactaaactcaatttataatataatttttgattttgaaagtaatttcatatataattaatttcatataataaaagtggttaaatggtgaacatcggtaggcgaacgaagttcgcgcgttaggtgagccaccatctgagcatgaaatgcgaattataaaactaactaatcaaaagctatcaacctgacataaaatcaagaatattaaaccaaaaaatatacataaatattaatttaaattcgaagaataaaaaaatttatttttaatacataatcaaattagccataatttaacttattcacataaaacaaaatatttaagttggatttttaacaactgctatacaactatgcaaagattatagtgcacgaagtgttggcttgacatttacctaattgaatattagaataaaaacactaggattaaatccgtttttataagaaaataacctgcactggataacataaaattcgctgaaaagatagttagtagaaaatttggaattggagatactatagtgaaaaagaaaatgctggcagtaacattaattttatttatagggctattattttcaggaacaatttattattttataaaaaatccagctttatactcactatcaataactttcggtactatcttttatcattttgctatgcgtctggcagtgggttttttaataaataataagtttcacaatcatattgattacacgctaaaatggtttaaggaaagagattttgaacaaaaattttacatatggattcaaataaagaaatggaaaaagtgggttcctgtttttaatccgaaagattacgatttaaaaaataattccatagcggaaattatacaggttacctgtcaggcggaagttgttcacgaaattatcatgatattgagttttgtgcctgttatattttcggtatggttcggagctaatgcagtatttttaattacatcgtgtgccgcatttcttatagacagcatttttgttgttctgcagaggtataaccggccaagattaatgagactgttaaaagataaacagttatcaaataatttataaaaatcattaaattttattttgaataatatcatcttaaatcaacaaaactataattgccgaactatcttttaaaatatgtgatggtaatcatttgaatatttgaaaaattttcgtttggaaaattgatgtttactattaagcaaggggatgatacaatgagcgaagaaagacaaatttataccgaatatcttataatcggcggcaatggatttgtggatggtatacgtgatgacgcacctgaggaagccaaacgtgagtttgaaaagtttctcagaaagcaaaaagaactgaaaaaggatgagcagtaataaaatggccggaaaataggttgataatgaaatgttttggtttgtacaaacggtgcaaatcggtttgattaataccaaattccggccttttacttaattatttttttaattgtgtcaccggctttgctgattgtaaactgcacggctaatccaataaatgctcctgttattattgctgcaattattagatacggcatataccagaaaattcccggggtttgtgtaattaaagcggcaacagcaacttgtgctgtattgtgaataattgctccgatgatacttgcagcccataagtttttaagaggaagatattttaaaagtatcatctctgttaaaaggcataagagaccgccggttaaactataggcaagcatcataatctgaccgctgaaaacacttcccatagtgactcttaaaatcagtataataaatgcgtctgttgggcttaaaaatacaagtgcaaagagtgtaacaatattggcaagaccaagttttatgccgggtatggcaaccaacggcggaatttgagattcaagcacaaatatcgtcagggctattgctgtgagaatgccgatagatgtaattctgcggattgttttatgtccgatttgtttttcaggagactttttcatatcgtcctccactagtatgttattttccggttacagcgtctattacggaatcatcgttttcagtctttattttaacaactaatttatgaggcaggcagataattggataaacgctgtttttaattttaccttgtttgacgcaaagcctgtccgggcagttagaatcggatatagaaatctcatctttttctatatgaacggtattaaaacctccggcgccgtcgtcaatgtttatatcatatggattatctacatcgtttaaatctattgtctcaataactttaccgttttgcacaatttcagctgtttttataggaacgttttgtttgcttgctataaagattataaaaactgatacaatcgctaaaacagcaaaaatgattatgaaaaatttgtttttcatttttatcacctaagattaaaattatttatatcatcttctatactatttctcggattaaaaaaactatttaatctctttcattattagcttaggttatattttttataagagaattttttctcatccctcagctgtttaattcacttgtaaaaatttgcagtttataaaatataaacttcggcagggcggtcttagaccgccgcgagaggtgcgcagccgcggagcggcaaaggaacggcatgtcatattatctatctcgtattgccgatctagtgatccgtataaaagcggacaaatattgctcgctgtaaaacgtttgtgtgctcgctgaaaatttttataaagttaatgatttatataacgcaagcttcggcagggcggtctaagaccgccgcgagaggtgcgcagtcacggatcatgaaaagaacaggatgtcatattatctatctcgtattgccgatcttgtgagccgcataaaagcggacagacattgcttgctgtaaaacgtttgtgtgctcgctgtaaaatgtttataaagttaatgatttatataacgcaaacttcggcagggcggtcttagaccgccgcgagaggtgcgcagtcacagatcatcaaaagaacagatttcatattatctcgtattgccgattttgtgagccgcataaaagcgaattgtcgttgttcactataaaatgtttatagtgttaattatttattatgtcttatgtattctatttgtttttggcgtatttgtcaagtttttgtctgtgctgtcgaaatcttttgttatatttctatttaaattgggtcttgtctaaaattgacgtaaatggtatactgttattcaattagaagtatgtaaagttttattgttgtcaaaaattaagacatacttttgtgtgcctgttattttggagtgaaatttttttatgaattatactatgcttactgatttttatgaaatcacaatggcaaacggatatttggaatgcggtatgggagacaggatcgcatattttgatatgtatttccgtcaggctcccgacggcgccggttttgctataatggccggcgttaagcagctgattgattatctcagcagtcttgaattttcgaaggaagatattgagtttctgcgttctaaaaatatgttttgtgaaaagttcttagactatctttcggattttaaatttgaatgcgatgtctgggccataccggagggaactcctattttcccaaatgaacctatagtgacggtaagggggcctattatacaggcgcagtttgttgagacgatggtattgcttactataaaccatcaaagtttaatagcgacaaagagtaatcgtatagttcgcgcagcgaatggcattcctgtaatggaatttggctcgagacgggcacagggttatgacggcgctatatatggcgctagagctgcgtatattggcggagttgcaggaacagcctgcacaatttcagaccaaatgtttggtgtgcctgctttgggaacaatggctcacagctgggtgcaaagttttgatactgaatacgacgcttttaaggcgtatgcaaaatgttatcctgataactgtactttgcttgtggatacatacaatgttttaaagagcggtattcccaatgcaattcgtgtttttgatgaagttttgaaaccgatggggattaaaaaatgcggtataagaatagacagcggcgatataacttatctttcaaaaaaagctaggaagatgctggacgacgccggctggacagaggcgtctgtatgcgcttcaaattctttggatgaatatattatccgtgatattttgctccagggggctaagattgattcatttggtgttggcgagcggttaattacttcaaagtcggaacctgtgttcggcggtgtttataaacttgtagctgttgaacaccagggcgaaataattccgagaattaagataagcgagaatgttcagaagattactaatccgtattttaagaaggttgtaagactttattccaatgaaaccggaatggctatagccgatgtcttaaccacatacgatgaagtgattgacgacgcgctgccgtatgagatatttgacccgcaaaacacgtggaaaagaaaggttataactgactttaaggctgttgaactgcaagttccgatttttaaaagcggaaagttggtttataagtctcccagtcttgaggaaataaaggcatatgcagaagaggagctttctttgatttgggatgaagttaagcgttttgagaatccgcatacttactatgttgatttgtctcagaagctttgggatatcaggtatgatttgctgaaagcttacaatgcgtaaattggcttaatttcaggaaagctaaaattaatttgagagttattaattattaaattttataaaggaaaggtactttatgatgcagcaaaatccggtagaattttataacttaggaaagcttggaataattggtatgaaagggtgcgaagatatcgctaagaaaatagatatgcaccttaaaaagtttaatgagaacagcatgcctaatattgaaagttttcttattcctacaaattgtcccagatttggaacgggcgaggcgaaagcagttatatcgcattcggttagaacctatgatatttatattatagttgacccgtttaattatggagtgacttacaacatgtatggcgccgagcatccaatgagccctgatgaccattatcaggatttaaagagagttatatctgctcttggcggcaagccgaaacgtatcacagtcattatgcctatgatgtatgagggcagacagcatagaagaattgccagagagtctcttgactgtgctatgatgcttcaggagctttcaaatatgggggttgataatttcctgacgtttgacgcacatgattcgagagtacagaacgctataccgctgaaaagttttgagaatgttcgtcctacttatcagatgataaaagcctgcctcaagtataattcagacataatcctggatgcggaggatactctcatagtatctcctgatgaaggagcaatgggcagatgtatgtattattcttccgtgcttggtatggatttgggtatgttctataagagaagagactattcaaaaattataaatggaaaaaatccaatagtcgcacatgagtttttgggcaaggatataaccgataagaatgttatagttgtagatgatatgattgcttcaggcgagtctatgatcgatgttgccagagaacttaaagccagaaatgccaagagagttatagtattttcatcttttggtctgtttaccgagggtgttgacaaatttaacaaggctcatgaaaatggtctgattgacgctgtgtttacaacaaatcttgtgtatagaagacccgagcttaaagactgtgattggtatcatgaggttgatatgtctaaattcattgctcttattatcaagcaaataaatgaggacaagtctataagtgagcttctgactcctatttgcagaataaataatattcttgagaaatataaaaatttaagaaatcaagattcacagaattaagtttatacttaaataagattatagaaagtgatataagatgactgataagactattaataaagcgggttctgtacgccgcgtcactgagacagagatggcggagcagagggattacatatccagaatacgcgcaatattagcacagagaaatgataaaccaaaagcttttgttgaaacttatggttgtcagcagaattcaagtgattctgagaaaatcaaaggtatgctctcggatatgggatatgaaatcactgatgaaattgacggagcggatttggttctttataacacctgcgccgttagggagaatgctgaacttagagttttcggaaatttgggagctttaaagcataaaaaacgcaggaatccggatatgataataggagtatgcggctgtatgatgcagcaggagcatattgcaaatactataaagacaaaatataaacatgtcgatatggtttttggaactcacgctttatatcgttttccgcagatattagatgaagcattaaaacatacccgggtttttgatattgagaatgaagacggagcaatttttgaagaaataagcgttaaacgtgacgctccgccgcttgctaaagttccgataatgtatggctgcaataatttttgcagttattgcgtggttccttatgtgcgcggccgggaacgcagcagaagcgcagaggatattctcgcggagtgcagaagagtggctgacgagggttataaagaaataatgctgcttggtcaaaacgtcaattcttatggtaacgatttgccgggcggaactagtttcagcgagctgttaaagctggtatgccggacggagggaattgaaagaatacgttttatgactagtcatcccaaagacctttcggatgatttgatagaggttatggcaagcgagccgaagatttgcaatcagctgcaccttccgattcagtcaggttcaaacaaggtgttaaaagaaatgaaccggggatatacgcgtgagcagtatatggaaagactaaaaaaagtttgcagagctattccggatatagttttaacgaccgatattattgttgggtttccaaccgagacaaatgaagattttaatgaaacgctgagcgtactcaaagaagttgaatatgatatgattttttcattcatatattcaaagcgcgtcggcactccggctgcaaaaatgccggatgttctgactgatgaggaaaagcatagaaattttgatgaaatgctgaaagtgcagaatgaaatctcaaaacggaaaaatgagacttatgcaggaaccgttcagaaagttttggttgagggattaagcaagacgaatgataaaactctaacaggcaggacagagggcggcaaggttgtgaatttcagctgttctgataataacgatttaagtttatccgactatgtggggaaaatagttgatgtaagaataacgtcagtgcagacgtggtctttattcggcgaaacagagaattagaaattatatggtaataccttaaaatcaaatgattttaggattatataaaaatcaaaggagaaaaacatgaacaataatgatgcgatatttgaaaaggcaagagagttaggcgagcttataaaggcaagcgacgttagacaaaggtcagaggaagccagcaaggctttgctttctgatgaaactgcaaaagggcttatagattcatataataagctgagagaagataaaatggcggagtttactgaaaagcagcctacacaggaagaagctcaggaagtaaataacgtacttcaagcagagtttgagaaaatggctgaaaatgatataataaaagaatatcttgaagcggcaagaagttacgaaatggttttgggacaaatggacagcattttgaaacactttatagttggcgagcaagaaaaccaatgcggcgagggcggatgtgctacatgcggaggctgccactaaaatatggcttatccggttggtcggccggctggcggcgtgttttgcgtttgtcagccggtattattatttatgactaaacttagagttttatttccaggctgtgacataatttaattagataatatatttgccttttaaatagtgaaagacgatattgacactttttataagtttatattatacattttgattcagtaatatttcggaagggagcggtatttttatatgataattgacagaaataatctgacgccgatgatgcagcagtattttgaggtaaaagaccaatataatgactgtatattgctttataggcttggtgatttttatgagatgttttttgacgacgctgtaattgcgtctaaagtattggaaatcgctctcacaggaagggcgtgcggtcttgaagaacgcgctccgatgtgcggagttccgtttcattctgttgacagctatattgttaagctggtaaatgccggtcacaatgtggcggtatgtgaacaggctgaagacccggccgaagcaaagggattggttaagcgtgaggttgttagagttatcaccccgggaactataatggatacctcggcacttgacgaccaaaagaataattatctgtgttcattttttagaagcgatgatggtataggtctggcttttgtggatattacaacgggtgatgtttatgtcggtgaatattccggcaaaaacatgatgaaccttgtaatgaatgttataacaagatttgttccaacggaattcattatgaatatgcgcgcgtatgaaaatacggatttagtgaaaacattaactgacaagttcagctgttttgtgagaaattattatgactggtctttttctgaggaagagtctaaaaaggctgtcagcgaccagtttaatgccgtgcgcgaaggtgacggcgatatacttgaagagcttggaattaacgagatgagtatggctgtttcagcattgggcggaattttggcgtttctgaaagaaactcagaaggctgaacttaccaatattaaatctgttgaggttctcaacgacgacggcgagatgcagattgatatgtacagtatgagaaatcttgaaataaccgaaactatcagagaacgttctcagagaggcagtctgcttaacgttctcaataagacaaagacgtcaatgggcggaagaatgttcagaaagatgataaccgctcctttgacaaatagaatagcaatacaaaacaggctgatagctgtggacgagttttataaaaatcaattgtttagagaagagattatagatattctgaaaaatatttcggatatagagagaataatcacaaaattggcatataaaactgcgaattgtcaggatttaatttgtttaagaaattcttttaaaaggcttcctgaacttaaaaaatatcttgagcagagttcgagcaaattggtgagggaacagctgaagagatttgatgatttgagcgatttatatgagctgatttataaaacgatagatgatgaagctccggcagttctgaggaatggaaaactcataaaaaaaggagctgaccctgaactggacaaaattagggaaataaagcaaaacggtcaggattggcttacaggtattgttgaagaggagaaaagaaaaagcggaataaaaaatatgaagcttggttttaataaagtttttggttattatattgaagtcagcaagcagagcaacgaaaatattcccgattactttatcagaaagcagactctggttaatgctgagagatacataactcctcaaattaaagagcttgaggaagaaattcttgaagccggtgagaaggtcaatgatttggagtataatattttttgcagaatacgcgaccatgttgctgcgagttacggcaggatacgcgagacttcagacgttatagctctgatagatgttttgtgttctttggctgttgttgcggaatcaaacggttatgttatgccgactgtaaataattccgataaaataattataaaagacggacgtcatccggttgtggaatcaataagcaaggcgaacgtgtttattccaaacgacacaagtatggataatgagagcaatcagatatctataattacaggcccgaatatggctggtaagtctacatatatgcgccaggtggcagttatagttttaatggcgcaaatgggaagttttgttccggcttcatcagcagaaataggtattgtggatagaatatttacgagggtaggagcgagcgatgacctgagttcgggagaaagcacgtttatggttgaaatgaaagaggttgcttatatactcaataacgccacaaaaagaagtcttataatccttgatgaaataggccgcggaacaagcacatatgatggtctgagcattgcctgggctgttgttgaacatatagccgacgcgaaaaagtgcggggctaaaacattgtttgccactcattatcatgaactgaccgagcttgaagacaaaataaacaatgttaaaaattattgtatagctgttaagaaaaagggagacgacataacgtttctcagaaaaatcatccgcggcggagcggatgagagctacggcgttgaagtagcggctcttgccggggtaaagaaatcggtaatcatccgcgcaaaagaaattgccggtatattagagagcagggaacagaaaactgtcaatacggccgatattaaaaccggaaccaagaaagaaaagaaaactccgtttaaggatgaacagatagacttttttgcccaggctgataatcctgtaataactcagcttaaagagttggatcttaatacaataacgcctgtagaggctttgactaaactttttgacctccaggcaaaagctaaaaatatgtgatttaaagccgctgtgcgctgtgtgcggcggcttttggtatacgctgtaaaaagttgacatcattaaattttgatgatatacttcaaaataattagagttttgggaagtgtttatatggaagaaaaaatacatgttttatctcctgatgtggcggataagattgcggcaggagaggtggcggagagacccagctcggttgttaaagagctggttgaaaatgctgttgacgcaggagcggataaaataacagttgaaataaaaaacggcggtataaaattaataagggttgcagataacggtaagggaattccgtcagaacaggttcctacagccttcctgcgccatgctacaagcaaattaaacactgccgatgacttatataatatctctacaatgggatttaggggcgaagcgctttcgagtatctgcgctgttgccaaagttgagattatcactaaaactgccgaagccgaaacaggggttcattatattgttgaccacggtatttgcggagaagctgatgaaatcgcttgtgcggacggaactattatgatagtcgaagatttgtttgctaatgttcctgccagaatgaagtttttgaaaaaagacagtacagaggcaggatatatatctgaccttatgacgcggctggctttgtcaaaaccgaatatttcatttgattatatatgtgacgggaagcctgtgtttaagacgtcgggagacggggatttgactaatgttattttaaaggtatacgggcttaagtttgcaaaggctgttatgccggttgattattttgaagacggagttaaaatatcaggggttatcggtaaaccggaactgtcctttggtaatcgtaccaaacagacgatttttgttaatggcagatatataaaaaatcatgtgatagccaaagttgcggaagaagcgttcagaaacgctgtaatgataggaaagtttccgttttttgtattaaatatagaggttccgccggaaatggtagatgtcaatgtgcacccggctaaaactgaggtcaagtttgcaaatgaaaaacagctttacgatatagtgtatcatgcggttaaaaactcaatgtatggtattaaggttagtgaagtaaaggctgaccagagcgctaaaactatacaaacaaataaaactttttcaaaaagcaaagaagcgcctaagctgaaagattcagcggtcttaaatgaaaaggtaatacatgattatcttgagtataccaaacctgttataaataaatctgaaattttagataatactcctttagaaaaaacgcctgatgaaaatatggatgaaaatgctgctgaaagttccgataatggcggagttttagacaaagttgtggatataatagataattttttggaacctgacaaagaagaagtatctgataatatctcaaatgatgtaaatgaagcaactccacaaactaaaaaagagtttaagcaaaccgagttcggagatgttgataagatatttgataattcagacagtatttttaaagattataaaataataggacaagtttttgacacttatgttttgctgtcagcgccggacaggttttatatgatagaccagcatgccgctcatgagagagatggttttgaaaagctgaaaaaagcgtattttaataatgaacgattatctcaggttttaatgtcgcctattgttataaatttaagccatgttgagtatgacgcggttatgtccaatcttgatgagtttgaacggtttggttttgatgtcggcgagtttggctttaatacggttgtagtaaatgagacgcctataatagccggcgacgagcagataaaggatttgtttttggaaataacagacgcgcttgtggataatattaaacatccgatagcggattttgaagaaaaagcgcttgatatgatttcatgcaaaaaagctattaagggaaatgataagctgtcgctgccggaaatgactgaagtcattaaaatagttgaaaatttgtattctaaaggtataaaaacctgtcctcacggaagaccaatcatggttgagtttacaaaaaaagagatagagaagatgtttaagcgtatcgtataaaatgatacaaggattatatgaggtggcgtagatgaataaacctaaaatattgtgcgttgtaggccctaccgcttcaggaaagacagactatgctgttgagcttgctttaaaatgtggtggagaagtggtttcgtgtgattctatgcagatatataagcacatggatattggaaccgcaaagccgactgctgatgagatgaaaggcgtcaagcatcacatgatagatataatcgagccaaacgagagttttagtgtagcgcgtttttctgagatggcaagggaatgtatagacgatatacttttaagaggaaagatgcctgttttatgcggcggcacaggactatattttgacagcacaataaataatataaattttatacaaatggacacggatgaagagtatagaaaagatttggaatcggctgcaaaggaatttggaaatgaatacgtatataaaattttaaaaagggttgacgaagaatctgccgaatccattcatcctaataatttaaaacgtgtgattagagcgttggagatatataagactaccgggaagaaaaaatcggaactggataaggaacagctgtcagaaccattgtatgagcctgaaatcacagggcttatgcgtgacagggaagtcctctatgacagaataaataaacgcgttgatataatgatggaaaagggacttgtagatgaggtttcagaccttattaaaattggtatagatacagaagctacatctatgcaggctattggatataaggagataatagaatatttggacggaaagacaagtctcagcgacgctgttgataaaataaaaagagaaagccgaagatatgccaaacgtcagctgacatggtttaaacggaatgaaaaaattcattggataaatatttaaatataaaattaatgcggtgtatgaactctaagtttgtatgccgcattttattttttggaataattttacaggcagcgacatttttctgttacaattaagttacatttgttctacaactcgtggattgcggtttacatactttttgacagagattataatagttattatgtagaatggatgtgtatgtttagcgctataagagatggactgttgattggaggtagtcttgtggcaaacactactgacaattcaaatataagattacagaaaagacgcaaaagagatataaaaaagaggctttttttaattcccaaattgatttttgtgtttttggtggtctttttgcttatcagtatatttttcagatcaggtaatagtgtaagcacttatactgctctgaatggtaaaattgaagaatatgtcctggctgacggttacattttccgtgaccaggagctcatatcatcaccgtcagacggttattttgagtgcctggcagatgagggagaaagggttaatgatggaagcacaattgccgccgtgtataaaagtgctgtagaccctgctgttactgaagaaatatcacagcttaaaacgaaaattgccgatttggaaaaggacgaggccgctgcggatatctattctgcgaacgctgtgaaaatagagcttaatatttctgaggaagctcagaaacttacgcaggttagggataataataatttctctgatattgtgagtataaaacacagcgttgatgattatattgcaaacaaacaatatgcggttgaaggcggcaaaacaaaagaggacaggctttcggaaatgaaagcaagacttgatgaattggaatcaagcatagacggggaacgcgagtatatatatgctccgagagccggaatattttcgtcaaagattgacggatatgaagacgttttaggcattgagatgatgggagacgccacgccgagatatataaacggcatttctaaaaataatgtgacggttggaaccacagtcacaaacggcgaaaacgtctgtaagataattgataattacgagtggtattttgtcggtttaatttccgaaaaggaagctgaaaattttaaggttgatcaatctatcagcataaaattctatgatttatccgatagtatggtatccggaaccgttaaggctatctctaagcctgaggacggcaaggtcgctataaccgtctattccacaagatatattgattcaatttatacgaccagcaaagtgtccgcagagctgctcactgagagttcggaagggataaaagttccgtcgtcttctttgagagttatagacggacagcagggagtttatgtcgttcgtttgggagtggccagatttgttccggtcgaacttctttacaataataaagaatgggctataataaaacctgttattagcacaagttatgaggaacatcttgaagtttatgatgagataatcattaatactaaaggtattgaggatggtaaggttgtgagacaatgagtgaagttcctgatatcagaaaaaattatatagacgttttgaactcggttaataaaattactgaggaatgcggcagaaagcagggcagcgttcgtctgattgctgtctctaagacaaagccggcggaatatataaaagaggctgtggaagccggagccgcagattttggtgagaacaagccccaggagcttgccgctaaatatgagcaggtgagcggagtgagatggcaccaaatagggcatcttcagaagaacaaggttcgccatataataggcaagaccgctttgatacattctttagacagtattgagcttgcaaaagaaattgataagcgcgctaaggctgttggaatagttcaggacgttttgattcaagtaaatatttcaggcgaggaaagcaaattcgggataaaacccgagaatttgccggagatgctggaaagtttaaaagagttcagcaatgtgaatacgacagggcttatgacaatatccgttaaaggctattctcaggatgaaaacagaaagttgttctcaaaactcaaagagttgggcagcaaatatggtcttagagagttttcaatgggtatgagccatgattataaagaagccatagagagcggggcaacaatggtaagagttggaacctcaatttttggcgaacgggattattccctaaaataatatgtgaaatatgaaatctattatatacaaaatactgataaacttaggaggaagaaaaagatgggaagctttatggataaagtgtacagcatgatgggtgttgacgttggagatacatatgaagaggaatactatgacgattatgcacagggcggatacgatgaaccggatccaaacgagagttatatgcccagcagaagaaattcaggaagaaacgcaggcagagtaaatagatacgaggacaaccctcagatgaaacttgttatcatgcagcctgtaagctttgaagaggcaagggatatagcaaaccatttaaaagagagaaagccgatagtaataaatcttgaagctgtagataatcctacatccagaagaatagttgactttttgagcggttctgtttatgctttggacggaagtattaaaaaagtatcaaacggtatttttctgattgctccatgcaacgtcggcgttatggatgaggaagaagcatacgaagaacgctggagctaaaagtggatacagatgataaactgatagtctctaaggcttttgataccgttagtatcgctgagagacagtatatttgcaaaactatggggtttttaaatccccatcaagcggctgtagtccgcagggaaatttcgagaaaaataccgtcggatattggcgttgaattttatggcggatataaagacgcggagagatgtttgtttatatgctttccggaatatttggaaccggactatgacagtattatctcagtgctggagataacagcccgtgacattgataaaatgtctcatcgtgactatcttggcagtcttatgggtcttggaattaagcgtgagaatattggtgatattcttcctcttgaagacaggtgttatatttttaccaagtctgatatatcaggatatataattgacaaccttttaaagataggccgccatggagtgaaaatttgcaaaagaagtctttctgagataacggtgcctgagaaaaagaccgagcaggtcagaaccactgtttccagtctaaggctggattgtatattatcaggagcgcttaatatgtcgagaggcagagctgcggaactaataagagcggagaaggttcaggtcaattttgaaactgcggacagtatatcaaaaatattaagtcctgacgacttagtttcggtcagaaattttggcaggtttaaagtggccgaaatagggggtctcacaagaaaagggagatatggtatcataattgagaagtttatttagtatatatagtagagtatagatttcgtgagaattgttaaacggtcaattgattaaagttagaagattgggaggatggaatatgcttacacctgctgatatcgaaaataaagagtttaaaaaagagatgcgcggttataacataaccgaggtaaatattttcctgaaagaagttgcaatgagctatgaaaagatatatcaggaaaatctttcggctatggataggataggtatgctgtcagacgctgtaaaacaatacaagtcgatggaggataccctcaaaaacgcattgtctgttgctaagggcgcaggggacgagataaagaacagcgctcatgggcaggcgcaaatgattattaaggacgcggaaaacaaagcggttaaaataatcaatgaggctgcaaaggaagtcgctgatataaattataagtatgaggaaatgaagagaagcgttgaggtgtttaaagcaaaagtagtgtctcttttaaattctcagcttgagattattaaggaatattcaaatataaatgccgacactgacagagaaataaggtcaagcgccgaagcggttgaagtgattaaaagcgaaataaacgatatccctgatttgccgggggatttaagtagagacgctgaatcaaatctgatgtctcagctcgaaaaagttactcaggaactccctaggataaaactgaatgaagacggcgaatatgttcctgcagatgagaattaataaataaaattttaatatttaaggttagggctgttctgcgtaatgcgggacagtccttgacatagaatgctgaaatttggtttgaaaggctgatgttatgataatatattttataataggtatactggttttaattcttgacatagttactaaacactgggcttcagcggttctgatgggaacatcggggataccggttatagacggattttttcatttgacttatgttgaaaattccggagtggcttttggaatgctccaggataaaagaataatttttgtcacaatgtcgctgttgatactttttgtattggctatgtatttttataaggcaaagaagagggatgtttggcttaaactgggaacggcgcttatctttgccggttctatcggcaatttgattgagcgtgtgacaaatgggttcgtagttgattttttggacttcagagtaataaattttccggtgtttaacattgctgatatggcggtgtgtatcggcgcggcggctttggtgatacactttttgacttctgatacagagagtaaagataaactaaatgagaagaaagaataaaatacggtgagaatatggagaacgatgagataaagttgttgaaggtatccgagggagaggagggaaggctcgataaatatctttccgataagcttgaggatatgactcgctcatatttgaaaaagcttatttctgatgataaagcggtattggtaaacggcaatccggcaaaaccgaactataagcttaaacccggggatataatagaactggcagtgccggaacctatagagttggaaattaaggctgaaaatattcctcttgatatagtatacgaagataatgatatgctggtagttaataagccgcagggtatggtagttcatccggcggccggaaactataccggaactcttgttaatgcgcttctttatcactgcggagattcactttcgggaataaatggtgaaaaacgtcctggaatagtgcataggattgataaagatacaagcggactgctgcttgttgccaaaaatgataacgcgcatcaaaaactgtcgtcacagataaaagagcacagtcttacaagagcgtataaagcgctggtgcatggaaatataaaacaggattccggtcgcatagacgcgcctatcggccggcatcccagcgatagaaaaaagatgactataacggacaaaaattcaagggaagcagtaactaatttcagggtgcttgaacgttacggccgctatacttttgtcgagtgtattttggaaactggcaggacgcatcagataagggttcatatgtctaagaacgggcatcctattgttggagataagacttatggggtaaaaaaggaagaatttaatttggcgggacagttgctccatgcgtataaggttgggtttatacacccggtatcaggagaatatatggagtttgtgtcagaattgccggattactatatgaacgtgcttgatagattgagaaattttatttaaaagctgtaaaaatttgtagacaaagtgagtttgttaggatataatagtagcaagggtgtctgggctcagagcgtagatggtcttgctattttgtctgtaaggtgggattaatatgagaacagtaattcttgaaaaagaagagattgacaaaaaacttaaaagaatggccagccaaattgttgaacgaaacgtaggtgaaaaaagcatctgtctgattggtatagtcaggcgaggtgttaacgttgccgaaagtttggcagaacacatcatagcaagcggtgaaatgaacgttgaagttggaagccttgatataactctatatggggcggaccataatcttatagccaaataccctgtattaaacgatacggatatacggttttctatagataataaaattgtagttttggtagatgatattttatataccggaaagacaattcatacggctattgacgctcttttggatattggctctccatcagaagttcagctagcctgctttgtggataggggaagaagaactttccctataagcgcggattatgttggagtgagagttccgagttcaggtcttgagcgtgtggttctgcatgttgaggaagtagacggcgaaagctgcgtaatgatagagaagcgtgatagttcagcagcgtttaaaatataaaagaataggcaaagatgaaatagagggttagtccctttatgtaatatacagcggaccaaaattccgcgtaaatctaatattataaatagaggaattacgatgattgataacttattaggtttaaaagaaacatcaagagatgatattacagcaatattggatgatgctgtgaaattaaaaaacgacgttttggagcaggacattaaaaagtcaaatatcctttctggaaagagtataataactctgttttttgaaaacagcaccagaacaagggtctcttttgagttagcttctaaatatcttggagctactgccgcaaatatttcagcgggaggaagcagtattgccaagggcgaaactttgatagatactgcaaaaactttggaggccatgggtactgatgtcataattataagacacagcatgtcaggttcacctcatcttatttccaagtacataggctctaaggttattaatgctggtgacggaatgaatgagcacccaacgcaggcactgcttgatattatgactatcagagagaagaagggaaaagttaaagggctcaaggttgctatagtcggagacgttaaacacagccgcgttgccaggagtaatatttacggtttgaataagctgggagccgaagttgttttagccggaccgtctactttgcttccttccaatttggaagatatgggcgttaaggtatacaccgatgttgaaaaagccgttgagggcgctgatgttgtaatgggtctgcgtatccagcttgaaaggcagaagaagggactgtttccatcaatcagagaatacaataagtattttggaatagatgagaggcggctctcattggcaaaacctgacgctatattgatgcatccgggccctgtgaaccgtggcgttgaactgaacccgcaggttgctgacggaagtcagagcgttattaatcagcaggtcaccaatggtgtttgtgttcgtatggctgttttaaatatgctggcaaacggtaaaagatatgataatttagtataaataatcttatattaggttgataaggcaaagtgttataattgtacaagtaaggggaaatgcagattgaaatcaaattggattttaataaaaaacggtcatgttgttgacccggcaaataatatagatgaaaagcttgatattttaatcaaggacggaataatttcggaagtaggcaaggatatacaaacaaatccttttgtgacagtgattgacgcagaaggtaagattgttgctccggggcttatagaccttcatgttcatttcagagaaccgggatatgagtataaagaggatattgaaagcggaagcgccgctgccgcaagaggcggagttacgactgttgtgtgtatgccgaatacgaacccaactattgataatccggctcttgttaaatatgtgaccgataggggaaaagaggtcggactgacgcatgttctgactaccggatgtataaccaaaggacagaaaagcgaagagcttgcggaaattggagagcttaaaaacgccggagctgttgctgtttcggatgacggcagacctgtgctttctccatcgcttatgagaaaagcgctggagtataccaaaatgtttgatattcctataatgtctcacagtgaagatttggatttggttgacggcggaagtatgaatgaaggatacatgtcaacttatttagggcttagaggaataccgaaatgcgctgaaagcgttgctatttccagagatgtgctgatagcggaggacgtgggaggaagactgcatgtctgccatgtgagcacccgcaattctatagacgctatacgccaggctaaaaaacgcggtgcaaatataacttgtgaaactgctccgcactatttttctttgactgataaagcggttgacggttttaatacaaatgctaagatgaatcctccgctgagagaacaggacgatgtcgacgcggtaatcgagggcttgattgacggcacaatagacgcgatcgcgactgaccatgcgccgcatgataaggatgaaaaggaaatagaattcgcattggcaatgaacggcattgtcggtcttgaaacttctttggggctgggtgttacaaaccttgtcaggactggaaaattgactatggctcagctgattgaaaagatgtcggtcaacccggcaaaaattataaatatcgacaagggctctttatctgttggaaaagcggctgatattgtggtttttgacgctgataatgaatatactgttgatataaatgaatttgcttcaaaaaataataattgtccttatgatggaatgaaactgtatggacgggttgattttaccatattggatggaaatgttgtgtttgaaagatagagaggagtttttaatatgatagactcattaatcgaaaagatacaggagaagaaaaatccgactgttgccggccttgacccaaaactggattatcttcctgaagaaatggtaaagaaagcgtttgatgaatatggagaaacttttaaaggagccgctgaggcaatttttgagtttaacaagacgctgattgacgctttatatgatatagttccggcagtgaaacctcaatcggcttattatgaaatgtatggtatagacggtattgagtgcttgaaaaaaactattaattacgctaaagaaaagggcttgtatgttatcttggacgcaaagcgcggagatattggcgcaaccagtgaagcatacgcaaaagcttatttgggaaaaaccgatataggcgaaaaacaggagcctgcttttgatgctgacagtttaacagttaacccatatttaggaacagacggcgttcagccgtttgtggaacagtgtttgaaatttggaaagagtatttttgcacttgtaaaaacgtccaataagtcttccggtgagattcaggacttaatcagcggcggcaagccgatatatgaacatatggctgagctcgttaaaggctggggtatggataatttcggaaagtatggttatacgcaggttggagctgttgttggagctacttatcctgaacaggcagaagttttgagaagggttatgcctcatacttatttcttggttccgggatacggagctcagggcggtaaggcggaagatgttgcaaagagctttaacggagacggacttggggcaatagtaaacgcttcacgttctataatgtgcgcatataagaaaaacggcggcgaggtcggtcaggcggcgagagatgaagctataagaatgcgtgatgatataatgtcagccgttggcgctgtttgattaactatagaggattggagaggttaagatgctgtgtgaacttgtagcaaaaggtcagataaggcgcggcctttttgactatattgtagactgtccggatatggcgatgaaggcaaagcccgggcagtttctccatgttttatgcggtggggatacatatttaagacgtcctataagtatctgtgatgtgattgaaaacagacttgtaagatttatatttgaagttcgtggaaagggcacaaaagaactggcaagagctaaagaaggagacagactggatattttaggtcctttgggaaatagttttgatatatctttttcagatgaaactgttgaaagcagttcgtctgttcccgagggagatatagttttaatcggaggaggaattggtatatttcctcttttatatctttcaaaaagtcttcccaaaaaacctaaaatattattgggattcagagatgcagaaagtatggcgctagtcagagagttttctaaaagctgtgaggatgtttttatagcaagcgacgatggcagcgtggggcataagggctttgtaactgacttgcttaaaaactctatagaatcgggaaataaaatagaaagaatatatacttgcggcccaaaacctatgatgaagattgtggcggaaaccgcagtcagcaatggaataaactgtcaggtatctatggaagagagaatgggctgcggagttggggcctgtgttacttgcacatgtactttaaaagatggttcgagaaaaagagtttgcaaagacggacctatatttaacgcatcggaggtggatttcgatggctgatttgagtgttaatatagcaggagtagagtggaaaaacccggttacaacagggtcgggcacttttggattcggaagagaatatgctgaatattttgacctttcgaatattggcgcgatttgtcttaaagctatatccaccaaaccccggctcggcaataagtcgccgagaatcgccgaagtaaccaaaggtatgctgaacagtgtggggcttcaaaatccaggagctgaatattttcttgaaaatgaactgccttggctaagacaatttgatacaaaactaatagctaatctgtgcggttcaactattgaagattatgtagaagtcgcagaaattttaggtaataagcttgatatgtttgaacttaatatttcatgtccgaacgttaaagagggcggaatggcctttggaactgacgcgaagatgatagaagaaattacatcaaaagttaaagctgtatcgaaagtgccgcttatagtaaaattgtcacctaatgttactgatattgccgagatggcaaaagctgccgaagcaggcggcgctgacgcaatttcattgattaatacattgctgggtatgaaaattgatataaataccaggagacctgtcctgaataataatatgggcggaatgtccggacctgcggttatgcctgttgcggtcagaatggtgtatcaggtgcgccgggctgtaaagcttccaataatcggtatgggcggaatcactacaggagaggacgctgtggaatttttgcttgcaggggctgacgcggtttcagtaggaacagccggtattgttgacccatatgcctggataaaagtgagaaatggaataaatgactatcttgataaaaacggatatgaatctgtaaatgatatagtaggaaagcttgaaatgaataattaataattggaggtttgacaaatgacaaatgaacaaataattgatatgcttaaagaggcggaagttttgctggaaggacattttcttttaacatcgggaaggcacagcgataaatatatgcagtgcgctaagattttccaatatgcaaagtatagcgaacctctctgtgccgagcttgcaaaacaatataaagaagataatgttgaattggttatagggccggcaataggcgcaattcaaatggcgtatgaagttggaaaacagcttggtgttaaaaacatatttgctgaacgtgaggatggaaaaatgacgctgagacgcggatttacaatcgaaaaaggtcagcgtgttctaatcgtagaggatgttgttacaaccggaggaagtgttcgagaggttatggagcttgtcaatgaagccggaggaaagatagtgggaataggttcaattgttgacagaaccggcggtaaaattgattttggagttccttataagagtgcattttctatggatataacatcttatgagcctgatgactgtccgatttgtaagtctggaacaccattggttaaaccgggcagcagaaagataaaataatgaaatcgaataatacacatgacggtcacagaatcagaatgcgtgaaaagcttgagagtggaaatttagctgatttacctgaacatgagcagcttgaaattcttttattttcagtgataccgagaggaaatacaaatgaaatagctcatgagcttctgaaaaaattcggttcaatttatggtgtattgtcagcagatatcagcagtttgctggaggttgacggcataggagcgcgcgttgcggattttctgcataatcttccggctgttttaggagttgttatgcgttctaaaatctcgtatgaaacagataataaatttttactgaatgatattaacactttaaaagattatttgttttctctattttcggatactgtttcagagcgggcgtatatattatttttaaataagggttttcggcttatcaagtttgagaagataagcgacggctctttagagcaggtatacatagatatatcaaaggctgtacggcgcgccatattaaacaatgccgcatatgtggtgctgacgcataatcatcccagcggctcggttatgccaagcgacgctgatatttcatcaacccgagagcttgacgaggccttgaacactgtaggaataggtcttttagaccatataataatcggcggtgacagctattatagtttccgtgaaagcagacattattaataaaagaatcctttaacccgatgaatttgtcgggttagaggattctttattttaaaatataaaaccaaatttcttataaaaaacggtgaaagtgcttgtataatatcatataatgtcgtataattactataaagatatgtgaatttaaagaacatattaaaaagaacatatttgttgggaggaattatagtatgcaagatatgcagaaaatatataaactaaaaatagataatatattttcaaatagtaatgatattatacatgaaatggattgccgatttataaaacagttggcatatggtaaaaaaatatgaattcaaaaagttcacatcatggtcatagagatagaatgcgggagaaattggagcatggaagtttggcagattttcctgaacatgagcagctggaagttctattattctctgtgataccaagaggaaatacaaatgaaatagctcatgaacttttaagaagatttggttctatatatggagttttatccgccaacaccaatagccttatccaggtggaaggggtaggtgaacgagttgcagactttttacataatttacctgctgttttgggtgtggtaatgcgttctaaggttctctatgaaacggataacaggtttgtgcttaaagatacggacagattaaaggaatatttgttttcattatatgcggacactatagctgaacgcgcttatatcttatttttgaataaaggatttcgattaataaaatatgaattgatatgtgagggttcaatagatgaggtttatttagatattaaaaaggcggttcgcagagctttaatgaaccatgcggcatatgtagtgcttacacataatcatccaagcggtcttgtttttccaagcgattcagatattatatctaccagagaactgagcgaagctttaaatacagttaaaattgggttttgggatcatgtaatagttggaggtaatcaatactacagttttagggagagcaggaattactaagagaaaatttgggaggaagacatgccaaaatcagcaaatcaaaagttaagattattatttgaaagagaaattttactaagagaaacggatgaggagaatcctattactacaaaacagcttatatcacgtttggaggattgcggcgttcaggctgaaagaaaaactatttatagtgatattgaggctctttccctatatggtatggatataattaaggttagcggaaaaaatggcggatattatgtaggtgagcgagactttgaacttcctgaattgaaactgctggttgacgctgtccaaacgtccaaatttataaccaaaaagaaatctgctgagcttataggaaaaattgaaagattaaccagcaagtatcaagctcaggtattgcatcgtcaggtatatgtatctgcccgtattaaaaatatgaacgagagtatatattataatgtcgacaaaatatatcagggtatagatgaaaacaaacagatagaatttttctatatggaatataatcttgataaaaagcgtgttcctagaagaaatggaaaacgatataaaataagtccttatgctttgacatggaacgatgataattattaccttataggctatgacggacagtccgatacaataaagcattatagagttgataaaatggagaatatagttgttctcaaagaaaatcgcgaaggagaaacaaatattgatataggagaatattctaaaaaggtattttcaatgtttggcggtagtgaggagtccgttactcttaattttgacaataggtttattggagttgtaattgacaggtttggtaccgatgttccggtaataaagactgacagtgaacattttgagaccagtgtaacggttaagataagtcctcagttttttggctggttggcgtcattagggagaggcgttaaaattatctcgcctatcagtgtgaaagatagatataaagagcatatacagtcgattttagaatgagaaagataatttaaacttttttaatagttttatattttatttggttgagataattggatagtaatcatattattaaactgtaattgataataaagttctattgaatttatataagaaatttatgtgaataaaaatataagtgctgcaaaatatataagttaaaacacagctgctatttattatataagcagctgtgttttaattggtatgcccgacgggattcgaacccgtgaccttcagagtcggagtctgacactctatccagctgagctacggacacataactttttttattataacataatttagctttatattcaataccttattctaacatttcataattcgttttgtaggtttgtcaatgatgtgttacaaaaaagattaaaagagttcgccgaaattgataaaagagttgatgtagtcaatgggagatttccaattaagcggacgcatcgggaatttattatagttacggttatgcacctttaattgctttgcaaaatcatcaaacgagtagaatttatgtgttgcataaaaatactcgttatccttacggtgtgaacgctagcttcaccgacaatgcaagcttcaggaacaaacttaacgtctatctgtactctctgaccgggatagagcatttgcttgtaaggctttggtatgtatttgggattgggtggtttaacaggcatttgtccctgtttgctgtgtatgcggtaaagacctgtaacagaacgagtatagcctctttgacgaagcttaacccaaaacacaacaagtccggcattggggctacggcggcgcatatcagtaatcaattttaactcatcagcggtatgctgattgggatgatggtggtggggtttatgtgatttatcggctaaggaggcgagcgtaccgtcgtagcgttttcgccagcgatagacatactgacgatttaccttatagcgaatggcagcctttgtcacgccgtgtttaaaagaatattcaattaatacttgtctaaatctcatagtttgtgttatagtgttcatatacggaaggctcctttgtgtatgtgatattgtggtgatataactataacacaatttatgagttttccgtattctttttttctctttgtaacacatctattgtaatcctacaatataaatgagaaaaatataaaaaagatattgacaaattattaagaatagtataaaataaaatagttgttgatttcaacgacgtttattatttgcggctatggcggaattggcagacgcgcatggttcaggtccatgtgaaagcaatttcatggaggttcaagtcctcttagccgcaccaaaatttgaaaatccgaaccttataccaattggtaataagttcggatttttgctttattttagttaattaaattttaatattattatataacttatggacaatttgtgacatcttttgtcaagaggtctttaacattatttgttttgatatagattattttttagctttgcgttttaatctgccaattaaaataatatcagcacgagaaaatcaatatacgtatatatttgtgtattgattagggagagtttacatatttaagattgcaaatttgcaaatttgctattcgtttgatataatataatcagctaataggggcctatatgtccttgttagaaatatcaggcgatcttattgtgcattggcagacaaacagaaagcggatatagtaattggcaggactgatagggacgcagcataacaattaagtcaaattgaaaacggaaaaatgtaaaacaccagcttcgatatccggataaggccggaaaaagggtttaggacataaacaaattatatattggggctaaccattattggccgccttaaaagttttgatatatataaatttggtttgtctgaaaacgtggttcaaaatttatgacatggacggttgatgtacatatcttgaaccgtttgccggaatacaaaagttttccacagcagtatagctgataagtgcttagttcaagtacatgacggatctgagaaatatagtgcgaaacgaggtcatggaactgacattgcctgcttcttgttcctgtgaaagacagtatagtgtaaagctgctctgaaattgttttttatgtaatatataatacaccaaatttgtgattttgtatggtcataagttttgggcagtaattttcataaagaactgtaactttattttggtatatttgaaaaacagctgtggagcaacattacggccaattgcttaaaaggaggattctaaatgaaccaatttattgaaacgttgacaagtaaagacaaatgtttggagttacccgaagaatatgattatttcggaaaacttatcgaaagctggaaactcaattataccgaccgaaacatatcatgctcagttaaaggagaatggcatttttcatgggttcttgagggtatggcaatacaagatgttattgttttaccctcgcgcgatacaaaaactgaaattccgcatccactcaccgaatacggcacaacgcttcgtgtttacaatccaaatacacatgcttgggatattgcctattgttacacaggagaaattatacggctagaggcaagaaaacaagacgatatgatagtgctcacaaacattgatgataataagaaaaaatgggtttttgtcaagattgaggagaatacttttcattggcaaaatattaccataaaagaagatggcgaatggcatataaatgcggatatatatgctgagcgaataaagtaaatacaatataaaagaaacttttagacataaagataaagaatatcagaaaaaacatagtctgatacaaaattgtatcagactttttgtattatttcttatataccgattaatttgactgtattacagagatataaaggtattaaacataaaatctgtcctaagtaataattacatattaaactttcacgggttttagatttatgaatttcgatttgcaaattctcaggttagagaaacacgtgtttttttcagcttaaatatgactttagactttagattttatattttcagagacaatattgacgaatgcagtatgttttgatgctgctgcgcatgacaactattttgtgttgggaaataaattcatatttagcagaaaaataagatttagatgatattaccatcgtttattgtaaaaattcggctgctgtttttttgcggatttcagcgaatgagtaaccataataattgtttgtacgatttctttattaatattattcagtaattcaattcttggctgctttattgttggattgctgtctgcatagataatatattttcaaagtcctgtgtgaaagttatagcccaatcaccgcgtatatttttaccatttggagctgacattgtaataagtaatgcaaaaatacagaatacggcaatgagagttccaaaaagtgaaagataaatattaaatatatatgaaaaatactgtggtaaccggattctttcatataatcagcccttttcttttatttatacctcaagccttttattgttacaagctgtttcggactttacggaatattctctattttttctcatgtatgacgtatatacaccatgattgtattgtcacaaataatactgtattctccccatacttgttcatatagccgttccttgctaataattttatcggcgttttccattaagtaggatagtaacaataattctcggccggtcaagtcaactttttttcctgatttataaatacggctgctttctttatccaatgaaagacagtcaacagttaactgtttgaggttatcaagcgtatttactgattgatattgttgacggcgaatttgtgacttaatgaggtaaacgatttcacgcggactaaaaggtttagtgatataatcgtctccgctgcagaagagcctggtgttttgtttatatcatcatttcttgctgataggaacagaattgaacaaaaagaaaattcacgtattttttatacctcaataccgtctatatccgtcagcataacgtctaagacaataacatcgggctgatattctttacatattctgattgcgtctgtgtctgtatatgttttttatatttttgaaattgttttaatacagagctttttcaaataaacctacaatatacttttcgtcatctattaataatattttattattcattagttataatgtcattttttttcgttaagaggcctattattagaaaacttttctgctttctttggtattagtgcatgttgcaagtttacaaaacgacagatatgcgtttgctatttatagtattttatgttcttgttgttttgctgatttaaggtaatatgaaacattaatagttttttagtttcgattatatgcgggcgcataaataaagtcaacagaaaatataaaaattatttatttagctggaatgtgattgacggttacaaagaaatgtggtataataataaaaatagctattgattatggtttttgatgtaaagttgaatttaaaataatagcttgattttcattattgcagtgtttttttatatatatagtttttgaggtagttactgtatatcagcagtcaatgctttgattttgctatattatttaagttcagtaatagcagttaaaatagcattttatttaatgtgcgggtgtagttcagtggcagaacaccagcttcccaagctggatatgagggttcgattcccttcacccgctccaaaaaagcggcaagcatttaatgcttgccgctttttattatgaaataaaacagagctatttgccattttaaatctaagagattattatttttctcatacaaaccaaagtttttgtcatcttttacgactaatgctggttttgacaggctgttttcagccgagatactcatcataactttatctttaaatttaaatatacagtatcgcaggatcccgctaaatgccttgtatataaaagtatctgcaatatattgtttcacacttttctaatattaaataataacttttattaaataataacttttcgagttctttttcgacaaaggtgtggtcacgaaaatctaattttttcccgttaaatgtatattttcaatatgttcaacaacaaattccacttgttactatctcgctattattacattgcccaaatactttatagtaaacgcaccgtcaaaattaaacagcttaattattttcctcaattgcttctccgaaaagttttcattttacagttgattacttaaagtgttttctctatatcatcgtgtttccgcaagtcatttacctttatatttcttttaatcaaaggaattaattttaaaagccataacaatataatcaccccattttgttttatacaaggggtgattatattgtatatacattaaaatcaaagaaatatataattactcaattgttttaatgattatttctctataagagtaaatttccatttacagcagcaggattcgtctgtaatatcaggataacagctgatgcagtcacagacaattcttttatcaataattttggcaaactctgaatactcaattattcctacagatttacatggatggtaaggcatattttttcttaatcttgcagtttgaaccctgcattctaaagtgctgtatatcaaagtattgtcttttattataagttcatcccggtttatattggcataaaatctaagctttaatgctttttccaagccttgcagacccgggtattcttcaagattaagaaattctttgatacgttttgcttcaattgctgtaaaatgcgtccacacttcttcatcacggcacatggcttcctgcataccatatttattctcaagtgactgaaaccataatccatccatagccagccaattttttgaataagcttcaatcaaagttattagttcattttttgataatttttgcagtgtttctttatttaacatgagccgctcctttaatatcttattttagaatataccaagcaaatgctgcattaacaaactaacggcaccaatcgctatccagcagcataaaccaagaaatattggctttcctcctgattttacaagcttgactatatccgtgttaagccctatagccgacatagccataacaataaagaatttgctcagagtttttaaaaagcaaaatactgcttgtcctccgtcatgaatcattccggatggaaagattgcaaagaaaatggtggttatgacagaagctaagacaaaatagaggatgaagaatgggaaaatcttttttatgctgacctttgttccgccggccgacttttccttttccgttctccaaaaggcaagcaccaaagtgattggtattatagcaagagttcgggtcagttttactattgttgctgtgtctaaggtgttgctgccatgtataccatcccaagctgtcgctgctgcagttactgatgaggtatcgttaactgcggttcctgcaaacaatccaaatccttcattagacaacccaagcatggaacccagtgttgggaaaatcaatgcggctatgatattaaataaaaatataaccgagattgactgcgctatctcctcatcgtttgcgccgataacaggagcagtggcggcgattgcagaaccgccgcatattgatgaacccacacctattaaggttgcaattttgggatgtaattttaaagccttatataaaacaaaagatacgattagcgatattgaaatagttgataaaataatcggcaatgactgagctccggtttttgctatacttccaaggttcataccaaaacccaataaaattattgcgtattgaagtatgctttttgatgtaaatgtgattcctgattgggactttgttttattcttataaaatatagttactaccatacctgctattattgcaaacacaggtccgcccacaatcggaaatattaatccaagtatgtatgcagggattgcaattaccaaacaaattaaaattccaagccagttttctttaacaaaattcaagtttactcccccttaatttagtgtttattctattgcagcagatttatcatattctttaaattgcctttgcttttcaaatacctcaggcagttttttgacctttataaaatatgaaatcataaacagcgtgcaggcggacagccaagctatcggcccggatgcgcagactcccaaatatccataaaattctccaaacatacctgttagtgtgtttgccagcacgagtgagagaacaattcgggcaataagctcaaccgcgcttccgcacagaactattccggaattccccattccctgaagactgttgcggtatacaaataagaggccgagagcaaaataaaacacacctgctacataaaaatagttttgagtatataatgtcacgctttcacgcaaatctccgctggttcctgaatcaatgaatattcctgcgatttgtcttgaaaagattaaaacaagagccacaattataactgtgaatcccaaaacaagcaaagcgcatttatttactccttcgcgtattcttttttcacgcatagctccgtaattttgtcctacaaatgttgccattgtaaccccgaaagaaatttggggctgactgacgagctgctcaattttattagccgctgtatagccggcaataactgttgagccgaatgagtttaaaacagcttgaacaatcattacgccgatagcagtaacggacatttgaaatgccattggcactgcaagccctagatgtctgagagaaaattttgagtcccacttaaaatcgctttttttgaggtgcagctccgggaactttttgccgacgtatagaagacaaagaagcccggaaatagcttgagctataatggttgcaagaccggctccggcaactcccatatgaaagtttaatataaatactaaatcaagaattatattaataatcgaagagattaaaagaaaatacagcggtgttctgctgtctcctaaagcacggataacacaggatatgtagttgtaaaagacttgaaatacgattccggcgtatattacaataatataattatacgaatcgtttataatattatccggcgtgtgcataaactgcagaagcgaccttgccgaaagcatactgactgctgttaagaccacagaagccatcgttgccaaaataagacctgtgccaacgcttcggcgtactccgtccatgtcattggctccaaatctttgagctactatgatagaaagaccatttgtaaaaccaagtgcaaaacccacaattaagaatgtaatcgcaccggctgcgccaactgccgcaagggcttcaacactgatagtccgcccaactataatggtgtcaaccatgttgtaaagaacttgaaagatgttcccgataagcagcggtatggtaaatttaataatgtgtttgataggacttccgacagtcatatcgtttgttaaagcatttgccatttatttcattccccctcaatataatataattttcaaacataggtcttattaatataacgctacaaattttgtatgtcaactataaaactgtacaaagtttctataagtacaaatttaaaatattattgaataaaaagaccgtaataaaagaaagagaatatttaatttatcaagtattttaaagtggaaaaatgttgttaatatcattttaaacaatttaaattttctgtaaatattcggattatgaagttgttgatatagctgtttttgtaataaaaattttatgcgcttgccggcattttattcactgctgatgtatccaatataattaaatataaatatgcaccgccaaaagtaacttgcttttggggtgcatattaaaatattatatttaatttttaaattaaaaatttattcttataggcctgtctccgagagtgagcacatcattatttttgatttcgacctgatgtttaagaggcttgccgtttaaaagagtaccgttggtggaattgttgtcttcagccataatcttctttccgtcgcgaatcagtatacagtgtaccgaggaaaccataggcttattaactactacatcacactgaggatttctgcctactaatatttcatcttctatagtcagagtttttgttttattgttttcaataatagttacgtttacttttatttcgcctttactgttatcagctttatttttgtcagtgtttgaagatttattgtcacttttttctataggcttagaagctttgggttcagaacctttttcacttttactttcttcattatcattaatattatcttcttcgtcaacagcgtcttcgctttcaatgtcagagttgttatcttcttcagcgtcttcaacatcttcaacatcattttcttcaagttcaggggtgtttaagtgtctgctcgattccatgtttttataatatagaatttcatcaagttcatcagtttgttttttcttaggattcataaataatcctaagcagattagaaccatagcgataacaaaaagcgcgccggcgatgagtaatatgtcattaagtatattcatatggcagttctcctttaaaatattatcgtgatagcgctgtagctatcttccggctcatttttcttcacaattctaatcatctttctgagccattcagaggaagatttcgaacgttttaaggttttttcaacctggcgctcagtaatcttttcccaaaacccatcggtgcaaatcaaaaccgcatcaccgcttctgacggcgattgggtcaattgtttcagctccgcacatcgggtcggcacccaaataagcggtaagcttgcgcctttcagaacttttacgaattcccggaaaacgaaattcacctttactatgggctaaataagctaaagaatgatccggagttatatattgaagataattttcactgagataatacattcggcagtttccgagatgaccgcttatcacacaattcccatcggttagcacaacggcggcggaggcttcataagtcttttcttcaccattgtttttagacgcgtgcgtaagatcccaaagtttttcatctgcgtttttaaaataaccggagatagtatcccgggttatatcggaagtatttttaaaatcagataaaacggaatcaattacaagttcagaaaccttgtccccgtttaaaccgcttaaagacccgtcacatacagcaaaacaaccgcagcccctgtcttcaagcattccgatataatcacagtttatttccatatcgcccgaatatcgagcggatgaaatatccataaatcattctcctatctttataatgactgtataagctaatatttattaatataatattttattagcaaaataaaccagtcaatcaaaaacaacatattctcattatactttatattggatatattgtcaacacaaaatgcggtggtctaagccatattattgttcagattgaataacaaattaagacaaaaaaagaccggctgaagtccggtcttttttatattctaaattaaggctccgcgtatcatagcagtgaattaatttttttataagttttattcttcaactaactcaacaatttcaacattgtcaacgttagaaatcggcgggatacttcttgtttctattgcacttctgttgccttttaccttagagcctactgttaaatcagcaagcttgtagattcttttgtcattgccgcgggttataacggtgtcgtcatataccataagggcacgctcgattccgttgtcatctataattatgcggtcttcctcaacagctgttatagtaccttcatatggtacagaatcgattacatcgggagcatcttcaccgttaacctctccggatctctcggttccgacagtttcaatagaaatagcggttgtctgaggcggaaggctaagagtcattgcggcgccgtagcctattttgagctcctgtccgtcaacaagtgtgttaaggtcaagttccttatcgccgtcttttaaaattgtatcttcgcttactctgactattacttcacccaatcttgcatcctgaacagacagaacgctgttttcatcttcacctttttcaatagagtttaaggtaacgtcagcaggttcaacaactataacatagtcgtctccgccttcgtatacgtctacgcctacgaggtcggttaagaattcaacaggtacataagttgtttcaccgtcaaccaatgaaggagctattccgaaagaaacaggcatcatttttgagaaataataagagtcaagccctatattcattccaaactcctgagcgcctcttaaacactggattttctggtcttcttcattccaaacaacttcaaagtttaagaactccatgacatatctgagcggaaccattttgtgtccgtcaacgtttacaaccggaacagcaggaatggtagctccgttgtatgtaacctctgactcagagccgttgttaaccgcttcaccgtcagttgctgaagtagttgtatagtcaaggttagggtcggctgttttttcaggataatattccgcaaacacagcagtgccgcttgcaagaactccggcagcaactaatgtagaaataatcttttttgtatctaacttataatttttcataatatcctcctaatcaatttacttaatgttttgtttacagtaccttagacgaaagatttttataaaagttacagatttttataaattatttgtaattcgtaatatttaccaaaaaacacatgttatatataggaaataagtatattttaagcataaaaatacctgtgctgtaattggcacaggtattaaaaagtaggttaagtagattattatattaatattggctgaagctgaattcccttttgcgctgcctcaaccgattttggtatcagcttaaagtcggaaaccagcgagttttctttttctgagtaattatcctgtccgaatgggactatataaatattttttcttgaaagaagtgttcctatgtttcttgcgctgccgctgagaccatcatttgtggaaacagccacaactatcggtttgttatttctaagatgggactttgctgctaaacacactgcagtgtcggatatcccgtttgctaatttggatatggaattccccgtgcatggggcaatcacaaggacgtctataagttttttaggtcctatgggttcaacgtctgttagtgcggtcataggttttttaccggaaatatcatggaccgcgtcgtatatttcctttgctgttccaaacctcgtgtctgtatttgcgactgccggtgacaggatcggataaatatccgcgcccatatcagcaagctcagccataacggcaagcaccttttttatcgtgcaaaatgatccggttaaaccaaaccctattttgacgccttttatcgtttcgtccatataattcatcacctcgcttgctcatttaaaatattattaattgtgtcgcggattatgtttcctgccgtgagcggagcggtttttcccggcagcgataacgcccatattacatttctgcccaatcgttttgctgactcaaagtccacaccgccgggtttgcttgccaaatcaattatcagacagtcttcacggagttgtcttaacatacttccgttgattatcattttaggtactgtattaaaaactacatcgtattttcttgggtcagtgagaggcttagttatgtccgcgccgttatatccataggcttttatatatgctaaatcactctgtttcctaaccgccacagtaacatttgttcccagtccgcttagggtatgacataaaatctttcctacgcggccaaatcctgtgcataaacagttagaaccatgcagagtgacaggcagttcttccattgcgattttaacagcgccttcggctgttggtatggcgtttaagacggcaagttcctcacgtttcatatagtccacaacaccagcgccgtttagatgggacaaagctgtaagcctctcgtcaactttcccagctaaaatcagtttcttatccaaaaggatagggggctcgaatagatcactgatttttatttttgtttctgataaaggagtattaatattctcgttatctaatattgatgaatatggaaccggaagtacaataaagtcagcattgtttacggcctgtgccaggtcgttgcagacagtaatattctttttgcctaaaagttcatcactgtctataccgataacatttactgaatatccgtcttttgcaaatccaagtataacgtaaatctgccgtctgtcgccgccgataaatgcgaaagtagaatacttgctcatcttcaacacctcaatgtatattatgttggtatatgaatttggtgaagatatttataatcaaagttttatttaaaaaatttcaaatttttatattttaaataaacacatagtataatataattaggaagtaaaataataagaaataaaaaatgaaataaaaaaacggccgagatgtggtggatctcggccgggagtgtttctgcttgaactaacctcaagcagagggaaatgaaaaaaagattgtttagttgtggtatgggtatatattacagtatttgtgtgatttttgcaatagaaaaatttgttgatattgcttaaaaagataactatgtttttgttaatattttacaattatatacttttatacattgataaaactaaaagtatatgtaattaaaataatttttacacacaaaatacacttatatatttaattttttctatattcataatagttaaacgtctggttttgtgctcttttatagaaagataatctgctccaacgtctgaaagcactccgcatttttcaaatttgctgccggtttggttccaaaacgctacgcaaacgttttcgccgcagaagttttgaaggtattgttttaaaacggttgatgagttgttagaattctgaggaacactaaagattttctcagtgccgctcagcccgtttgttctaataatagcgtcataaaccgtcttttcttcgccctctgcgtccggcggaagtatcaaatcatcatagttgcgcgaatcaatgtttatatttaaagtttccatgttatgtttgtttctgcctgaacggcggttatttataggttgtttcaattaccattcctcctatcttagtaatagtctattcagaaaaaataaaaagtttacaaaaatatgaataacatttatatttttgcaaagaatagatttgcaaaacaaaattttaaaattttataggaggtttgacaatgtcaagcaaaagtaataatcaaaataataaccagaacaacaatcagaacaacaatcagaacaacaatcagaaacagaaccaaaataacaatcagaaccagcagtctagcagacagaacaacaatcagaacaattcaaattctaataactaattgcagaaaagcatatttaggggcaacaggtattgttgccccattttttcatttattacttcttgtatttgtgtcctgttccgagaataataactaagggaattgggttaaagacaaggaggtagataatattgcctttattaagcagaaaaagggttggatttatcatcactgttttttttgtttttttggtatttttcgggatttccgcagaggcggaggaagacggaaatgctgcggcagaaaaatttgttgttccgggcggacaaagcgttggggtttctttggacctcagcggggtctatgtagacgggctgggtgatgttgagaccgagggcggcgccagcgcctctccggcaaagtcggccgggatagtgtcgggggatataatcacagctataaatgacgaccctgtaaaaactgttgacgacttcaggaaaaaactgaacacacttgaagatactgaagaggttaaggtcaccttaaaaacaagccagggaacagaagagactaaaagcgttgttcctgttagagcgtcagaagacggttctatgaaaataggcgtttgggttaaagacgcggcttcaggtgtaggaaccataacctactatgacccgcagacaaaggaatttgccgctgtcggtcatagcattagcaacgttaacgccggtattgcttcaggtgaaataacaggagatatttttaagtccgaaatagtaggcgtgagacggggagaatcaggaaccccgggcgagcttattggagtttattcagaaaataagcttaaaataggagccattagccaaagcaacgaatttggaatcgtgggaaccgtttcaaatcccgaaaatctgaactctatgcgccagcctattccgataggcggcagggactcagtttctttgggtgaagcgattatatgttctaacgttgaaggaacaaaaatccaagaatttactattgaaatagtagagattaatcagaacagcgattgcggcaaagatattgtttttaaagttacagacgaaagcttaattcaaaaaaccggaggtatagttcggggaatgagcggaagcccgataatacaaaacgacaaaataatcggttctgtgacacatgtcttggtcaacgagccgacaatgggctacggaatttttattgaaaatatgcaaaaataatttaaaaagggtgattttttcacccttttttacagaattgccaatttttggcggttattttgtcgaatgggttgacaacaaaagggaaattcactataatttgaatatcgaatgttaccaaattatggcaaaaatgttacaaagaaattacgacagcgtttttcgacacttttgtctatggtaaatatttataaaaatttataaaaatttaatcacatagggagaaaagaaatggaaattaatcaaaaaatcaaagtagcagtagcagatttcgacagggagttcgcagacggattgtgcgagtatatgagacagactacaaaaattgacgtggtgggttgtgcgtatgacgggttggaagttccgggtttggtaaagaataatgacgtagatgttttggtaatggatttggtgctgccgaccatagacggaataggagttcttgagagaatcaacagaatgcagctgaataaacgtcctcatgttctgatagtaagctcagtcttgaacgagactgtaacgtcatattccaattcatacggcgttgaatattgtatgttgaagcctgtcaactatgatgcgctgattgacagaatcacaatgatggcggctccgataaccacaggcgaagatgtaatgcagaactggaaggtgaacacaaaaaagtttgactatgcacaggtagaagcaatggtgacaaacgttatacatgagataggcataccggcgcatataaagggataccaatacataagaagggcaataatgatggcgatatatgatttggatataatgaactctgtaaccaaagaattatatccaaccatagcggagaacttcagcacaacgtcgagcagagttgaaagagcgataagacatgcgatagagctaaagctcccattgactacatcaactcttttatcaatttcggtgaactcttttaatcttttttgtaacacatcattgacaaacctacattttttaatttatttatattttataagtaaatatttttaaataaataaaaatgcactgttcaacttttatatttttgccaaaataaattattttacactacagaccaagatgtctgcggcaagccgcgacatcttggtctgatattggctgttttattcctgattgtatttctttgaaagctcgtcaatctttccgctttctttcatttcagccaaaactttgttgatttggtctagaagctctttattatcttttcttacagctattgcatattcttctgtttcaaaaacctcagggtcttcaacaaatttgagaccttctttttgtgccagggcaactcctgtagctttgtcgattacaacagcatcaagcttaccgtttttaacgtcttgaactatatcaattcctctgtttgctcttgttattttactgtcatcaattgcgagatcttctgttactatgctgtcgcctgtgtaaccgagaacaacgccgactgttttgttattctttaaatcttctgcactgtttatatcagtgttgtcggctttggtaataataacctgtgaagctgtgtaatatgtttctgaaaaatcaacgctctgttgtctttcttctgtgattgtcattcctgctactgccatatccaccttgcccgattttactgcggcaatcagaccgtcaaattccatatcctcaacttgaagctctttgttcatgctgccggcaatttccttgcctatacatatatcaataccgtcataatttccgactactccattagttgttgtaaattcaaacggcgggaaagcggcgtttgtaccaagcgttaatttgtcgtctttgcttccgcagccagacagaacccccattgtcattactgctgctgcagctattgcagctgctcttttaaaaaattgtttcattcttcttcctcctaatttatattttataattatttacaaaattttgcccaaaaaatctttagtgcgctgattctgtggattcccaaataatttttccgggcttccttcctccactaccattccgtcgtccataaataatactctggaggcaacttcacgcgcaaaccccatttcatgagttactactaccatagtcattcctgcgttagctaaatttttcattacctctaaaacctctcctaccatttccgggtcaagagccgaggttggctcatcaaaaagcattatatccggttccattgcaagagctctggctatggctattctctgtttctgtcctcctgatagctgacccggatatgaattcgctttatcagaaagaccgacaatatttaataattctatagcctttttatttgtatcagaggcattttttttcttaacttttattggagctaaagttatattttcaattacactgagatgcggaaaaagattgaaatgctgaaaaaccattcccattttttcacgcagtttattaacattggttttgggggctgttatgctttcaccctcaataagtatttcgccttccgttggagtttccaaaaggttcaggcaccgaagaaaagtagatttgcctgacccggacgggccaataagcactatcttttcacctttgcgtacatgctgatcaataccttttaaaacttccaaatcaccgaaacttttttttagaccgcttacttttatcaatctgcagccctcctctatcgtatatcggattttctcaatttattttcaaatgcttttagcaatgtgctcactattttaataactacatagtaaataagtgcaattgaaagcataggcactacataatcataggttaaactctgtacttttctggcggcgcctacgaggtctatattggctatcataccgataacagcagtctcttttataagtacaataaattcatttcccagcgcaggaagtatatttttgaccgcctgaggtattattatgtaagtcattgtttggcgctgcgttagtcccagcgacctgccggcctcagtctgtccctggtcgatagataggattcctcctcttactatttcagcaatataagcgccgctgttaataccgaatgcaataacaccgaccatccatctgtcaatattgacattagcaaaaattatgaagtaaattatcaggagctgaaccattgttggagttccgcggataatatcaatatataaaccagagataccgcggaataatttattttttgataatctgccgaaggccattacaacaccaatgaccagacctaccaaaacagcaaaaaatgaaattaaaagcgtgtagccaagaccgctcaaaaaccattgccaccggttatccagtacaaatgttgaatacaaagaatttccgagctcagtaataaagttcattttatatcttccccctccctgtttaaactcttatatttaattatgatagcaaacttttcccaaaatagcaataataaatttgaataataatcaaaatttaagtatttttattattttatgtaataaatctttgattcacgtgttcgtttatatgacttaaacagagtttggaattgcatatttaatatatatatgttataattattaaattaaactcgaaaatttattttttaaaataaaataaaaattttaaataatattgaggtattatatgaagctatccggaaaatctgaactgatgtcagttctcaataaatataatttttctttttcaaaaagtttgggacagaactttttaattgatcagaatattttaaacaaaattgtcagcggttcaggtattaatgagaatacaaatgtactggaggtcggaccgggagcaggaactcttacaagagaactttgtttaaaagcaaagaaagttacagcggttgaaatagataaagctcttatcccaattttaaatgatgtaatgtccgattttgataattttaatctcattaacagtgatattttggagctgaatattaatgagttgataaaaaatgaattcgacaatgaaagctttactgtagtcgcaaatctgccttattatataacaactccaattattatgaattttcttgaaagtgaacttcctgtcaattcaatgactctaatgatacaaaaagaagtcgcagcccgtattcttgccgagcccggaacaaaggattacggtgctctttcggttgctgttcagttctatgctgaacccggaataatctgctctgcttcgcctcattgttttacaccgcagccaaaggtgacatcgactgttgtaaatctcaaattatatgataagccaaaatatgatgtgaaaaataaggaacaattttttaaaattataaaatctattttttcacagcgcagaaaaacactggtgaactcgttatcaggcagcccatatttggatcttagcaaagataaaataatcgacgttttaaaacaaatggaattgaatgagaaagtacgcggtgaaaaactaaatatagaacaaatagctgaactatcgaatataatttatgaaacacaggagtaatataaaatgaaaaaatatgttttagcaagcaaaaacaagcataaagcggatgaaataaaagaaatattaggtgaaaattttgaaattcagactatggatggggccggaataggaaatttagaaattattgaggacggtagtacttttgaagaaaatgctgaaaagaaggctattgaggtgtttaaagccacaggtttgcccactatcgcggatgacagcgggttatgtgttgacgcgctgtcaggaaaaccgggaatttttacggctcgttttgccggagaaaatgcgacagatgatgaaaatatagataaattgctgcttgaaatgtcagaagttaatgaggaaaacaggactgcaaaatttgtctgcgttatagcggtaattgataaaaatatatcagaaaatacacagtttttccgcggtgaatgcaatgggtatataactaaaaaaagagcaggaacaagcgggtttggttacgatccgatattttattatcctgaaaaacagtgcacattgtcagaacttggttcaaatgaaaaaaataaaattagtcataggtacaaagctctgaaaaaatttgcagaatctatatgaaaatgatataaaatgtttcatatgaaacaaaataaataaaaattcgccatatatctatataaattttaattttacgctattgaaaatataaccaggtgtgttataataaagtgacagtgaagaaggatggtacatattatgggaaaaattattgcggtagcaaatcaaaaaggcggagttgggaagacgactactgctataaatcttagcgcatgtttaggattaaaaagaaaaaaagtcttgctgattgatactgacccgcaggcaaacgctacaagcggggttggtataaaacctgaggacgctgaatattcgagctatgattttatagtaaatgatacacctattgaagacgttataatagagacagaatatacaaatatgtggatatgcccgggagatatgaatttggccggtgcagaccttgatttggctgaacaggataatcgtgagtataagttgaaaaaagcacttgaaaatgtaaaggataaatatgattttattattattgactgtccgccgtcactcagtctgataactctaaatgcttttaccgcctgtgatagtgtgattatgccaattcagtgcgaatattatgcgcttgaaggattatcacagcttactaagacaattaagcgagttaagaaaagtcttaataaggatttaagtattgaaggagttcttttaacgatgtttgacagtaggacaaacctatcagttcaggtagtggaagaggtgaaaaaatatttttcttcaactgtattcaatactgttatacccaggaatgtgagactgtctgaggcgcccagttacggtatgcctgttattgcttatgataaaaattcaaaaggagctgagtgctacaaaaaattggctgccgaagtaattaaaaaaaataagaaataatgaattgtttaacgtgaaacaaaatattataaggatgtgagcagatggcttcaaaatctaaaaaggggcttgggagaggacttggagcgctttttgatgacagtaagtcggagaagagcagcgaagggtttgattttttatccgatctatccgatacagaaatcgcagacagcgatagtataaaaatgataaaagttcgtgatatagagccaaataaaaatcagccgagaaaaacgtttgataaagaaaaattggaaatactgagcagttctatagccgctcacggtatagtacagccaattttagttaagccaaatataaacggaacttatatgatagtagccggtgaaaggcgctggagagctgcaaaattagcaaaaataaaagaggttccgtgtgtcatacgtgaattggacgagccggctgtaatggaaattgcattgatagaaaatctgcagcgtgaggatttaaatccgattgaggaagcggagggctacagacgtttgatggagacttgtgaacttacgcaggaagaggtagcggagaaagtgggaagaagcagaagtgcggtcgctaactctctcagactgaataatttatcagaaagagtaaagcaaatggtgattgatggaaaactatcacaggggcatgcaagagcacttttatctataactgatgataatgaacagtttgaattagccaaatttataatagaaaagggtttgaatgtaagacaggttgaaaaacttgtgtctgatacttcagaaaataaaaagaaaccaaaaactaaacaagtaaccggaatgatgaaaaaatatttttctgaggtagaaaatgacctgggttccagattgggcactaaagttaaaattagtgaaggtgcaaataagggaaaaatagaaatagagtattattctaaggacgatttggaaagaatattatttgaactaaaaaagtagttatatatgaaatatagtagatttactttaaaaaccgacttaaaaatttatacctaatttgtaaatttgaataatgtcctaagtaattatattaaaagaaggcaaaattgattctggacatgtttttagcttttatataagcaattggtttttgagaggaggaatgacattgggaaaagagaataaattaaaggaagatgttataaaatctgaaagttctaaaagtgagaaggttataaagtctgaaaagaatactaacccaaaaaagaagagtaatattgcaacatatgcagttgttatgataatttgtgttattattattattttaatagcagctatggctgataaccgcgaagaagaaataggaaatagggttatggaaactgaacagacaaacgcaagcttcgaaaatgaacttgtaaatttgcgtgaagaaaactataagctgaaaaaagagcaggagaaaaatgcttccaagatggaggaagagacaaagtataaagcagtgcttgaggtaatgagcaatatttggacaaaaataaatatgggagatacggaaggcgcaaaacaggatattatttctttggattcttcatcatttgatgatattcaaaggggatactatgaggctttgtgtaaaattttaagtattgacagcgctacaaagcagcctataacagaaaataacgctcagtaataatgtaaagatggaggataaaaatgttagatattaagttaataagaacagaaaccgataggatcaaaaaggctttggcacgaagaaaagaagaggtagacatagatggattgttagagcttgacaataagcgccgtgagttattgtttgacgtggaacaaaaaaaagctcagcagaatgtagtatctaaacagataccacagttcaaaaaagaggggaaggatacaaccgaaatttttgcccaaatgaaagaattatcggatagtatcaaggtagacgatgaaaaagttcgtgagctggacgaaaaaattcagacaataatgtatacaatccctaatatacctaatgagactgttcctgacggcgacaccgatgaggacaatgttgaaatcagaaagtttatggagccgacgaagtttgattttgagccaaaagctcattgggatataggcaaggatttaggtattctcgatccggagagcgcggcaaagattaccggtgcaaggttccatgtttataaaaagggcggagcgagacttgaaagagctattatgaattactatcttgatacacatacaagccgcggatatgatgagatatttcctccttttatggttcacagaaacagtatgctgggaacaggtcagcttccaaagtttgaagaggacgcattcaaagttgccgataccgactatttcttagtaccgacagccgaggttccggtgacaaatatgcacagggatgagatattaaacggcgatgacctgccccttaaatactgcgcatatacagcttgcttcagagcagaggcaggaagcgcgggacgggatacaagaggtctgataagacagcatcagtttaataaggtggagttagttaagttcacaaaacccgaggattcatataaggaactggaggagctgacagccgaggcggagtatgttcttcagggacttaaacttccttatagagtagttaaaatatgtataggagatttgggatttacagcggcaatgaagtacgacatagaagtttggatgccaagctacggcagatatgtggagatatcttcgtgctcaaactttgaagattttcaggcgcgccgtgcgaacataaagtttaaaaactcacctaaagagaaggctcagtatgttcatacgcttaacggcagcggagttgccataggaagaacaacagccgcaatactggagaattatcagaatgaggatggaacggttacaataccagagatactgcgtccgtatatgggcggcgagacagtaattaagccagactagtagtatagctgcaaaatggactttaaaaagtcattgttatggaagattaataaaaaccattgtaaaaggcttatcactgcttaaatacaatggtttttttatattttcttgttatacaaaaattggactatagattttttaagccattttatttttacgacaaaatgtttcacgtaaaacaaaattactcttttggttttgaatatatacagccgcagtagttttgcctgtaaagattatattgggatgaaagctctattgactttttaaatccctctttcttcttaaagtcagaaggtaaaaatgaaatttgatactcatcgcccagcatttggcctatttcattgattttctgtgcatttttaagaggacttatagtgagggtagtgcagaagtaatcgaaactattttcttttgccgccttagctgtagcttctagccgcagcttgtagcatttaaaacatctttcgccgccttcgcggcagttctccaaaccctttgaaatttcaaaaaacttttccgggttgtaatcagcgtctaatatattgattttatttatcgccggaagttcagaaatcagtcttatttgttcctgtttgcgttttagatattcttctttatttgttatgtttgggttataataaaaaaccgttatattaaaatatttatttaaatacgacaaaacatagctgctgcagggggcgcagcagctatgcaataacagcgattttgttgtattttcaccttcaattttattaattatcttatcaagttccagttgataatttatcttattcatgttttcacctgtagtatgtttaaatcattatatatgtaaaatcaccggtacattatattatatttttatataatccgtgatgttgttatcaaatattatcataggttaggtttcaattttcactgattcggttaaatagttcattggcttctttgacagttatttcatcgttatcaatcaagacctgaagccttgcggcaatattacttttcaaaaaagcacgatactcttcatacttaccaaattgattagccacatccgccggcataataccgttcataagcatttcttcgataacagattcctcggctcctgtaatcaacgaaagtaatagagttatattaccgctttcaacatcaactaacatatagttcactcctttctcaagtagtatattcaagttggcttatccttattaataaaatgtattatttttctttacacctatatcataacactttattgttaataattaatgaacgataggttaatattagttaaataattgtgaaaaattaatttataaaagttaattaaaagaacttgattttaatagaaaaaggtgttataataatatggttgtttgaataaagagtatgcgcctgtagctcagctggatagagtgaacggctacgaaccgttaggtcgggggttcgaatccctccaggcgcaccatataggaacggactttggtccgttcctatttttattctttttataccatttcgggaatatgtaacaatttttccatatcggtttcggctgataaagccatccctttatgtagaatcttatcaatatcattatgctgaaaaaagacaatataatctttatcaatgaaaccttgtggataaaggcatccaacataatcgtataatatagcaggatttttctttgttatttgctgtcttccgtaaatcataagcggccaagttccattctttaatacaacaactgtccctattggatagtatttcataatcataactcctttctcaaattatcaaataagttattaagcttaattttgcgatagattttgttattattcgatactgatataaccaaattttgtgaacgaaaaattttctccgccgcctcatttatatctctaactgttacatcatcgtacttcccaatcagttcatctatggagcaaaacggctcattttcaacaaatgtacgccatcctattaaaaaattcagttcatgcacatcgtcaagcaacctgtattgattgtcagtatagaaaaccttgtttgactgcatatcattttctgtcaagccgtattttgactgttgtaatatatcaaataccgccgtcaagctttcttcgatatttttgttatatacttcaaattcaaacgacattcttcccgagtatcccgcaaactcaatatttccgccgattgcacttgtaaatcctaatttctcccttaaaacctgtgacagcttggaggtgacgccgtatccgattatactctgcaaaatttcagccgcataacgatttacggatgctccgtctacatcaaatgaaatactaacatccgaaaatccgtcgcttgagccgtaaattctgtccgatgctgaactacgattacaaaattctttaacagtgtacttgggtagtataagatttgttatcgtatcaggcattggaagttgctctaattcatttgtaaagtgcgataaatcattacagctgaaatttccggttaaaaccacacagcagttctccggcacaaaaacgctcctgcgatattcattaatacaccttgcgctcattctgtttatatcggatatattccccattataaaagaacccttgggcgtactctcgtaatacttcatgtctgcctttgagtacaaggaattatacctgtcctcaatctgtcgcttgacaacacgcttctctgcctcaacctcctgcggccgccactcaaagcttttgaacacctttgatataagcaaaaatgcctctctgatttttgacggtgaaaccgtaatgtcaaggcagataaaatcagcgtatgttgccccatttagcgttgcgcctattttgtctgtttcaaaatacagctgcctttgaggtatgtcgcaaaggcgacgaaagaacatgtgctctgtcatgtgtgcaattccacagattttttccggtagctttcgcgcatatattccaatgttcacactgtgcaggtgttcattttttatatgctttactgtaagactgttatttaagatatttgtttcaaattttgtgttcatataaatatcttctttctctaaggtgtaacaatatttgcaggaatcgtccaccaaagcggcggagcaagagatggaagcattcttaaccctctgtatatggcatatcctgcagcagcagaagcgccaatgacaaattctttctccacaatgcgtttttgacaatatcactttttagtgcgtgtgcttttaatttattgtaattcataaggttcttttaacttacgtaagtaaaattatcaatatcacttgatttttacttacggatctgtaagatacaaatatgcaaatggatatctgcatatccgcaattacacattaacttgttgttaccggcagcattttaatgtgtattttcttttacaatcaatttacaccacgcctttcttatataacagattattttatttcttttcataatcattatatcagaaacaaaagtgacatagtgtgccatttattattatatcatatcattaatataacaacaatgttttatcattgtactaacacaatgtatctttttatataatccatttttggaataagccgatatagagttattgtgtccagattatttaattttgagattaatactgattattggaagtcgaaaacccttgattttaatatgtttttagcaaagttctatctgtatactcgcaccataccgtaacaaagttttctttgctgcgttttttattcaaaaatttacatatactttattacttcttcttttaaagaaaaacagcagattttgagagcctaggagttatcgggtaagtcaaaatatatttaaattattcacgctggccaagctataacaaatcgaaccacatacggcagattacctctgttgtttatgggttcgattttataataattttattttggctttataaggttgcaatgtttaaagccgttattatttgctgcaaattaatagaaaatttttatataaatttttacaccagataaaattgctcctcaaattataattctatatcaagcagtaacgcagtttcgattcaaattttgtatttaattttccgtcacaatcaaggctgcaaactagatttttaaattttacgctgtaactgtgaggattaaaacggttcggcaaattattaaatgatatgtggtcttcatagaattctttttttatttttccattacagtcaatatattttatgcatattccaaatcctgtaacaaccctttttgttcggccaatgtcataacaggccatatttgtattataaacatagcatagtatgaaacgttttaaatcgcagactgaaatatttttttgtatgcattgacacaagcatcggctattcatctcaaccgaccaggaattgctttccgcgcatatgacgtcatcacaggtgtttccgtatacgtatgctgtgttgtcaaacgtgacaggagtttgtttgcagcatggctctgagcaaacatataatacaaatgaaactgtgtaaatttgaccgggacacaacgttccaatataaataccactttgtgggttttcatttgttggtccgcatccgtcttttattgttgagcttgttttatagcataatccttgcggaatattatcatagacaactacattagtaagcgctgtactgcagggattggatattttcagagtgtagactatttcctcgcagagacagcacacggaggtcttgtcggcgtgctttgtgattttaagtccggcattaacaattctaacagagctgcatttacagcttcctaatccatatctgcagcaattgctgcagtctaaatagcaatacctgacgaaagctcggtttactatatcacaggatacagcatagtctacagacacgctgtatcttagttcggctgtttgacccggcggcagactgccgattgaaattccggtttgcagtgtttcctgtggttttggcgctggctgtatagaaccgggtattacggaaactccgggcggaagcgtgtcaaaaatttgaactgtgttcagcgatacatccgagtgatttgtaaactctactgtataggttaaggtatctcctatttgagcagttgatacgctggctcttttattggtactggtccaaatcaaacaactatcacatgcacagttgttcacacataatgtttggcaagggttagctatctgaactgtcttttgttcagttacaaatgattcgcatcccggtaaaatgatttcatcaccgtcacggcagcaaattagattgctgatgtctgttgctgaaccggggacaagcgatagtccgctgcagccgccgtaagtaatatcatacatacgaatgctattcgtgcaaaataatttatagtccagtttagcgtcagtattattacaattatttaatgctttgcaggaaaggtctgtcggcattgcatatttgtctcctttcaaaaaaagggaacgggataaccgttcccctttcataatttcctattttctaagaagctgtcgtaaaaccggaacagcacgaataattattgtcaatataatttgctacaaactgagctctgacaacacgttctgaacaaagtccaaagccctcgtccggcagaatgaactgtatgcatgaaacaagcacatctgaacaagttggtaatccgtgcggcggaatgacaaaggttttcataccacggggctgaatttcgttgtttggatctaattctgtcaaaatgaccgctaaagcaacgcgcctgtcaggacaaacatttagcagattaacatccagctgtaaaattcggcctgtgtcatttagctccaaattacctgcgtcaaactgtataaactcgttgcatccggtcagcggtatgtctatcggtgtagagcataagtcaacagggactacagactggcaatctacaaaaacagaaggattagcaaagctggcagtatttccctcattatctgtatatgaaatagattggtcaatatttttaatacctgaagtagtggcgttatgcttaatagtaaatctaaccgttgcgctttcggtagaagttgagccaagctggctaatgttccatcggaatgatgttcctgtcagcattgatatagtgcccaccgaagctgttggagtgccggtaataataaaatcaggatttattacctcatttattactatatcagttgcaccggggactgatatatttgccgctaaatctgcaaataattgttccagttcggagctgtccggagcaatagaaacatgtgttatatcggggtctgacgcccaattattcagagcgtcaatatcgattccgccattgccaacgagaccaattgtgtaaattgtaattcccatggcttttgcagcggcagcaattggagacggatttggaccggttgtggtttcaccgtcagtaaacataacaatgacgcggttgttggttgatgagctcaaaagcgacgttgcctgtgtgaaagcgtcgccatggtttgttagtccgtcggcagtcagtgacgctgcagctgatttcaaatttgatacagaagtgataagtccggtattttgaaccgccgtatctgcaaaactaactataccaatacggctgccggaaccaatttgaccgggacctccgtcggtagcgtcggagataatatctataaaagtattaacgccggttttcaaatcagcgagcggctgaccttccatacttccggaacggtcaaggactaaaacaatatctgttggattggtggtgatatccggtgcggcggtgattccaattgtaacatttaaagaaccctgacaattgatggagctaacgccgcctatagatttatttgaactaattattcccatttctataacctaccttataataatttgagcattacgctcaatatcaatatatgtcgaaaaatcatatatgttaatacattacggcaggtgtaattcatataaataataaaataaaagtatgtgaatagtgagcgtcggcaggccgcatttatgcggagcgtaaggcgagcaacgcgggtaggatataaaactaaaagtttatactgatatactattccacgcctacgcacctaacgaggtggtctgcgaccaccctaccgaggtttgaaaaccgcttcaacaaataaattgtaaaaattttaaaaaatatcgtgtactcaaagtatctgcaaatatttataagttataatgctttatataaaatattaaaggggtgtttctatgcaattaaatcaaattgttgccaaacgtattcgtatgctttgtgtggaacaatcaataaaccaatatggattattcttaaggagcggcgttcctatgacaacaataagttcagttctgcactgtgtacatcggagtgtgacgctgcaagttttatatgaaatcagcgagggatttggtataagtcttatagacttttttaactctccgctgttcgagcgtgaaaatatcgatgattaaaattgtgctctcagcaaaaaataaatttaatataagtttttatttgtttatttttagtgacttttttactgatatatgctatactgttattataatagttttaaaaaattggtgcagtatatcagaattgggggcgcaggatgttgaaagggagaaaacttttaaaaattaacctgctggtaagtattatattggtatttggcttcattataacttcatttttgagttataacgccaattacagaacctctctcagtaatgtggagcaggtgtcgtctctgacggccgaaagtatatattatcagctgactactatgttcacacgtcctgttaacatctcgcttactatgtcgagagacactctcctggttacccagcttaatgaagaaacaaagcagatgaataatgaggaatatatctcaacactgaaaaattaccttgagacataccgcggaaaatataattttgactctgtctttcttgtctccgaagcgactaaacggtattataactttaacggcgtagaccgcgttctgactgaggataatcctgaaaacgtttggtattatgatttgatgaaaagcgggcaggaatattcgttaaatgttgataacgatgaagttgacggcgcagacaacgccataactgtttttgtaaactgcaagatatacggagagaataacaaggttttgggagtagtcggagtaggaataagaataagctatcttaaggactttttgaagacctatgaggaaaaatatcatctgagaacctgtttggtaaatgaggacggcataatcgaaatatccactacgcatacaggttatggcagaaccgattggtttagcgaatacgacagggaatctatacgcagtcaggtgcttgactggaagagcgataagagtaatttagaattttggactgaaaacgaggataacagtcaggaaaaaagttttgtggcttcacgttatattccggagctgtcatggcacttggtagttgagcaggacaccggaagtataatcggtcagatgaaaataagactttatttgacagcagttattattatcggaatcattattattgtattgataataataagtttagtattatttaagtttataaagcaaatatcagaactcatggaggaacgtcaggcaatatttaaaaaggctactgaggaactttatgacaatatttatgaattgaatataactaaaaatggttatgcaaacgctcccacaaaacagtactttgagagtttgggcgcaaagggtctgccgtataacaaggcgcttaaagttgtggctgagaagcagattaaaaaagaatacagagagggatatattttaacgttttcgcccgaaaacgtcattaaagaatttgagagcggaaataatcatttaagttatgactttttgattactcagaatgatatggactatttttggatgcgtattgacgcatatatattcctgtcacaagaggataactgtattcacatgttcacatatcgtaagaatatagacgcggaaaaacaaatagagcgtcgggcgtcgacagatgagatgaccggattccttactaaaacggcgactgagcattctattatgtctgaattatctgaaaagccggaggacttatatgcgttctttatctttgacatagataattttaaacaggcaaacgaccaatttggtcactcatttggggattactgccttaaagagtttactgaggttataaggaaccatttcagggacggtgatatattgggacgtatcggcggagacgaatttgtggcgtttataccgattcctgataccagatgggtggaaagtaaagcgagagagttatcagcagctttaaacttcaactgcgtaagagaggaaaaggagtggaagctgtcctcaagtataggcgtgtcgattgctccggaagacggaaacgactttaaaacattgtatgagaaggcggacgctgctctgtaccgtaccaagcagagaggaaagaacggatacactatatattaaaagcagaataaagaggagactgccgcaagtttgggagattcatctaatttattttgacggtgtataataataggactttaaataatgatggtgacccacgaaaaagttagatttttggtctaactttcgtgggtcacatcattataaagaagttttattttttattgcctatatgcaagaaactatataaatttttttattgtttttacgctgaattatacgtttattaataattaataggctgatttatttatactgtaatatgaaaaacaccgtatacgttcatgttgtatttccaaatagttctgacttttggtatacaatttattgaaagcataaggtgtttagtctattgttttatattttaaggacaagttaatttaacagaaatattatagtgtctagactgcgaataaaaattttaaggattatttctatatatttctgaatttccataactgctattattgtctgttatgtttaaataattttttatattccgctggcatcattgagttcaaacaggttgccttcagggtctctgaaataggtgcagcgcataccccaatcctcaatagtctgtggttctcctaaaaactgtactcctgcctctttcagacgtttatagtccttttcaaggtcatctgaggggataacggccacaactgtatcaggctgtgaattgcagtcgggctggttatagcctttaaacatactcatattttctccgttaaaaattgcaaagcaaggcggagcgtctttttctacggcaaaagaggtataaggaccgtttctgtcaccccataccggagttaagccgattttatctgtgtaaaagtcaaaacattctccataattcttccgaaccaaaattctgattgtagtattatcaaaccgcatttgttttacctccaatatattttttatttagatattagttaaagctcgtcctacatatttcatgatttttatgtgatacctatgtgcattggtaattttcgcatattgtatattttatatcataagtttccgctgaatatttttataaagccaaatagaaaaactatattttggtttctttcctgtcagtaaataatatgttttcgaaacgccggggaattgttgatttataggttatgccattctccttgctgttatgagcaaacaaatgatatgtatattgctttttcagcattgatataccggtataaataaggcaataaaatttattactgccaatatccttgttgaaatataggttatttcataattgcatttaacataaatttttgcagaaacaagaagttattataattaaatattttggcggcagataaatttattattcattttcttttttatataaatagtaaaatacagaactgcggttcaattatattagtctttaaaattcattgacagactgattctgttctttttggtgtcaacatcaataatttttacctgaacaatgtctccgatagaaacaacgtcggtcgggtgcttaacatagttttcggacagctgggatatatgaacaagaccgtcctgatgaacgcctatatccacaaaagcgccgaaatcaattacatttctcacagttccggtcattatcatgccgggttttaagtcgtctatactcataacgtcacttctgagcaacggctgttcaatatcgtcacgcgggtcgcggccgggtttttgaagctcttttattatatcttttaatgtggggactccaatatccaacttttgcgcaagacttttaaggccgtgcttgtttactgcttcatctaggtttttcagaccatcgctgcttatatccttgaaaccgcactcagaaagcagcattttggcggcgtcatagctttctggatggaccgatgtgttgtccaaaatattttttccgtctgttattctgagaaatccggcgcactgttcgaaggctttaggaccaagtttagacacttttttcagctgttttctgtcagtaaatcttccgttttcctcacggtaactgactatatttttggctatagccgagcttatgccggaaacataactgagcaaaggtgccgatgcggtgtttaagtcaataccgacgctgtttaccgcgtcctcgaccacgccgccgagcgcttcagccagtcgtttttggttcatgtcatgctgatattgtcctacgcctatcgctttaggttcgatttttacaagctcagccagcgggtcctgaatccttctggcaatagatatagcgcttctttgggtgacgtcaaaatccgggaattcctcggttgccagttttgaagcagaatacactgaggcgcctgcctcatttgttataagatatttaacttttgtcccgggtatggtctttaaaagttctgctgtaaatatctcagtctcctttgaagccgtgccgtttcctatggaaatcaagtccacatcatgtttttttataaggtttttaataaattcggcggctgattttttctgcgcttccgaatgtgtgatataaataacccctgtgtctaaaaccttgcctgttccatcgactactccgactttacatccggttctgtaacccgggtcaaggccgataaccaccttgtccttgataagcggctgcataagaagattgtgcagatttgttttaaatatttttatcgcttgttcctgagcgttttcagtcagttcgtttcgtatttccctttctatagacggggcaatcagtctcttataagagtcgtccacagcggcgtcaaaatatttgtgttcgccgccgtcaagttctttccgttttaagtaattgattattttctctgtgtccggtatgattgatacatttaagactttttctttttcgcccctatccattgcgagaaccctgtgcggagctatctttgataccccttcagaaaaatcataatacatttcatatactgtctcggcttcagggtctgttgccttagaagtaatcacgcctgtttgaaaggttatgtctcggattttttttctatgttcagcattgtcggatatttgttcggcaataatgtccatagctccgttcagagcgtcttcaattgataatacttcattttcctcgcttacaaagtcttccgctcttttttcaagttcttcatcactcagcatttgtgagtatatcagcactgagaggggttcgagaccttttgctttggctatagtagccctggttttcctcttgggtctgtatgggcggtataaatcctcaatctctgtgagcttttctgctttatcaattgcctcagccagttccggggtcagtttgccctgttcctcaataatgcgcttgacgtccgctttgcgttcctccatgtttctcagataactgagcctttcatttaagtcgcggagtatttcatcgttaagctcaccggtggcttcttttctgtaccgcgaaataaatgggatagtattcccctcgtcaattagcttcacagtgttttctacttgccaagcgttaagtttaaactcctctgcaagcttctttagtatatccatgtatcaatttctccttaatatctatattttaaaacgaaatctgcgaactgtcaggtagactgtcaaggaccccgttttcgccgagaacttctataaccgttttagttattccggctctgtttttcaaatcttcctttgacataaagtctccgtcttcacgggctgacgctattgcttcagcagcgtttgttccaactccggcaaaggcgttaagcggcggaagtatttttccgtcctttttcccgaatttatatgggtggctttcgtaaaggtctacgggcgcaaagtcaataccgcgctcatacatttcctggcatatttctaatatagtaagcagatttttctcgtttgcggtggccgagttgcctttaatttttatcttcttcatttcctgaatgaccttttcttctccgtgcgccattatagcggcgtcaaaaaggtcggctctaactgtaaagtaggccatatagaattcggcaggatagtgaactttgaagtaggctatcctgaacgccatcattacatatgcggcggcatgagccttagggaacatatattttatctttttacaggagttaatataccattcaggcacgttattttcacgcatagcggcttcaaagtcttccggcataccctcttttgcggctctgccctttctgacaaactccatgattttaaacgccatgctgggttcaagcccatggtgcagaaggtataccataatatcgtcacgcagtcctataacttcggatagcgttgcggttttattcttgacaaggtcctgtgcgttgttaagccaaacatcagtaccgtgggaaagcccggatattataagcagttccacaaaggttgtcggcatagtgtcaaccagcattccgcggacaaagttggttccaaattcaggaacgccaaaagttcctaccttactgtcaatctgttcgggtttgatgccaagagcctcagtgctgctgaacaaactcattgtttctttatcgtcaagaggaatctccaaggcgtttatacctgtcaaatcttccagcattcttattgttgatgggtcatcgtgtccgagtatgtctagctttagcaggttgtcatgtatagaatggaaatcaaagtgtgtggttataatgtctgaatcctttttgtcagccgggtgctgaacaggagtaaagtcatgtatatccatggtcttggggcacactatgattccgccaggatgctgtcctgtcgttcttttcacatcgacaataccctttgagatacgttttagttcagcgtcaggggccactatttcctttttctcataatattttcttgcaaacataactgccgtcttgtcggcaatggtgccgatagtaccggctttgaatacgtacccgtctccaaaaagttcgccgacatatttgtgagccgtcgcctgatattctcccgaaaagttcaggtcaatatcgggaaccttgtcgccctcaaagcctaaaaacgtttcaaacggtatcgtaagaccgtcttttctgagcggcgcgccgcatttcggacaggtcttattcggcatgtccataccggtggggtattcgccgttgtcataaaattcactgtacttgcagtccgggcacacatagtgaggacagagcgcgtttacctctgttataccggacaagaatgcaacaaaggaggagccgacacttcctcggcttccaactaggtagccggcgtcgtttgattttttaaccagcttatgcgcaatcatatacataaccgagtatccgtatttaacaatacagcccagttctctctccatgcgctcctcaactatttcaggcaggttgtcgccgtagatttcatgagccttactgtgacacatatcaatcaaatcctgctcacagttttcaatggtcggagggtatgagccgtccttaacaggctggatatcctctatcatgtcagctatttcaacagtattgtctattactatctcttctgccctgtcgccaagataactgaactcgtccatcatttcggcggtggttctcaagtacagcggggcctggttgtcagcgtcttcaaagccctgagcgcccatcagcacgcgcctgtacatctcgtctttggggtcaagaaaatgaacgtcgcaggttgcaacagttttcctgcctatcttgtcgccaatgctcacaatctttttgtttatctcgattagttcattatcatctctaacttgtccattacgcttcataaaagcgttgtttcctaatggctgaatttcaagatagtcataaaattttgctatctctgccagctcgtcttcggatttcttatttataatagcccggtaaagctcgccggattcacaggcagagcctactataatcccctcgcggtatttgtggagcagacttttgggtattccgggcttcctatagaagtagtccagatttgacctggatattaactggtataagtttttgagcccgacatagttttgcgccagaagtataatgtgatatttcctggtcttcacgaccggattgtctttatccagttcgggaatctcagcttcagccgccgccgcgtctttccatgcggtcatatccatcatttttatgaagcagtaggcagttgccgtggcgtctgcgaccgctctatggtggttgttaagctcaacgcccagcctttggcacataatatttaacttgtgattgttttcatttttaaatatatttctggacatttccagcgtgtccattgttttattaggaaaatataatttgaggcggcgcgcatttgagtatataaatcccatatcaaattttgcgttatgtgcgaccattataccgtcgccgcagaatttttggaattttggcagaactttatcaatcgtgggtttatcctcaaccatttcattggtaattccagtgagttctgtaatttgctcagatatttccatttcgggattaacaagctgtgagaacttatccactataataccgtctctgatttttacagcgcctatctcagttattttgtcacggtctgaactcagaccggtagtctctaagtcaaagactatgtatgttcctttcctcatttcccttatgtcgttaaggcgtttggaatctatgtcgtcgattaaatagccttccattccatatatcattttcagacctttgtgagcctttgctgcctttctggcgtcagggaatccttgggcaactccgtggtcggttatagcgacagcgggatgcccccagaaagccgctctgtcaaccaaagacccaacggatgaaacagcgtccatagcactcattttagtatgcatatgaagttcaacgcgctttttgggataagtgtcttgtctgacaggcggagccggtatcagcagtgcagaggtcactttgattacaaaactgtgaagatactcgtcaaattcatagtttcctgctaccttgagacggttgccctctttaagcattccggtcagggctttcattttttcagaatttccgaaagcgctgcaggtggttgcccattcgtcatcacctatagaaaattttattgaggtgttggaacggttaccgcggactatgtctctgctttcgaaatcaataatttccccttcaacaacgcaatattttgtttcttcggtcagtttaattattggcgtcgggttttcatctatgtattttccgaatgatttcggcgattcggacggagccgccgccttttcgggtcttctttcctggatagaagcggccacaagcttagattctaactctgattgccgcttgagatattcctctcggtcggtttcggcaaaacaaagattaaccgtaacgttaagatcgattccaaacgcaatatgctcacgcataaaggctgaaaaattcatgttattcagagcagactcacagccgttaatatttttaataatgagagtattatcattaagctcccctgtggctcctattaaaaatgcctttccggcatcatggcttgcgagaaaagcgtcaagcagataagaaaaatattggtctgaaaaatcaagaccgggatacttaacaaatatttcaaaatcgttcagaccatatgattgtttggtcatgtttataaacgcttttgtttccgggattggcagcagattctgcccttttaggtaaagctttatattattataatttgtatctatattacaggatactatttcatagctagacaaaagcgacgcgtaattttcaagcacggtcaccctgtcaaaaatatccagtatggttgggctcattttatcatcttccttttaaaacttcattttattcggttaaaccattttattaatttcatcaatcaaacatggaataatctcgtcttcactgacctttctgattatttctccgtgcttgaacaatacgccgcagccatcgccgccggctattcctatatccgcgtctttggcttctccggggccgttgacaacgcagcccataactgcgactttcagatttttatttattccttccaccgcgtcgttgacagcgttggctatggaaataagatcaattttggttctggcgcatgttgggcatgaaactacttcgatataatcttcgtctaagtctaaagctctaagtattgatttggccgcggatacttccaaaattgggtcgtcagtcagagatactcttatagtatcccctattccgtcaacaaggagcgagccaatacctacggaggattttactatcccctgtttaattgttccggcctcagttactccaagatgcagcggataatcaaaagtttggctggcaagcctgtatgctctgacagttgccgcaacgttggaggatttcattgacagcacaatgttatcaaagtcaaaacggtttaggatttcgacatgccgttttgcgctttcgaccattgctttcggcaaatctccgccgcacttatcaagcagacctttttcaagtgagcctgcattcacaccgatacggataggaatatttttggcggccgcggctttggctaccgcttcggcattttcttcaccgcctatgttgccgggatttatacgaaccttgtctattccgcgctcaatacacattaaggccaggcggtagtcaaagtgaatatcggctaccagcggaacgtttgttttattctttatttcttcaatggcttcagcgctctctttgtccggaacggaaaatctaactatatcacagccggctgaggccaaatcgttaatttgtttagttactttttctatatcataagtcggaacgtttgtcattgactgtatagcgaccttatttccgccgcctattgtaatgtttccgattttaacaggttttgtatgtattgaaatttcttccataataaccaccccggataagtttttttatctatatattttatcacaacggcagtacatattcaagtaaataaaatgcgctgatttaattaaattttagctcattgcagggcattaaagtaataactgcatataattaaacggaggggataataatgcgaggcagaatcgaaagtataagttcagtgaaggataggaatcagattattacagttgttggaaacggcgagcataacggaagactgagtatgtttgaaaaaagagataaccggtggataaggctgttttcgtatccatgttcagtgggagcgggcggaatagctgatataaaaagagaaggtgataatataactccgtcaggaatgttcacattaggaacaatttttgggtgcgcggataatccgggaacagagaataattatctaaaggtaaatgacgatatgtattgggtcgatgatttcaattctgaacactataatcagctggtagatatagggaaaggcaaagttgattttgccagcgccgaacatttgtcagattatcctattcaatataaatatgcagttgctgtagactataatattgatggtattccgggcaaaggctcagcaatatttttacactgcaccgataatttagaaaagggaacttcaggttgtattgcggtagacgaggaagcaatgaaaaagataataattaatcttaaaaatgacgcggtaattataataatgggataaaaatatacttttaaaatttattctgtaactttaatttgtgctaataaaacggtatgtggaatattgagtataataaaaataaaatttgggtttaaatagcagtgtgccgtttaggcagcaaatatgttcggatgctgaaacaatgcggaaataaggctttaaggtgataattagttaagacaataagaaaataagacaattaagatagttatatattaatagtggaatgataactttataaatatataaaaaatacatagaaaaagacaattaaataagtccttgccatttggcggtcttaatatattttatgccagcaaagcaggtatgtactttgtttttttgttacaattagattataattattatacagcagtcaattattttcactagattaagttgattagcggttttggccgccttaaaaatattgatgttacttagtacagaaactaacactaaatatagtaattataaaaactattggtttaatttatgattgacaaatttggcataataaaagagccgctaaaattttagcggctcatatcttttaacttaaatatttttagtgagaaataatattctcagtatctttatcaaataagtgaattttatttgcgtcaagagcaaccgtaacggtatccccgtgtcttgctgtagaacgcggattaactcttgcagtaaagtcatttccggcaattttgaaataaagataagtctcagcacccatcatttcaaccaattcaatatttacctttgaacagcagtcaggaacacttgaaatgaatgcagggtcgtcataaatatcttcaggtctgatacccataataacttctttgccgttatactgcttaatttctgatctgccgcccttgccttcaggaagtttaattgagaaatctccgcatttgagatatgtgccgttagaagcgcagtcaacagtaacgttcaagaagttcatctgaggagaaccaatgaagccggcaacaaacatgttgcaaggatattggtataggttagacggtgaatcaacctgctgaataataccgtctttcataacaacgattctggtacccattgtcatagcttccgtctggtcatgcgttacatagataaatgttgtttgaagcttcttatgtattttaccaatctctgttctcatctgaactctgagttttgcgtcaaggtttgaaagaggctcatccatcaagaatactttagggctacgaacgatagcacgtccgagagcaacacgctgtctctgaccgcctgataaagcctttggctttctgtcaagcaaatgctcaataccaagaatctgagcggcttcaataacctttttcttaatttcatcctttggtgtttttctgagtttcagaccaaacgccatattttcaaatacagtcatatgcgggtaaagagcgtagttctggaaaaccatagcgatatctctatcttttggaacgacgtcgttcattaacttatcgcctatgtaaagttcaccctcggtgatttcttcaagaccggctatcattctaagtgttgtagacttaccgcagcctgaaggaccaacaaagattataaattctttatcttcgatttcaagattgaaatctttaacagctgtaaatcctcccgtatatgttttgtaaattcctctaagacttaaacttgccatttttaaatgacctcctgattttatatttgttctgaatcaatatgtatcacagaatttaactacctcattattctaacataattgtgagaataagaaaagggcgtatttcaccaaatttgaaattaagattttagtgattttgcatagctatttttaagacttaaatactttcgggtaaatatatacaaatttttgggtttcacttgatatattttgtctttgatagtataatgctaaacatgaaataaaatgctgtcgatttgctcacaatgcctatcagaagctgtttttaaaaatttatacggagttgatttcaatgataaaagtcggaatattaggcgctaccggatacgccggaattgaagttgtcagacttttgaccgcgcacccggaggcggaaatagtgagagtggtttcgcaaagttttgtggggcagaaaatctcggatgtttatcagaatttgaaggggatatgcgatttatgctgtactgcgctggatgttaacgatatagccggcagttgtgaccttgtcttcacagctttgcctcacggcgcttctaagaccgttattccgtcattgtatgaaaagggtttgaaaatcgtggatttgagcggcgatttcagatataacgacccggccgtctatgaaaagtggtatggagaacctcactcggcgcccgaggttttaaaggaatcggtttatggtctgtgcgaaattcatagagatgaaataaagacccatagactgataggtaatccgggctgttacacgacttgttctattatgggacttgcccctcttgccgcggccaagattgttgacacaaaaaatttgataattgacgcaaagtcaggagtgacaggagccgggcgaagtgcgagtctgcctaatatattctgtgaagtaaatgaatcgcttaaagcatacaaggtggccacccaccgccatacgtctgaaatagagcaggagctttcaatattatcaggcgcggatatagttctttcatttacaccgcatctcgttccgatgcagaggggtatttttgcaacttgttatgccaatcttactaaaaagatgacaacgggtgaagttttggatatttataaagaattttataagggtgaagaatttgtccgtatctatgacgaggggagcctgccggaaataaagcatatagccggctcaaactatgttggtataggagtggttgttgacccgcgtctgaaccgtgcggttgtagtgtcatgtatagataatctgattaaaggcgccgcagggcaagcagtccagaatatgaatttaatttgcggtattgatgagggaacaggacttagggcagctggaatgtatttataaagattgggggattagaaattggaagaacttataaaaaaggccggtatacttgttgaagccctgccttacatacaaaaattgaacggaaaaactgttgttatcaaatacggcggcaacgctatgataagtgaagaactgaaaaacaaggttatggaagatataaccttgctgaaatttataggcctgcacccggtgctggtacacggcggtggtcctgatatctcggagactttgacaaggtttggaattcaaagcgagtttgtaaacgggttaagagtcaccgatgacgagaccatgcgcgtggctcagatggtgcttatgggaaaaaccaataaggaaattgtttcgctgatttcacaaaaaggcggcaaagcattgggtctttcaggaattgacggagagctaattgaatgcgagaagcagtatgccaatgttgacggcaaaattgttgatatcggttatgttggaaagataattaagataaaccaaaaagttttggagtttttggctaacgacgactatatccccgtggttgctccgctgggagtggataaggaaggccgaagctataatataaacgctgatacagtggcaggcgcgatagccgccgcactaaaggcggaaaaacttatgcttttgacagacaccccgggaataaaaagctcgccgaccgctgatgatataatatatgaaattaaccaaaaagaaatatataagatgattgaagccggaaccattgccggcggtatgattccaaaggttaaaggcggacttgaagcattggcaggaggggtaaataatgtacatataattgacggacgtataccgcactgtctgctgcttgaaatatttacagacagcggtataggaaccatgataacccgataatacaagccgtatatgggagctgaatagagggatagtatgaaaaagatgttattagtatcaatgtttcagaacgttacaggtatactgaaaaaagtggaacctgaattaaagaataaaactgtgacatatatccctactgccagtaaggctgaaaagttaggtttttttgtaaaaatcggcaagtggacattgagacgattggggctgactgttgatgagctggatatatattccgcgtcttatgagactgccaaaagtaaactagaaaaaaatgatattatatatgttgccggcggcaatacgttctacttgttgcaggaattaaaaagaaccggaaccgataagttgttagccgatgaaataaacaaaggcaagctttacataggagagtcggcaggcgcaatacttacggcgccggatataggttattctgcagaaatggataatgtgggaaaagcgccggatctgaaagattattcaggacttaatgttgttgatttttatgttgtgccccattataaaaattgggagatggggaaagcggcacagataataattgataaatactcagaaagtttggatttaaaagttattaacgataaacaagctatatttattgacaatgacaaggtcaaaatattagacaaatagactgaccgcaaaggtgatcgccaaatgaaaatgcctgaagaaattgaaccatttatgtttgctccatgcggaatgaactgtaaagtttgttataagcacttggctcataaaaattcgtgcggcggatgtttgaaaattggttctgaaaagccgaaacactgccgtgtatgcaagatcaaggactgcgcaaagaataagggcgtaacatactgttttgaatgtgcaaattatccttgtaaacaggttaattatttggagcaaagctatataaaaaggtatgaggttagtttaatggaaaataccagattagttaaagaatgcgggatagaatactttatgcggcagcaaaagaataaatatacctgcgcaaagtgcggcggtataatttccttacatgataaagagtgcagtgagtgccgaaatagcggcggcaattagttgcagtacgtttctaaatggtaaagaaaagggaatgagatcatgtcagaaataaaagtcagcatagtaaatttaaaaaagcaaacagtatatggtctatggaaaaattcaaatgacagcacagtttcaaaagatataaagaatctttctaaaaaatatcatataaaggtgtcgtcgccgggcagtaaagtgttcccctatttagtgctgtcaaggaattataacgaactgagtaaggattttgaaatgtttgtgggaggcacaatagacaaaaaagggttagaatctttaactattccaaacggtgaatatgccaggataactataaaaccgaaactgggatttttgtggggattggctattggcgaagcaaagagatatttctataccaaatggctgcctaaaagccggtattcggcgctgaatatggaatatgaataccatactgagaagagtgatggaaagtctccggaaatagatatattttttgctgttaagagaaaataacagtaatgcttaacgccggaatagccgaacaataaccgcaaaggttttatagaaatagcacatttccgggaaaaagcgtctttggcagtcacgtcttgttttctcttagtccttgatacgcgcttcttatatattattgtccagcagcaaaacacggtaaatgggaagtgaaccatatctgttcctgttttttgaaaatattaaaatgcttttttatgtatattttcaatctgctattttctgttgcggcacagatatttataataaccgaaacgtgatactttttgaatcggtatacttttttgatattacacattttctaagattcctataaaactgaaattatatacatactttgcacttaaaaagatttgttttgtaatattaattctttatatttttgtagttttttaattcgtattcagcattacaaaagcgttttctatacctcaaaaaccgctttgactatgcttatcatatttgttaattcaacgatacgtaccgatattgttgattccaaatttttttactgtttcataaataatttttttgcctgtccgtacaatttttatagatgcagttttatattgtttgtcataaactgcttgttttataaaccggatcgaattttttaatcattctatactttctatactttgtaattagattattgtactatatcccaaataagtctttatactgcctaaaaaatttgaattatttcaaaagtgatgaacttttatttaggtgtacttttaatattcaacaatgaagacgagctgtcaggaacttacagcccgccttttgattatatctcgaaaataaaaatttaaataattttgcatatataaacccgagtgttcaggaaattaatctgtttacaaaaaataacgcgcttgagttgataaaatatataaataatatcattgagcgcctgattaatcaatgataaacatattattttaatgcgcgctgttataataattatagatttagcttatcaaatgctgctgcaaatggattgttggagtcgtcttcctttttgttttgattgcgaagataattctgcacatctcttttggaagcgccgctttgtcctctccgctccttgaaggcggagtatttttccctgtagccgcaggaacagtagaaactctttttttcaccgtcgcctctaagctccattttcttatgacattcaggacagcgtgcgtttgttattatgctaactgaacggcggtaaccgcagtccctatcctggcagaccagcacttttccttttttaccattgacctcaagcaaatattttccgcagtcaggacaggtctttttagtcatgttgtcatgtttgtattcggcgctgctgtttttaacggtcttaacaaggtcggcggaatacttttctatttcagcaataaatttttgcttttgggttttgccttttgagatcttttctaactcctgttcccacttagcggtgagcaggggttcttttaaatccggcggcaccaaatctataagctgaacgccttttgaagtaggaaccatgctgtttccctgcttttctacatagaatgaggagtataacttttctattatatcggctcttgtggccggggtcccgagacctccgcccaaatattctttcatatttttgtcgtttacaaaacgggagggattttccatagccgaaagcaatgttgcttccgtatatcgtgccggaggttttgtcttgcctgatttgacgaatgtgtttttgcagataaattcatcgctatacttcattttgggaagtatttgtttcctttcctgtgcgtcagcagtatcctcatcatcaaacgagtagtctgaggaatatactgctttccagccaagagaaacctcctctttgcccccggctgtaaacttttcacttccgcactcaaattcagctttgatttgtttatatttatacggacccataaaacaggccaaaaaccgtttgaccacaagattatatatacgcttttcttctgttgagagcgaaatcataggaaccttttgttcagttggtattatggcatggtgatctgagaccttgctgttatttatgcagcttttgttgatttttaatttcctgcggagtatatcttcagccgccgcctttgtatcgccgatggttacagcacgcagacgttcatttaacgtcggaactatatcgtcagtcaaatagcgtgaatcagttctagggtacgtcagtgccttatgctgttcatataatttttgcattatgttgagagtttgtttcggagagtaaccgtagagcttgtttgcgtctctttggagttcggtcaaatcgtataacatgggcgcatacgtctgtttgtcagagcttcttaaagatgtgagcttgaacggtttgcctttaatctctttggatattctttctgctttttcacggtcaaatgtagataatcccccgtctttgctgcgccaggaaacaaataatttgccgatatcggcttctattgtgtaatattccttaggaacaaatttctttatctcattttctctctgcactaatagtgcgagtgtaggagtttgtacacgtccggcggataactgagcattaaacttgcaggtaagggctctcgtaacatttaatccgacaagccagtcggcttcagcccttgcctgggccgccatatagagattataatactccttgccgtctcttagtttctgaaagccttcttttattgctttatcagtctgtgacgatatccaaagtctttttattggttttttaactccgcttttctcaattatccagcgggcaaccagctcgccttcacgcccggcgtcggttgcaataataacggagctgacctctgagcttcgcagctggcgttttacaatgctgtactgttttgaagtctgctttatgacctcgagtttcatctttcccggcagcatagggagcgtttccaggctccaggttttgtattcatctccgtaggcttccgggtcggccaaagtgaccaagtgaccgagagcccatgtcactatatatttgtctcctataaggcatccgtcagattttctgctgcactttaagacccgtgcaagttctcttccgacggatggtttttctgctaagacgagagttttagacatatgttttcctcctttatggggaattattgattgaaattttgtatcataaaattataccacaaaatttatattttgtacatagccggttaaattgacaatagagttaaaacggtgtagaataaataaaatacgagtataattatctattatgatgttaaatatttttataagagaattaggcaggaagggatgatataatatgaatatagaaaagtttgcatattatggtgataagaaaattaaaataaaagatgttccaacctcaagcaagccatatgatgtggagaaagaacggataattgacgaaaccgaaaaaatgaaacctcagatagaagacttgcaggagaaactctatgccgaagccaaagaggggcttataattattattcaggctatagacgcggccggtaaggacagcactattaaacatgtgatgagcggagtgaatccccagggcgtgtctgtaacagcgtttaaacagccctcatctgaggaacttgctcacggttttttgtggcgggcggaaaaagctgttcctagaagaggttatataggaattatgaaccgttcatactatgaggatgtgttggttgtaaaggtgcataatctgcaaaaaacttataaaatgcctaagcggtgcgtagatatgcccgccgcagatttctttaaaaaccgttataagcatattagaaattatgaggaatatctcagtgacaacggatatagggtaatcaaaatatttcttaatgtctcggctgaaaagcagaaggaacgtttcttagagcgaatagacaacccagcaaaaaattggaagttttctgctgatgatttatctgaaagagcgttgtgggacgagtatcaaaaggcctttgaggatatgataaacgaaaccgcaacaaaaacatcggaatggtatgtgctcccggctgatcagaaatggtttacaagatacttagtttcaaaaataatattaaagacgcttaaaaaaatgaaccctaagtatcctgaagtctccaaagaagataaagaggaacttgaggagtgcagaaacgaattattggctcaaaagtaagttcagaaatagtaataacaaaaccgcaccggaactgcagaatagtccggtgcggtttttatataatattttaaggcttgtttataactagtcgttaagatttttgtcaaggatttcaagctgtttcttaatgtcagccggaagtctgtctccaaactgagcaaagtattccttaatattctcaacgtcttctttccaaacttctttatcaacactgagcagagcgtcaagttcttcagcagaaatgccgaggcctgttgtgtcgatgtcagaagctgtgggaagcagaccgatagcactgtcatgggcgtcagccttgcctgaaacacggtcgagtatccaaagaagaactctcatgttatcgccgaatccgggccacataaagttgccttcatcgtcttttctaaaccaattaacgtggaatattgcaggagcattgtcaccgagctttttgcccatttcgagccaatgtccaaaataatcagccatgttgtatccaacgaatggtttcatagccatagggtcacgtcttacaacgcctacagcgccggcagcggcagcggtagtttcagaagccatagtagctcctacaaacacaccgtgttcccagtcgcgtgcttgatataccagcggagcagttttagcgcggcgtccgccgaatacaatagcagaaatcggaacgccctgtgggttttcaaactcagaagaaatacatggacagtttatagccggagctgtaaatcttgagttaggatgagcgaggttgccttcgtatgttgttccgtcaaccttttctcccagccagtttgtgcagttctttggaggattcttgtcaagaccttcccaccatactgtcaggtcgtcattgttaagagcaacatttgtgaaaatggtgttcttctttgtagattccaaagcattgaagtttgtcttttcgcttgttcccggagcaactccgaagaaacctgcttcaggattaatagcatagagctttccgtcttcaggattgattctcagccaagcgatatcgtcgccgactgtccaaaccttatatcctttttcctggagatattccggcggaataagcatagcgaggtttgtcttaccgcaagcgcttgggaatgcggcagcaatatacttaacttctccctgaggattttcaagaccaaggataagcatgtgttctgccatccagccttcttgctttccaagatatgaggcaattctcaaagcgaaacacttcttgccgagaagaacgtttccgccgtaagcagagttaactgacataatcgcattgtcctgcgggaagtgaacgatatatctttcttcaggattaacatcctttttagcgtgcagacattttacaaaatctccgtctgttccaagaacgtccataacttcctgaccgattcttgtcatgatattcatgttaagaacaacatagatactgtctgtaagctctataccgatttttgagaaaggtgagccgacaggtcccattgaataagggataatgtacattgttctgcccttcattgcgcctgtataaagagccttgagcttatcatacatctgacttggctccatccagttgttgattgggccggcttcttcttctgtcggagtacagataaatgttctgtcctcaacacgggcaacgtcgttttcagctgttctgtggtagtaacagcccggaagtttttcctcgttaagcttaataagctcgcctgttgatactgcctcagcgcggagagcctcaagctggctttcgcttccgtcaatccatacaacactttcaggctggcacatagcaatttgctcttccagccacttgtttactttttcattactgcactttgtaaattcagccatattcatcctcctaaaattcatactagtaatttaaaaatttaaacaaatttctagttagtttattttatcacaattctacctcaaatatttggctctgtcaaatagatttttacaaccattgatacatctttcacaatatctacagtcgtgatagttcttgaaaaaaatagctgaaaattttgtgaactttgcttaaaagaaaatgctacaaatttagtaggaaatcatttgatataaaatttatcttcataaacactttgtttaaatatttttttgtgaaataacaattttgataaattcaacttacatataaattgaaaaaataaatagagctgtatataacaaacatcggcagggtgaccgaaggtcagcgcgttaggtgcgtagtcgcggaatagcagctaacaaattaaaatcaccgttaacctatgtccgtatagtttgccttataaactgaaaaatacggaccgacggaatttgccaagagcagtttcgcgaaagtggtatgaataatattttaaataataaaagaaagataaatataaaatacatataaattaaaaagtaaatagagctgtatttaacaaacatcggcagggcgaccgaaggtcagcgcgttaggtgcgtagccgcggaatagcagctaacaaattaaaatcaccggtaacctatgtccgtatagtttgccttataaactaaaaaatacggaccgacggaatttgtcaagagtggtttcgcgagaatggtatgaataatattttaaataataaaagaaagataaatataaaatacatataaattaaaaagtaaatagagctgtatttaacaaacatcggcagggcgaccgaaggttaccgcgttaggtgcgtagccgcggagatgcaaaaaataaataaacataactctaaattaacacaaatcaattgaattcattaaccaaatagatgtgtgctgctgtaaaacacaaaatttgatttataaatttatagttattcttttatttaagagattttatgaacttataagttatttaaactaaatgtataacagataaacatgacatttatggatatataaattattgtttaagtaaaaaacagaccgaaacgatttcggtctgtatctaattaatctttatctattaaagcaaaggaaatttcaccttttgccgctacttcatcgccgacataagcgcaaacgtcagctttgcccattactgaacggaactttgtgagttctacctcaagtcttaacgtctcgcctggcaccacttgatgtttaaatttaaaattatttattccggtaaacacagccagcttgtttttaaattccggtttgctcagtataacaacagcgccaacctgggcgagagcctcacaaatcaaaactccgggcataattggattccctggaaaatgtccctgaaagaacggctcgttcatagtaacatttttaagtccaacagctcgggaaccttcctcaaactctactattttgtcaataagcaaaaatggatatctatgtgggattatatccattatttctttaatattaagttccatataataatacctccagaaatttttatgctaatattataactcaacaaaaaatattttacaataagtattttggtatagaaatataaaaataaaataacattttaatataccgaccgcgcagcttgccttacgagccgcaaagcggactgctgcagcccgcctttgtgttaggataagaaaatactattaaatcaccttataaaatttaatataaatagtgacttaaattatatgtagataaattaaataccttggaaaatattttttatatttaatatgatgtagagttttatgcacagttgatagttgcagaaaaaaatctgtcaaatgttataagatatgtaaattttttaatttttaaaaaaattttttcaaaaaagtattgacaagctattctaaatatgttatcatagtcaggtcgttaacgcgagacagcataaacggcgctaattaaacatggaggggttcccgagtggccaaagggggcagactgtaaatctgttgcatcttgcttcgatggttcgaatccatctccctccaccacaacggagcaaagttcgctttgctccgtttttgtatagaaaaaataagaaatgtcttatatatttttaagtgaaactgtctctgtcaccgttatttttctcagttgtggctattgccgcgcaatacacagctttggcgccggaaagttttaacactcttgcacattcattgaatgttgcgcctgtggtcgtaacatcatcaataaccaggatggttttgcctttaatattatcgctgtttcctttgagaccgaaagctccgttcagattttgctgtctttcaaagctagaaagctctgtttgtttactggtttgtctgattcgtttaaaaaggtttggataatattttacactgagcagtttggcagtcttttttgccagcgcaccgctttggtcaaaccctatttctttcatacgctggcgccgcggcggtatagctgtgatatagtcaaagttgacgccgccaaaatcatttttaaccattgctgttattaaatttgaaaatgtgttcactgaacttaggcttcgggcgtgtttgagattaattattcctcttttggaatttcggtcatattccacagcagcagtaataccattataataggtgcatatatctgacttagcttttctaaaacaactttggcagaggcggtaacgagggtttccaagcggcgtgccgcagactttgcagcgcttgcggctggcacagaattttatcttatccatacattcactgcatatattaatgctggatttttgaaaacttattaattttccgcagaagctgcatttagatggataaacaagatttacaaggcgtctcaaaatattcatagactatgatacctttcgcatataataattaattttacattatatgacataattttgcaagatatatcaaaaatttggcgttaaactaatctaggcgtgatttatttatgacaggaggacaggatttgatagaatttattacaaaaatagattttgcggttttggaatttattcgaaacacattaaacagttcttttatggattacatcatgcctattataaccgattttggttccggaggactgctttggattgcggtgggagtcataatgttatgcactgaaaaatatcgaagatgcggggcttcggttttgattggactgctgctgtgcttggttttgggaaacatcattttaaaaccgcttatcggcagaatgagaccctgctggataaatgacagtatagatatgcttgttaggattcccagggactactccttcccgtcaggacataccctggctgtttttacaacggcgtttataatttttggatattcaaaaaagataggaataccgcttgtagttttagcgtgcttaattggattttcaagaatgtatttatatgtccattaccctactgatgtattgggcggcatagcattagccgctctcattgcgtgggcagttagaaaatttgttaacgggacagtattcagccggatgtttcggaggtttgaagactagaagtttcggttataaaaacttaataattttttatataatatttataaaatcatgacagaacagagttgttttttaaaatcttatataatataataaaaagagtgactttttgaagtttataatttacagataaagcggtttaacttacgattgaggagaggattttttggaaaaaacagaagcaactaaagttgaaacaaaaggcggttcaaaaggaagccattttatgcagggggctttagttttgggtatagccagcctgattgtaaaaataataggcgcagtattcaaaatacctcttattaatttgattggcgatgacggaagcggttattttaatgtggcgtatcaaatatacacgtttatgtttatagtcgctacggccggatttccgatagctatatcaaaaatggttgcagagagtatggctagaaatgatgaaactgatgccaaaagagtatttcagacggcgatttcatttttggctgttataggattggccggcagtataattctatttgtttttgcaaaacagctggcaggtttggttggaattccggatgcagagcttggtataaaagctatttcgccggcagttttctttgtatctttggcgtcgtcaatgagaggctattttcaaggcagacaaaatatgttcccaaccgcaggttctgaagtaatagagtccagcggtaagatggttataggcttgctcatggcgtcgttctttatggggatgactattgttccgaatttggacaaggtgatagattttgtaacacgccaggtagacaccgcccatatgcgtacagtttatgcgtctgccggagccatttttggtgtgactgccggaactcttttgtcgttcctgttactgtcagtaatatacatatgcttggctataggtgcaaagcggcatgctaaaaatattgcgccgatgacagcggcccaggaaaagctgagaccgaaaagaaccattttaaaagaactgataatgatagcaataccaataactataggggcgtctgtttcaagtcttacaactcttatagatatgacaacaataagccgtaggctggttactaatccgaacgtgtttaacgagtacgcatttatgtttgaacaagggacgtcattctatgataaggccgttggagcaggatggaccggtgcggtgctcgattcacagaaagcctcaactctttatggaatgtacacgggaaaagctctgactatgtttaacctgccgttaaccttggttgtggctctgggaatgagtatagttcctgcaatttcatcagctttggctagagccagaaaaggcgaggcaggaagcatcactgagagcgctataagaattgccatgttgttcggtgcgccgtgcgctataggaatgtcggtgctgtccagcggtgttttaggtctgttgtttagtgacgacaatgcgcatgtggttttaagcattttgtcaatagcaataataccggttgccgtagtacaagtcacaaatgcaatactgcagtcatacggaaaagtctattatccggttgtaaatatgttgataggcggagccgccaaggtaattttcaactatatagcaatcccgtacttaggtattgacggagcgcctataggaacttttatctgttatttaatcatagcggtgcttaataccgttcagatagtacgtattgcagacataagatttaaacctattgatatacttataaaaccattgattgcggccggcgttatgggtgtatgcggatactttttatccggtattctgccaacttcaagagttctcactgttttagaaattcttatttgcggaataatatatgtaataatgattttcgctgttcgggctataaaacgtgaggatattatgaatatgcctaagggcgaaaaaatagccggtatactagaaaagtttaaactgataaaataattggagctgaagaggatgaattttaaagatacgaaagataaatatacgtttgatgacctggttgaaattgtttcacttttgcgtgcaccgggcggctgtccctgggatagggagcagactcatcagagtataaagaaaaatcttattgaagaagggtatgaactgattgaggcaattgacggcgggaatcctgaaaaaatagccgacgagagcggggatttactgctgcaggtagtgtttcatgcaataatcgggaaagacagcggagaatatgaaataaatgacgttaccgacgctatctgccgaaaacttattcacagacatccgcatgtgtttggtgaagtcgaagtagcggacagcggagaggttcttaaaaactgggacgctataaaacgtgctgacagggagcagagcagcattgctgaggaactgcgcggagtatcaaaatatctgccggcgcttatgcgagctgagaaaattcagaaaaaggccgaaaaggccggttataagtttgaaaatgagataaatttgtctgtaatttcggatgatgtagccgaagcagaaagtgcaccggagagggactgcggtcagctcctgtttgcggcggtaaacttttgccgcagagccggtgtggatccggaattggctctcgcttcttatactgagagtttcacagatgaatttgagaagtttgagaatagagaaaattaaatctatttgaaaaaacactaaggagaaaattgtaatgcgtttggataaatttttaaaggtgtccaggataatcaagcgccggacggtggctaatgacgcctgcgacgggggccgcgtttccgtaaacggacgcactgtcaaagcgtcatatgacgtgaagcccggagatgaaataaaaatattatttggtgaaaaacctttgaatataagggtcttaaatgtaaaagagaatgtaaaaaaggatgaagccagagagctgtatgaaatagtttaaattttacagataataaatatattgcgaaaaataattctgtctgtgtctgtcgggcagtattgggtttgacgaattaaaacaacttgtcgagtaaatacatgctgtttatatacctaagcggccgccgttaaagaccaaaaattattagttaaaacagctcattataggattaagctgtatctagcaaaaacctaatgggtttagttgatacatctgtttataaaactaagtagcagttggcagaaatataaatggacgtttttatgagttttttccgttcttatacaagttgggtgcaccttccgcagtatgatgaatacctacaattttatgttttttatttatttaaaaactataggacaggaatatagcgagcatcggcaggccgcttttgcggcacgtaaggcgagctgagcggacagtatataaaggtacaattttatataggatgctatcccacgcctacgcacctcatatagtggtatgcgaccaatttgagtattcatattattgacactgcagttacaataaaacaggttaatatggtttatctccactttctaaaaaaagtgggggtcacatctaccgaagtttaataatacattaattttatatttttaatattcaaagctatttataattagtattgaactaaagacaggaatatagcgagcatcgacaggccgcttttgcggcacgtaagtcgagctgagcggatagtatataaagatacaattttaaaaagatacttaaggcggaaatttatatatcgttttaaataatatgtccatactacggtatgatgtttctacttatatacagcaaatgcgctgtaatattttgctcgaagcagaagacatatatattgataattaaaacgttattattgctaaaatctgataaactttgcaatgtgcatttcgtttagtgtgctgaaaaaattgtcgtcaggcaaaaaattacttgacaaaggtctcacagcgtagtataatctatcccgtagacagcaaaggcgctgtgagtattttgctcgcagcgccttattttttatttagtcatttctatttacttttaaaaagaaaggaatgttttgttatggatcaaatgaacgagttattcggcagtgccgtatttgaagactcggtgcaaaaggtcagacttcctgatggaatttacaaacagcttaggaagaccaaagaggagggcacgcctcttacgcgtgaggttgctgatgttgttgccaatgcaatgaaggactgggcggtagaaaatggtgtaacccattttactcactggttccagcctatgactggcgttacagctgagaagcacgacagctttatacagcctgacggtatcgacagcgtgattatggagttcagcggaaaagaattgattaaaggcgagccggacgcttccagttttccatcgggaggtctgcgttcaacttttgaggcaagaggatataccgcgtgggatccaacatcaaacgcctttattaaagacggtatactgtgtattccaactgtattctgttcttatacaggcgaagcgcttgataaaaagacgccgcttatgcgttcaatggaagctctcagtaactcggctgtcagggttcttcacctgataggggaaactgacgtaaacagagttataacgacagtcggtcctgaacaggagtattttttaatagaccgaaaggtagctttaaagagaaaagatattacatatacgggcagaactttgttcggaactccggctccaaaaggacaggagcttgacgaccattattttggagtggttaagagaagagtttcagagtatatgaaggatttggacgaggaactctggaagctgggtatacttgcaaagacaaaacataatgaagtggcaccggcacagcatgaactcgctcctatttttacacaagctaatatagccactgaccataatcagcttactatggagataatgaaaaaggttgctgaaagacatggtatgaaatgcctgctctacgaaaagccttttgaaggaataaacggaagcggcaagcataacaactggtcgatttcgacagacaagggcgaaaacttgctgaaacccggcaagacccctcatgacaatcctagatttttattgttcctgtccgctgtgatagcggctgtggacgaatatcaggatcttttaagatcgtctgtggcaacggcaggaaatgaccacagacttggcgcaaatgaggctccgcctgctattatctctgtatttattggagatgatctcaaagaagtgctggattctattgaagaggacagtgattttgagaacagatgtaatgaggtgatgaactccggtatcgacgctgtgcctgattttgcgaaggatacaaccgacagaaacagaacgtcgccgtttgcattcacagggaataagtttgagtttagaatgcccggctcggctctttcaatttcaggaccgaactttattataaacacagctgttgccgagatacttgaccagtttgctgtcagacttgagaaatcgtcaaaccctaaatgcgagatttataacatagtaagagatactatgaaagaacataaaaggattatttttaacggtaataactattcagacgaatgggttgccgaagctgaacgcaggggtctttgcaatttaaagagcacgcctgaagcattgccggcttttgttactgaaaagagtatagacttatttgttaagcacggtatactcacccgtgatgaaatgctgtcaagatacgagataaatcttgagaattacagcaaggctatcaatattgaggcaaagacgatgcttgaaatggcaagacgcgatatttcgcctgctgtcgcgaaatatgttaaagaactcagcgatactgttgtttctaagagacaaatgggcggttcggtttcttgcgtgtttgaagaaaagatgattagattgctttctgagttagaacttagactgtttgaaacggttgaagctcttgattcaagcgttcaggaagcccttgctatggaagaaggtttggagcaggctgtattttataatgaaaaagtgttgaaagatatggctgaggttcgggaagtagcagaccaaatggagatttatactcctgaagaatactggccgttcccaacctatggagatttgctgttctctatccaggagtaatatagcattccggcaaaatatttctaagttataggttttaaaaagtaaataataagataatagacaatggggtctgagagtaattttctcaggccccattttcttttatatatatacggcgaaacagccggaattaaaaataaggaggaaaaagttatgaacattatggatttggcaacgggtttagatactgcgtgggtgctgctgggagcagctttggtattctttatgcaggcagggttcgctatggtcgaaaccggtttcacaagagcaaaaaacgcgggtaatataattatgaaaaatctgatggattttagtttaggaaccccaattttttggattttaggttttggaattatgtttggcgcaaatgtctttggcggctggctgtcggttccgtcatttttccagggagcaaacgctttgcccggtgattataattttgcaactttaatatttcaaacagtattttgcgccaccgcggcgaccattgtttcgggagcaatggcagagagaaccaaattttccgcatatattgtttacagtatggttataagcgcagtgatttatcctgtttcaggacattgggtttggggcggcggatggctcagtgaattaggttttcatgactttgcgggttccacagcagtacatatggttggcggagtggccgctctggtaggcgcaaaaattcttggtccacgtataggaaaatataaaaaggacgggacatccgtcgcaatacccgggcattcgttaactttgggggctctcggagtatttatactttggttctgctggtttggatttaacggatgttcaacagtagctatgtcagatacagagagttcgtcgttggcggcttcggtttttgtaacgactaatcttgccgctgcctgtgctacagttgctactatggttgttacatgggttagatataaaaagcctgatgtttctatgactctaaacggcgctttagccggtcttgttgcgattacggctggctgtgacagtgttacgccgctcggagcggccgtaattggtactgtggcaggtattttggttgtgtttgctgtggagtttattgacaagaaacttaagatagacgatccggttggagctgtggccgttcatgggtgctgcggagctgccgggacaataatgacgggtttgtttgcagcaaaaggcggtttattttacgggggcggtttcagctttttaggtattcagacattaggagttataacagtaatagcgtgggtcgctgtaacgatgaccattgtatttctaattattaagcatactatggggcttagagcgagtgctgaagaagaaatagaagggcttgatatacatgaacatggcctagcctcttcttatgcggactttatgccaaatgtgccgactattttgacaggaagatcagagacagtgggacaggaaactcccgaatctgctgtgccgataattagagtgccggataatacggaaaagaaagttgataaggacggtcatactattacaaaaataacggtggtgtgtaaagaatctaagtttgaagctctaaagcacgctttaaatgaaatcggagtaacaggaatgactctcacgcatgtgctcggctgcggaatgcagaaaggcagcagtgagtattaccgcggcgtacctgttgaggctaatcttctgcctaaaataaaagtggatatagttgtgtgcagagtacctgtatcagatgttattaaagccgctgttaaaatactttatactggacatatcggagatggaaaaatttttgtttatgacgtacgggatgtggtcaaagtcagaactggagaatcaggatatgacgcaatgacggatgatggagaaaattgttgagtttagaatgggtttaaggttaggtgaaataaggagcgggcgtaatgcccgcccctctttttattcatcagacagcatcttttttctattcattccgtctataactccctgacggtaagacgctttgcattcttcaatcatcataaggttattattttctataaatttaatgacgtttttacattcttcttcgctaagtttttgaggaataaagcgttctaatacctgtctaacagcttcggaggagcttttgtaaatctcctgctcgtggattaagtcattatatttttgactgtttttttgatgatagtacagaatgtcatagatgtactcctgaaggtcactatcaaagtaattctcaaaaaatttagatgcgttttcttccgacacaaaaatctcccttttcaattaaaattctttttatattatatacaaagtttgtcaggtatatacatcacccccaaaaaggaaacacttgagtgtttcttttaaatttattccttgacacatgtatatttttttcacacaatactttattatataataaaataaataaacattacagtaaaatttagatatttaaataaaatgtaaataatcacctatgaatattattttattataaaagcttactttattaagacgatttttatttaaaaaagttttacattaaaaaaataataagaaataaattaaacaaaaaaattgcaattaaaaacctgccggaaactccggcaggtaataaagatcccctattttttttgcgtaagtgcgaaaacatccttagatttgcctattacaacaagatggtcgcttggctggaatatatattcaggggtaggcaatggctttagaatgttttcctgttttattcctattacatttacttcatacttttgtcttatattaagcgaatttatgcttctgccgatccatgaagggacaacaggtatttcgtatattgagtattcgcttgtcagtttaatatagtcaaaaatattgtttgcgttatagcgcatagccagtttttctgcaatctccttctcagggtacactacctcattcgcgcctaccaattttaagaacttagcctgtctgtcctcgcgtgcctttgaaactatatagtttgcccccaggtctttgagcatagatgttatttccagtgaagcctgaaaatcttctccgatagccacaaaacacaggtcaaaattgtttattcccaaagcccgaagaacgccttcctgccggcagtcgccgatttgtgaatcagtgaatattgaagaaaactgctcgatagtcgaatcatctttatcaactatcataacatcattaccaagcgccagcattttggttgcaaaatgcctgcctaaacgtcccattccaattaccaatatagatttcataatcagacctccaaaacttatataaaaacttattatcctattaatatatcttcaacaggccgcataagagccacaggctctctgttttcggcaagcaccagcatgagagacagtccgcctaccctgccggcaaacatcagcactatcagtattgactgggacacaacagacagcgacggggtgagtcccattgaaagcccgactgttccgattgcggaactgacttcgaacagtatttgtcttattgtatatggctctattgagcaaataataaaagttgataccaaaacagccgttaaatagattgatgatatagcgctggctcttttcagtgtgtcgtcgctgagacggcgtttaaagattacaacgttattgtttttccttgatgatgcaaacgccataagaaataaaacaacaaaagttgtagtcttgatacctccggctgttgaaccggggcttcctcctatcagcataagcacggttgtaagcagagaactgctctctgagagcgaggataagtcagtagtgttaaatccggcagttctgggtgtaaccgcttgaaaaaatgagtgcagccatttatcagcagtggataatcctgcaaaatttttattcttttccaaaataaagaacagcaccgtagaactgattaacaaaaccgcagttattgagagcacaatttttgtgtgcagcgaatagtgtttaaagtcgagcttagcctttattatattattccaaaccataaatcccaggccgccgataacaataagaccgcagattgtcagattaacaaccggatcgctttgataatgtatgagggaagagttaggttcaaattttcccataaggtcaaaaccggcgttgcaaaatgccgagattgagtggaagatagcgttgtatataccttctaaaaaccccatctcaggacaaaatcttgttgccagcaaaatcgctcctgcgctctcaaatattaatgttccgaaaaaaatacgtctgacaagctgtatcattccgctgagtttagtatttccggcggactgcatcaataattttctctcgtgaagagaaattctccggcccataaatatagaaaccgttgtaataacggacataaatcccaaaccgccgatttgtatcattaaaagaataaccagctgaccgaaaacagaccagtgcgtatatgtgtcaaatagaactaagccggtgacgcatgtggcgctggtagccgtaaacagcgagtcaaaataagacgtccaggtgttatcttttgaggaaataggcagtgaaagtaatcctgccccgactactatgataaccaaaaaaccaaaagcaattatttgggtataggttgccttatgtttttgtaatgtcctattgttagatgacagctcaaaatcaggagcttccataatattttcctcctatattaccaatgcagcataaaaatgctgttaaaatttgtcggcgcttataaaaaattcacagccgacgggagcaacgtcgatttctattatactatctctgacaggcactatttcaggatttgatatgccgtgagagaaaaatgaaaaatcaccaaactctgaaatgtcaatatcaatatgtttggattcaaagctccggtttacagcgcaaattgccaaactgtttttacagcagtttccaaatgcgttctttccattttttgtgaaacgggcgtatatatataggtcgccgcttgcataaactgttttataatatccaagcgtcaaacagtcggaattgtttcgcagtgcgccaaggtcagtataccactgtctgaggtcagggtcaatagcccgccacggataagttcctctgttaaacgggtcgctgccgccctgcattcctacttcgtcaccataatatatacatggaacgcccacaaatgtcatctgtacaaaagacagcatttttagccgataggttgcgagttcttcgtttcctgaggacaatttctgtgttccgcagtcctgcgaaagaccgccgagcagagtttttatacgcattgtgtcgtgagttccgattatattcatcagggagtacagcgtctcttttggataattctcaaaaatagacataaaatgcgcgttcaggcattcagcgtctatgtttcctaagagaaatgcaatcatattatccttaaacggatagttcattacactgtcgagctcttttcctaaaagatactcgcggcgaatactgtaggagactttattagacgcgtcttcccaaacctcgcctattataaccgcgtcagggtcttgtttttttacttcccggcgcagaattttaataaattcatccggcagttcatcggctacgtcaagtctccagccgctggcgccgcgtttaagccaggtctttataacagaatcctcatctcttaatatataatcaaggtatgaaggagtcatttcgtttacgttgggcaggttactgcagccccaccagctttcgtaattgggatagttagtaaattggtaccattctttatattgactttgtggatttttgtatgctccggtattattaccataattgccatacttgttaaaatatatgctgtcagcgcctgtatggctgaatacgccgtcgagaataactctgattccaagtttttccgcctcatcgcacagagctgtaaatttttcgtttgttccgaacatcgggtctatattcatataatctgcagtatcatacttgtggttggaatacgcgtcaaatattgggtttagatatataacgccaacacccaaactttttaagtattttagtttgtctattataccgcttaaattcccgccgtaaaaatcgttgcaggcaggccccatttcgaaaggatgggcgttaaatgagattggctcataccagtcgctgtgtattatatactcgtttcgctttttgggtataactccatttgtgtcactgtggtctccgaaaaacctgtcagtgaaaatctgatacattatttgacctttaaaccagtcaggtgttttgtagtccttatcgtaaacagttatctgatagctgttatttgccggctcggtctgcgtctgtccgactcctcccaaagaatcattattatttatatagtaaacggcttttcctcctgtctcaactataaaataataccataccaaaccttctttttcaggcataggaactgttgcggtataatagaactcgttttctgcagtattttcactgcctgatgacgaaagggactgtttttggttttccctgctgttcttaggcgccatatcataaaatatttcttcctcgttttcccaaaaccgaattttaactgcgtcaggctgagtatcagaaattatctttaaagcaagtttaactttactgccggtagctgcggcgccaaatggcattctataagctgtatcatgtgagttgtgaaaaagctgcatactatattcctccaaatttctacaatgctgtttccttaatatattatatatattataggttactacacaaacaggtattatacaacagattcttttaaaattcaaatacaaaaatataacaattgaaactattgtcactatgtgctataattaaggaaaaaatttggaggttttaatgaaatatattatatttgatatggacggggttatagtgaattccgaacctgtcattatgaaagcggcgcttgacgctcttaagaacggtggaatagaagcatctgaagaagattttataccctatatcggagccggcgaagagcattttataattgagccgtgcaaaagggcaaataaagcggaactgacagaaaaaataatggatgatatgtttagaaattttgaacaaaacatcaaagaaatgaaggttttcccatcagcaaagccgcttatcgaaaaactgaaaaatttgggatacacgctggcgcttgtgagcagcgccgcagaaagaaagcttgtggcctcgctaaaagccgccgaaattgacccgtcggtttttacggttatactttcaggaaatgatgtgacggagaagaaaccgtctcctgcaccttatttgcttgcggccgataagctgggcgctgacccagctgagtgcttggttatcgaggacgctttaagcggagtaaaatcggcaaaggctgcaggaatgcagtgcgccgcggtcacaacctcatttagtgaagagaagttaaaatcggccggagcggattatgtgactagagatataatagatatattaagtttactgaacggataaaagggtgattttgtgtttaaaacagtgtatggaacggctcgtgcggacagcggcggttatttgtttgaaagcgtcagggcgaatataaaaaatggaataaagtcatatctgctcgttccggagcagttttctgtttttaccgaacgcaaagttatagaaactttgggcgttaaggctcagactttggcggaagtgttgaccttttcaaggctttcgaatcttgtgctcagcagcctggggcctctcagactgagatacatagacggagcaggcagagaaattcttgctggcagagctttgcagcttatagaaaataaactgcagtattttaaatcaaatgttcatcagagaggattttcaagtctgatggcggggcttgtgtcggagtttaaacggtatggtctgagttttgaaagtctgcagactgtttccgaaaaggtagagaaagatgagtttaaacgaaagctggaagacttggctttgttttatgatacatacagcagattaatcaacgaaaataattctgacgcggaggataatctgtcaataatactccctaaaataaaagactttgaaattgaaacggactcgtgtctgtttataaccgaatttaagagttttacgcctctggagtgtcaagtgctgcaggaactgatgaagaagatgagtaacacagttctgtttttaagatgcgatgaccttgttcatccggacggtattttcagttcggcgtctttgacatacaaacagcttgcggaagccgctgaagcgtgcgggattgaggtcagcaagcctgagattttgccggtcaaagacggcggaaaatctgaccttatatttttgcaggacaactattttaatataaaccctgaaaaatatgacggaagcccggaaaatatctttatatattctccggaaaatcattttgacgaggtggaacagaccgcgtcaattatacatagactgtgcaggattaaaggctataagcaaagcgactttttgatattggcaagggatacagatgtgtattcaagaatcatgcctctcgtatttgataaactcggtataaatgtgtttttagacaagcggcgcagcattcttgaaaatccatatttaagatgtatttcaagcatgcttgaaatacttgcctatgggttttcttatgacagggttatggaaatagggcggagcggattcgccggagtcagcaatgaagaagagctggatgtctttgaaaattatctgctttctgtcaaccccagccacgcgatgtggaatgatgaaaatgagtggacgtataatccagataagcgcgcttatgatattgatagtataaaccgaataaaaagcgtgattttagctccgatttttgagttgaaacattcaataaggggacgtaaaaaggccagtgaaattaccgaagcggtttttaagtatatggaaagatgccgtcatcaagagataatgcgtgatatatgcaaagactattcggacaagggcatgatatatcttgccgaagaatataggcgcacatggaacagcgtggtgtcggtgcttgacagaatctctgaaattatgggcggtgagcttataacgtatgagaagttttatgatttgtttatatcggcctgcggcggaataaaaataggaatatctcctcagacgattgacggcgcagtgttcagcaaaatagatatgttcagaaacactgatgcgaaggtggttatagtccttggggtaacagacggtgttttccctagaggttatggaaacgagggtatactgacggatgcggagagagaagcgctgagggaatacggcattgatttggcaatgacagcgtcagaaaagtcgcatgacgagcagcttttggtatataatgttttatcatccccatctgacgaattatatttgcttgctccaaagtcctctgacgatggagaaagtcttttcccgtctaaaattataaccaaaattgagaatgagctttttgatatggaaagagaaaatgtgaatgacgatagcggtgagctgccggagggtaaagaaccggtatttttggcgcttgaatccgaatttatcagatgctgcggagatgtaggcaaatttgcaccaaagtggcgtgcagtctatgatttttatgctgaggatgaaaagtacggcgcacggctcgctgactttgcagagaggttgaaagccgccgaaagcggttatgaaatactgtccaaaaattcggtcgcaaaactgtacggcagagaaataatgctgagcgcttccaaaatggaaaagtataacagctgtgctttctcttattttatgagatatggtctgctggctaaaccaagagatattgcggtttttgatccgctgagtatgggtgatatactccataaatctttggaacgctttttctcctcaaaaaatgacgttgactatgagtcaataacacgggaacagtgcgagaccgaaatgcggaatatagtgagcgaaatagccacgggaaacgaagaggttatgtataaaaattcagcttactataagtatttggttatgcgtatgaccggtatcgcctcaacaaccgcgtgggaaacggtgaaatttttcagggaatccgaattccgtccatatggctttgaaataagaattggtgaaaacggcgatattccgccgcttaaagtcgaaacaaaaaacggaacagcctatgtggaaggttttattgacagggcggacagcgcagtaatcggtggaaaacgatatatcagcgtggtggattataagtcgtcggctaagaaactggacaaagaactggctgacgccggagtgagatttcagcctcttgtgtatacaaacgctgtctgtgagcagagtgaaaccgagcctgcggctatgctttatctgcagatgaacgatcctataatagacgaatctaaagcagcgacggacgaagcttttgaaaccgaggttcacagaaacgtcagcgcaaacggttgggttgtggacgatggagaggtaaataaagcgtttgataagaactatggcagcaagaaatgttatatgtcaccgaaatgcggaataccgccggatgaaatgcaaaaacggctcaaaagagccgaagaaaaaattgtagagtcagccgaaggtatactggccggagagatttcggtcagtccgtacaaaaaaagagggtttgacccatgtgcttattgcgattacagcggaatatgcggaaaaaataatagttaaaatatgcgggcggtttggcatatctttatgagccgaatctgctcgctttttgctgaataatatttgcaaactttatttcgctcaagtataccctgcggaaacaattgagtaatttcagtgtaatatacctgtaataaatttagggatgtttcacaaattttcagtagcggcatacgtttttactgaagcttaatgtaaacattacaaaaatattgctaaaattattttttgtggacaaatgattattggctagaattaggattgactttttaatcaaaaggttgtttaatagagatacaaaaaataaaatcatcaagtttgaaagacaggtaaacctgtcaggatagtacaggagggaagacagttatgaaagaattttcgtacactatcacaaacgagtatgatttagctgctaagccggcgtttgacttgataaagcttgccggagagcatgattgccgcacgtatgtcgtaaagaacgaccatgcgaccgatattaaaaagctatttattctgctcagtatcggaacaaaatgcggagatactataaagtttgtgacagacggcgttgacgagaagtccgctattgataaaatcggaaaatatgtttcctgcaatatgtaggtcaatcttttagataataaaatcagcttaaatcatacaaacttgccggttccgtgtttcggaaccggctaattttttataaaaaaagaccgccgcttaaagcggcagtctggcaatattttatttaattatgcctgaggagcgtcaaccggacatacgtttgcgcagttaccgcagtcaatacattcgtcagcattgatttcatattttgcatcgccttcagagatacatgaaaccggacattcgctagcacatacaccgcattttatgcagtcatcattgatttgataagccattatagtcacctctctatgtaaaattcaaatttattcttactcttgcattatatatcatcaaaggttttttgtcaagatttaattaagatttaagacattattttacaggttttttatagcgtctgtaatgctcttttccattgctaactttccatatttgtcaacttctgttttattcttaggtccgtgggtcagacagccagctccgccgatacagccccccacgcaggccataccctcaataaagttgatgtttcctattccctttgacgctttaagcagcgctgtacggcattcgtcaataccgtcgcatgaaacggcgtggagttcaaagtctccgttgccctgctccttgagtgcttcttgaacggcctcggcaagaccgccgcagcgggcaaatatcctgccgtaatatgatgcgttgttgagctctgattcctcaagttcagtcaggtctatctcacgcgcgtcaaataacgcctgcagttcttcgaatgtcagagcgctgtcaacatactcttttataccgtcttttctgatttccgctttctttgcagtgcatgggccaataaatacaaccttgcagtcagggtcgttctttttgatatacttggctatagccgccataggtgacggattgtgtgaaatgttctctttaagcatcgggaagtttttctccacaaattctacaaaggccggacagcaggaacttgttaaaaatcccttctccgctaattctttagcttcatcataagctaccatatcagcgcccaaagccgcttctacaacattatggaagcccagcctcttgattccggtaaccacttgaccaagcttaatattagcatatgagaactgacccgaaatagaaggagccacaaccgcataaagctttaccttgtcgtcgttggcgtattttttcagcatctccacaacttcaactatgtaggatttgtcagttatcgcgccccatgggcattgatatacgcaggctccgcagttgatacatttgctgtcgtcaataacagccgaatgctcctcgttcatgcttatcgccttgaccttgcaggctttaacgcatggtctttcggtgtgtataatagcgctgtacgggcaaactttagcgcacattccgcactgcacacatttgtctttgtcgatatgcgctttctgattttcgtcaaaggtgatagctccgcgtttgcacacgtcctcgcacctatgagccaaacagccgcggcacatgtgtgtaacttcgtagccggcaacaggacactcgtcgcaggcaatgtccagaacctcaattatgttgtcaacatttttatgtccgcctccggccataccgattctctcgcccactatagctctttccttgtaaatacagcagcgcattgtggctttgtcctttacaatagttttggctatgtcgttaaagctggtgactaggttgtcgtcgtcatatgtatgtcttgccacctcacgaagaaccttatattttaagtattgaaccttagtatcaaattttttgagtataggtttgttttggttgttcatatataatcctcccgtttttactcggctgatactgattttagccggataataaatctatatatctaaaaataattaacagtcacggtttttcccatgtcttctaaacattgtctcagttcgtcgactattttaagttttatgctgaaagaaatatttaaatttgcgtcctgatgggcgtcgttctgagccttgccgacaaacaggtttatgtcggttgcttctttaaacaggagccgggctatttcgctcgctccgtccttttgttttccccatttttcaaatagggaattgtcttcaagataattttttgcgtaatccaaaaccctggctatcgttataactccttcagtcactaagtccacaccctcgattgaggctgtcggtggaatagaagggtcgctgtagtcaggagcggccactatttctttgcccaaataccgggccgtaattttagaggtcgtgccgccgcataccacatgccgcccctgttttgaaaagaacagtgccatcaccttattgtcgtcttccgggtgctccggcggtccgaacaaaaggttgcaggtcttgcgtttccgaatctgaactgcggcaacagttgtgtcgtctcctggctctgaagcgtaaagacggttgcattcgtccgctatttcggaagctataatctttgcggtctgcttgtagttgtagttcgcctcaacataggctatgatgttttctctctgccagccatagtttaagacgcgctcaaccccggcgtatattgcaccgtcgctcatcattataaaaacatcgtcaagctcaacgggtattttagtctcataaatctttttcccctcgataatcctttcagtcatgggatattcgtaattcttcccttttctgagcagtataacaagcggattgtcaaattggattatctcggcttcagtgttcccggtgaacctcataatagtaaaggttgaataggccacgccgcgttttttgcagaccggcagtgtagccgcaacggtcgaaacgcattcatcgatactcatattctccgccatcatggtggagattattttagaggtaagcgttgagagaatattggcttttactccgctgcccaaaccgtccgcgaacaccacaatcaactcatcctcacggcgcacaatttcaaccatatcgccgcaaagttcctctccaacatggttaaggctgacatagccgacatcggcaaataaatcattcatctttattcaaagtctccttaagcttggttaaagcgattttggtttcggcggtagtctcgccgaggagagaggctatttcctgagcgacacgcatctgtttttcaacaaccttatcagtaatttcaatggcgctcatgctttgctcggcctttttctccctcataatctcctcttctgtaacatccttcattatgctcattataatgttatattcagggtcatatattatagtctcgtcaacgtattttttgtactcgctcagatatttccgtttgggttcagaatcctttttgttttcagtcattgctatcatataatctgtcggattcagtatccttacaacaggctcgcccataatatcatttgcgtttttgatattcattatctctaaggcagatttgtttatctgctgtatctctaaactgtcatttaaaacaacaatgccgttcggcgtattgttgattatggtgtctgagaaagactcggccttttccttcaaaaacggcagacacatattcatgtcagccttgccgttcagcacggcgacggccttttcacggcaggttgggtaaccgcagctgccgcagttaagttcctgctcttttgttttctttcccatttggtgcagaatttcctcaatagcagaacttcccggcattactttttttatgtattccgcgtcaaacactttcctgattccgttctcgggctgcttaacatcaaaatctgtcctgccggcagtctttccgatagtgagacaactgctgacatggaaaatgttgtcgtgtttcataaccggtccgcctatacagctgctgtcacaggcgctcatttcaacaaagcagttctcaatatttccgtcgcgtatatcctcaagggcgttcatgcagtcctctattccgtcaacgctgaaatatgaaaaatcatcgtctatatccatgctttcaataattccgcccctggtggggaaccagcgcgcgcgtccgcccccggtcaagtcttcttgtgaaaagtcgaactcaactccgctttcagccatccagtcgttaagctcgtcaaaagtcagggcgcagtccacatagtcagggtatttatcaacctcatcctttttagaaatacaagggccgataaaaaccacttttgcgcccggatgctgatttttaataagctgtccgtgcgcctgcatcggtgatataacgttagctaggtatggcagaacatcgggatagtgcttttgtataagagtgttaacgctgtggcagcacgaggagattataacgctctgctttctgttttctataagcttttcatattctctcttgacaatggttgcacctacagcggtttccccagcgtctttaaagccgagtttttttaatgcgcttctcattatctctatgttaatgcccttataatttgctatatatgacggcgcgactgaggcgtatacttcatcgcctctgtcgataaacccttttgcggacggagtatcgtctcgaagtcttttggcgttctgagggcagttaacataacaccgtccgcagagaatacattcattgggaataatctcggcgtgcccctccacgacctttattgacttcatcggacagaatctaacgcatttataacaatttttacagtttgatttttcaagctgtatacaatttttttgcatgattacacatccttagttaactgtgtttaaaacatatctggagaaaatctcgttaaagttttctttggtcactccgctgataacctggtcgtcaaccttgatgctgaccccgtcgccgcagtggccgaggcagaatgcagcggacataccgaccgtttcatccagtccgttttctttgagggcgtctttcataaggttaataatatcgtaggagccgcggagatggcaggagcttcctatacaaactttgatatccattatgtactcctttcgggcggataatattccgaaaataattatcgccaaaaatatagagccggcaaaaatccgctctgtttcatataccttgattataaaggaaacacggtatattgtcaatgatttaacaactatatttttataaaatttatggaaaattaggataaagaaaaggtaagataattttgggcaaaataaaaacgccgcagaccacgcacctctcgtaatccacagcgtttccttatggtcggggtgacaggattcgaacctggaacaaacaacgctatatacgtatatttaagaatatcgactgataattgactttaaaaactgaatgtatttaacttttccgctgtttcggatttacgttcctgtctaatgtgcgtgtagatatcttgagttaattttatgtctttgtgtcccattaattcttgagcgtcttttgcttctattccggcctcaaaaagcattgtcgcataagcatgccgtaattgatgagcggttaatgttaaattattttctttgcgcattttgtcccagcgacaagcaagctgttttttggttaaatagtcttcatgctcgttacagaaaattatgccatgttttttattcggcaaatattttgcaactctgtccaaaagtataactgttcttgttccggattctgttttagtttcgtatattaatattgggttatttccgtcatgtacaatttttttgtttacatttataattttattttctctgtcaatatcttcgtaattcaaagcaagcgcttcactaattctaaggccggtatataacagaaagtaggccaaaaatccaaatccctcatgtaaggtgttaacgatttctatttctttggtgtcgggcattttacgtattgatttttttaaattctttggtagtgaaacagatgtaaccgggtttatgttagcatatccattaactatagcaaatttaaatatttgattaaaaacacttttatatgttgccactgtcttctgtgcgtaatcttttgcggcaagccgctttaaaaatatatcaacgtcatgcgatgtaatgttttttatccgttcatttccaaactcttgtaatagagataaatatgcgctttttccgcattttttaaaagtggtatatggtgtgtttaataaatattcgtcgagccattcctcggcaacagttttaaaaatttctcctttttctttggtgtcttgataggctaaaatctttctgttaatttctctttctgatttgccgtaaaaggatttaatttttccgttaatccgtatctgtttacagtaccttccatcggctcgttttttcattgtattcacccttcttacatttgtgatgcttttttatccaaagtgtgggaatggttgttgcactttttgcaacaaccaattatttaacctctcctgcagcgtaattaacgcacccaggaggacataccattacatcatatcaatatggcggcgataacgtcttggtatatcaataccaaccatataaccgatttcgtttaacgctaatggtatgatggaaaatccaattggaaagctcccattgactacatcaactcttttatcaatttcggtgaactcttttaatcttttttgtaacacatcattgacaaacctacaaaccactctatataataccgaaaaaccgctggttttatctgtaaatttgccattttaacaaatcaaaacccgttttgtaattttttaaaacataaaattagccctcattttatcaagaacaatccaaacaagtatctttctctttacagacataaaactgtgtaatttgggcttgctaaagactgaaatatttgttataattaaatttatgcaaataattttaaagattaggcaggataattatgtttcattatattgaaggaaaactggcattaaaaactgacagctttgcagtaatagaaaccggaggcataggatatagaatatattccacccgcccctcgctggaagctttgggtgaaatcgggtcaaaagcgaagttatacacctatttgaatataaaaacaacatctgatatattatcattatatggatttgccacacaggaggaaaaaaatatttttgaaatggttttgggagtaagcggaataggcgctaaaaccgccgctaatttgttatctaatatatctccctcaaaatttgctctttctgttgtgaccgatgacgctcaatatctagctaaaaacacgccaggtttaggaccaaaaggcgcaaagcgtctcattctcgagcttaaagataaatttaaagatgcagacatatccgatatgccggctgaagaaatattctctcccgaaatggatgacgataacgaggccgtatcggctttggtggttcttgggtattctcctgaagaagcccgcagagcactgaaaggagcaacagggtctgccgaagaaatgataaaatatggattaaaaaacctactttagtatactgaacggttatactaacataacaaacacataaaccgacatgatgaataaagaaacgagtgaaacatatggcaataactgacagtaacgaagaacgcatagtttccaccggggaaaccaatgccgacactgaaattgaatacacgctcagacctaaaattctttcagaatatatcgggcaaacaaaagcaaaagagaaccttaaagtctttattgaggctgcaaaaatgcggggagaacctcttgaccatgttcttctgtacgggccgccggggcttggcaaaaccactcttgcaggcataatcgcaaatgaaatgggtgttaacatacgcattacctccggtcccgctatagaaaaaccgggcgacttagcggctctgctcaccaatctttcacaggacgacatattatttgttgacgaaatacaccgaatgagcagaagtgtggaagaaatattatatccggctatggaagattacgctctcgatataataataggaaaaggtccgtccgcccgttccatacggcttgacctaccaaagtttacacttattggcgcaacaaccaaagccggtgctttggcggctccgctaagggacaggttcggcgttatcagccgtcttgagatgtataaaccaaatgaactgaaaactattattaaaagaagtgcaagtattttgaatatagatatagacgatgagggcgcctctgaaattgcaaggcggtcacgcggaactccgcgtatagccaacagattgctgaaaagagtccgcgatttcgcccagctaagccaagacggcgttatatccaaagaactggctgaccacgcattgaataagatggaaattgatgaccatgggcttgacgcaatagataaacgaatgcttttgacggttatcaatcagtacggaggcggacctgttggagttgaaacactagctgcaacaatcggtgaagaaactgatactatagaggatgtttatgaaccttatttgatgcagattggttttattaaccgcactcccaggggaagagttgtcactccttccgcgtacgaacatttcggtatacccttcggtgaccgatagattgatagaccgtctatcctatatttatcaataaacttaaggagagatttataatgtgtgataaagaaaaatattatataactaccgctatcgcttatacctcaagaaaaccccatatcggaaacacatatgaagttgtgttgaccgacgctattgcccgctttaaaagatatatgggctatgacgtctgtttctgtaccggaaccgatgaacacggacaaaaaatacaggagctggctgaagctgagggaataaccccaaaagaatatgttgaccgtgttgccggtgaaattaaaaaaatttgggatcttatgaatgcaagctatgataaatttattagaactactgacggctatcatgtcgaaaccgttcagaaaatatttaaaaaactttatgaccaaggcgatatatataaaagcagatacgagggctggtactgcactccatgtgaatcattctggacagatactcagttagttgacggaaagtgcccggactgcggacgcgaagttcataaacaagacgaggaagcttatttcttcaaaatgagtaattaccaagaccgcttaatgaagcatatagaagaaaatccaaactttattcagcctgaatcacgcaaaaaagagatggtaaataactttttaaaacccggtcttcaggatctctgcgtttccagaaccagttttgactggggaataccggtttcatttgacgaaaaacatgtcgtatacgtatggcttgacgcacttaccaactatatcaccgctataggctaccgcggcgatgaaagttcgcctgagttcagcaagtattggcctgccgacgtccatataatcggtaaggatatattaaggttccacacaatatactggcctatcattttaatggccttaggtcttgaacttcctaaacaagtattcggccacccctggcttttaaacggtgaagataagatgagcaaatctataggcaacgtaatttatgctgacgatttagtaaaacattttggtgttgacgcagtaagatactatctgctccacgaaatgccatacgctcaggatggaactataacctatgaaatattaataaacagatataattctgatcttgccaatacactcggcaatctcgtgaacagaactgtatcaatggtgaataaatatttcgaaggtattatacccgctcccggcaacagtactgattttgacagttcactttcaaatacttgcatagaatgcagtgaaaaaatcgtcaaaactatggatacactgagagtttcagacagtcttgaccaaatttggaaaatagttgaccgttctaacaaatacattgatgaaacaacaccatggatacttgcaaaaacagacgaaggaaaagaaactctaaaaaccgtaatgtataatcttatagaagcgataagatatatcacatctcttctacagcccttcctgcctgatactgcctctgcaatagcaaaacaaaccggtgctgacgagttgtcatacgcaagccttaaaaacttcggagcaactaaacccggaaccaaggtctcagaagccacgcctatatttgccagaatagatttggataaaaaacttgaagaacttactgaagaattcggtgcagaacaggaaactcaacctgaaattgaaccgtttaaagaaccggtaaccttcgatgactttgaaaaactagatataagggtcggcaaagttaaagtttgcaaaaaagttcctaaatcctccaaattactcagatttgaactggaatgcggaggcgagacaagacaaatattatccggaatagcaaaatattataaacctgaagaccttattgggaagaatctgctcttcattgcaaattttcctccgcgcaaaatgatgggtttagagtcaaacggaatgatactgtcagccgaacacgacggtaaattggttttaacctcaacgcttgatgatatccaaagcggcgcgtcaatagtataattatttctaaaaaatataataatttattaacaattatgtaatcattcctagataaaagatgctataattattttataagaaagatttttaataaacttgaatattattaaataaattagaacggagtgaggataatgttttgcagtaattgcggaaaaaaattaccggatgacgccaaatattgcgacgcctgcggcacaatagcaagatctgacgaaaaggaacaaagctcttattcgaaggacagcaccacatatcaaagcaataatgaccatttcgaaaatacagaaagtccgtttactaatgcggcttacaatttgggagttacacaggcacagaacggatacattgaacaacctatttcttatcagccaaataatcataaaaaactgtggggaagagaaataactataccgattgccgctatatctcttgcagttgttttggtgtttattggattttctgtctacagcacttttaaaacccaaagatatggagcacaagataaccgtattcatcagcagtacggcgcccataattatggaaacatcccggacagcggcggctatgacgaatatggtgacttttttaatcaatacggtgattatttcggtaaatacggcggcggttataactatggaaacggaaacaacaatggtagcggcggtgattccggcggcggttataaaggatacggaaataataatggttcaggcggcaacggcggttatggaaacggaaacaacggaactcccgggaacaacggcggtggttatggaaacggaaataacggcggttcaggcggacaggtgagcgatcctcttccaaccgacagaaacggcaattccgcttcaagcaaagattatgagtggccgaccggagacggaacatatgaattctatgcaaagtctactatacccaaatttgaaagtgttaccggaaaaactatgacagcttcagagactgataacagcggcaatacttactataaatatgaaatggatatggacgcttataacaagtatcttgacgctttaaaaaacgccggatactcacagacaaagtttgacgctcaaggcaaagattcctatgttgtatacgaaaatggtaaccaatatttgattatatatcttatgaattctgaaaatcaaatagtaattatggcttaagacactattcaaaatgcccgcatataaagcgggcattttatattctataaaacaattcattataaaatttaaaatttaatatcagataactctattggattttgtaatatacaaatggtctatattgtaataatagtttacttgaaaaccaaacaggtgtgaccgaccatacttgttcaaaataatatattaatagatattgtttttttatatgtcaataacgtctgaaattgtggcatagtaagcatcggagggcagatgaaatctgccgcataagatgcacagccgcggaaaagtttattataaaaagaattatgacaaacttttttatatatgttcacgcttcgcatgagatgacagctcacctaacgaggtgtgcgcttgcacaccctgccgatgttcactaagaaacacttttttaagatattaattctaaaaagttttcaaaataatgcagtatagctagcttcggaagggcgtacgaagtacgccgcgtaaagcgcgcagccgcggaaaaatttattagtaaaaaggattataaccaacttttttatatatgttcacgcttcgcatgagatgacagctcacctaacgatgtgtgcgcttgcacaccctgccgatgttcaccaaaaaacacttttttaagatattaattctaaaaaattttcaaaaataatgcggtatagcaagcttcggaagggcgtacgaagtacgccgcgtaaggtgcgcagccgcggaataatttatttagtaaaaaagtttataacaaacttttttatatatgttcacgcttcgcgtgagatgacagctcacctaacgaggtgtgcgtttgcacaccctgccgatgttcaccaaaaaacacttttttaagatattaattctaaaaaattttcagaataatgcggtatagcaagcttcggaagggcgtacgaagcacgccgcgtaaggtgcgcagccgcggaaaagtttattataaaaagattttagtaaatataaaatgtgtactcaagcctcacgtgatataataacaattaggaattctagcatatcctactaacgttcactaaaaacaccattaacctttctgtctagtttgttgcagtctttccaaggtttaaatataaaaagtaattgtgaataatacctatcttacaggagtggtcacaatctccacgatgcttataccccatacgtttttatataattttatattagatataacctaaacatttctttacactttattcgagcgactacaatataacatataaaatatttcactccgtaacatcatttaaaatcattaaacttcaacatataaaatgccgtttattcttaaattgatttacaaatatatctataatatttttatacgctctgtaaaaaaatgacttatctgaaaactataaaaacacccttgaaatttttcatcggttatgctataattaatgaacaatatattatggaggagttttatatgaaaaaactagcgggatttttagcagttatatgtgtgttgacaagcttttcacaagcggcttttgcggcggctcaaagtatagttattaacggaaacgttgcagagataccggctgaaatgggtgaaattattgagcaggacgacagaactttcgttcctatcagatttgtttctgagtctatgaataagacggttaagtatgatgagaatactaatgctgctctaattcttgatggttctgaaatgtatatcgttcaggaaggttcttataacatattcagaatttctgacatgggtcagactgttgtaacaccaatggatacaactgcttttgttaaacaatatgacggtattggcggacgtatgtatattccgcttagattcctggctgaagcatttggctatacagttggatgggatgaggcaactcaaacagtaaccattgattcgcctcaggtataaagttaataaaaacaaaaacagcttcattattgtgaagctgttttttatatataaaaattacaaatatttctttataatattttctgcaatccttgccttactttcccggctgtccattgcctgtttttctatgtatctatgagcatctttttcactgtatccctctttttctatcaaaacacattttgccctggaaaccattcgcaattcttcatacttcttttcatattttgaaatctctttctccatctcaataaatctgtttgaaaatcccagtgctaatcttaccgcacccataaaagttctctgctgcaaaggttttggaattacaaatatcccgtctccctccactcttgaagcaagcatatccgcaacgtcggatttagctattaatattactgatgaatgtgtgctgtgaataaaatcagaagcgagagagcttccctgttcatctttaagaggagcatttatgataacaagctgatatgatgaacgcaaaactacacgtctggcttcaactccgcttgacgcaaaatctatgttattcatagcaaaccgtctcaatataagagccagcgcgtctccgctcttttgagatgccgaaactataagaattctattgtacaacggcataacctcccaaataattaatggtaaattttattatatagagccgaaatacaaatcgcgttcatattgctccttaactctcgccttgacatatttgtcatattcaattttcttattttcaatataagtagacaggatattttcaggtaaaacatttttcagaaaatcactatccttcgcataattcactgccgtctctaagttttgaggcaaacattcaagaccttctatgtcttctttataggtcacgtttacaggttctcccaaaatcatcttgttttttattccgtcaatcccggcataaatcatcaatgcaaaaacaagataaggattcgctccgccgtccggcgagcggagttcaagtctgcagtctcctgccaaattctttggtatacgcattagctgctgtctattctgaggtgaccatgttataaatttaggagcttcaaactctccaaatctgctgtatgaattcgttaagggattcaaaaatagagtaatctccttaatatggttaagtatacctgccataaattgtctgccagtctcattattataatctataacgctgtttccgtccatatcataaagcgaaagatttacaaaaataccatttccattctgtctttgcaaaggctttggcataaaagaagcgaaaagtccattcatatgcgcaattgtcttaaccaaatttttaaatgtcattagatgatccgctgcttctaccggtgcgccatatttaaaaactatctcgtgttgcccggggcctgcctgatgatacgaactttcgggttgaatacccatttcctccagcgtaagacaaatttctctccgaatattttctcccttgtctaccggagccacatcataatatgtgccgttgtcatgcggcttgtttgttggatttccgtattcatccaactcaaaaagatagaatttacactccgaaccgatatcgcacgagtatccgagctctttcaaacagtctaccgaacgctttaaaatatttctggaatcgccctcaaacgttctgccgtcaggataacaaatatcgcaaaatattctaagaaccctatcctgctgtggacgccacggcaaaatttctgcggttgaagggtcaggtttaagcaaaagatcgctttcgccaatattcataaacccatttatttcggaagcgtcaaaagtgacgccatactccaaagcttttggaagttctgtcgagataattgatatatttttcatactgccgaaaatatcaaaaaatacaagtctgataaatttgacgtcgttttcctccacatattccattatatcatcaaaagaaaaaagcataaaatagcctcctaaaaaactgcgctgaaattaatatatagtttactaatataacacggaaaaatatttattctagtcatatattttgaagttatgataacataagataaaaacattgtcaattaatcttaccgattgtataaagatatattttcataatattatatttattaatctgattattaagaataaatattgagttatatattgaacacttcatgttcagatgattgctcgcctcacgcggtgcataaatgcaccctgccgatgctcttcttaactgatgatcttttgattttattttttatgtttttatagtctcttttattttaaacactttgtgttcaaatgtaaatcatcttatacggtacagttattagctaaacacacctcatatggtttttaattgttaatcaaattatgtttttcttttttattaatatatgaatgtattattttttcaattattaataaacgaattttaaaagccgattcagttcaaatctgaatcggcttttataaactatatcattacattactgccgctttcggcacatgcttctgctctgctctaactcttctgtcagacaatttcacacatattactgtcatgtcatcattttcaataccattttcagcatttctcttaacagcctcgtctagtattatctgcgccaattcttttggcggtatctccatgtctattacctcaaccagttccctaatccaattgtcttccgccgctgatattacaccgtcactggtcataactaccatagacccgttttccaaagtcctggcaaacgtctcaatatcgccgattgatactattcctattggcaatgatgccgcgcgcacagtctctgtatattctgtatgtttaatataactggcttcagcgccgtttttgataaattctatctcaccagtatacaaatctataacgcacatatccacagttgcaaaagcatccctggctgacttcatcaccattactgaattaaccagcttgactgctattgtcttatcaaaaccggcttccaaaaagcttcccaaaagtttaacaatagcgtcgctttggatagccgccttgtgtcctgttcccataccgtcgcttatagttaccgccagtttcccgccgctcaaatagttcgtatagtgcttgtctccgctttctccgttacttgaaaggcttgccaccccaatactgggatcaaaaccttctacctggcaaaaacgtatacagcactttccgctgtctgaggtatcacactcattatacggcacagccacattgattccaaggacctttttaattacgggttttattctcttttggcaaactgagaaatcatcacagtcaagcacgctgatttctaccatatattttccattcttgtcacaaacaacgttaactcgctgggctgaaattcccatatcgtttaaaacttcttttatttcatccgccgacctgatatcaaaactcttttcgccgcatatttccgacgcggcattctttattatttcagaaatccccttaaactgctcgctcgtaagctctctgttctcctgaagcttatttttccaagttctgtttattttataaatctcaaacagcctgtttatttcagttataagcgggagcaggtgtacacacttgtccgaaaaacattttggaacatcactgagctgcagactgcctttccgctccattatctccaaaaatttaaacatagctgcatatgtagcattaaaatcctttttccagcaaaaattcgctctctcacagtttttacacactctatccgccgccgtgtcaaacagcagcgagatatcactcatatccatgcctgtctgcttgtccgacattgaatcaaatgtctttgaaatatcatagaacgaatcagatatacacataagtttttcagtaacatacattctaaaacgctcagtatcgtctgaattgtcaacattaaaatcagttactttctcacctattataacagcctttctgggaagaaagtacacaacagccgccgccaaaaccaactcatatatatttggtatatgcgtttgtccgccgggtatacccatatacagcattatccctaaaccgcatacaccaagacaaaggcaaacaacctttcttccgaactgagctgaaataccgcacagcaggccgcagattgtgagtactgccacaaactccggaaataaaccgccgattcctaatataatcccggaacatattcccgcaacggcgccatgagtcagaccatgtcttgacaaagacactaccccgattaaaacgcatgccaaaaagttagatatattaaacgtatccaaaacagtgattgactttgtactgagcaaaatcacacctgccattatacataagcttatcttttcatctgtcagcagtgaacgcgacaaaaacttattttcaagcaaaacatccctacttctatcaaacaccatcactccgactgccataagcattgtatcgcaaattataagtattagacctgcaaccgtaaagcctgtccacattaaaacgccaaactcacaaagaaacaatgctgccgctgaaacaatagcaacgaaatacaaagacggtttttcgtttctttctataacgaataaaaccgtctcaaaaataacacaagcagatatgtatcttaaagcaagctcaaaatcaaaaagaagcagatagccaacagacacaaaaatcaaattaatgacgctttttagtgaaaactttcggtcaagcgtcaaaaaagacaaaccaaacggtgccattccgcttataggcattgcccccgcaaacaataagcccaaaagccgcaccggaatatcccaaaattttaaatcgattcctttccgctttttttgctgtacctgcagagaagtctcaacagacaccaattctgtgtttctcataataaatacctccgtaaccgcattaacatttcattacgaaagtattataaacaagttacaaggcaaaatttgtcataaacagttccctaataagaaaaatatataaaattttttatatcgctgtaacttcggagatattaatctctaaaaaaggccattaactcctgtcattgtcgtcttttacctttcttctaataagcataagcgccaaagctcctacacaaatcgccaaaaccatgtacttttttacttcttcctgagttactgggtcaacaatcggagtataacaagccagcaatatcaagactatcatagcaaaccaaactcctgctataatataaaatgtttttctcttcatgaaatctctccttatatttattttacttaaaatacttcacgcataacagcatatgtcatatatccaagatatgtcaacaccattaaaatacccggaagtctctctatcttgttcctaaaaaacgtaaccaggtaaattatcaggcagaatccaatgaacaaacttaaatctataacggagaatcccgaaactttaacaggactgacagcagcggataatcccagcacacctaatatattaaaaatattagaaccgataacattacccattgccaaatcattttctcccttccgcgtcgccaccaaagaagtcacaagctcaggaagagatgtccccacagccaaaatagtcagtcctattattgtctggctcaaaccaaaagcggcggctatatcacttgcggaatccactaccaagtctccgcccaccactattcctgcaatacctaaagctgtataaaaaacgcttttaagaggcgacattgtctttatttcttcgtctccgggaaggcctgtcctgccctttacagctgagtatactaaaaatccaagatacgccataagtccggcaaaaagaattatcccctctgttctgttgatagtaaaaccttttcccccaattatcaaactatttaaacaaaagaaaagcaaaagagcagctataccaatagaaaacgggaaatctcttttccgcaaatcaattgacaccggaagactctttatgaccgcacagcctcctgccactaccaaaagattgaatatatttgaacccagcacattgcttattactatatcattttgaccctttatagctgcacccacgcttaccgccatctccggcgcgctggttcccatagcaacaatagtcagtcctattattatacttggtacttttagaagcttcgctattgatgaagtgccgtcaacaaacaaatctgctccttttattaataagaaaaaacccaccaaaagccatacatacattaaaatattattcatcatctctccatctttctgacataatttatagttttattatttaaaattatcttatagctccataacccagcgcattcagttcagtagaaaaattgttctgcttaggagacttaaatttagggtctacaccggttatctgtttagaaagctgttccgccggaagcatatcaaaccaacagttataccctgaaacactattcgggtcataccaatagtttgctccaaaattgttagtgtcattatacggaccaacacctttataaacaagttttccgtcctcgtctgcaaaagaaaatacaagtccattctctccgccgtaaattatattctgtgatattatattatcttctgcctgctgcaccattatcccgacaatattattatataaggtattattaacaaaatcgcactgttttgtccagccaaccttattatcataacctccgaaacaaattcctgccaaacccttgcactcagaaattatattattatttacagacacattatatgatatattatacggcgcccgtgtagactcactggctacttcaactcctatatcacaattataaatattattatctaatatttcaatatcatgacctccgtcaatatatattcccgcacagcacaagtcgtaacctgaaccatctttataaccctcattgccataggttgaaacattataaacagtattatctctaaacacgccgtttctggcacagtccagttcttttgttttgcatgttccctcatagcctatcgcgtcgagacctatattattgcaatcatgaattatattattagacactctgaaaccatccacgtttccgtttagagtaaccgtttcactcgtataagttttgcagttatatatttcattcccgtcaataatcacatttgttaccggatttacatttttagcataaaagaccactgcaaaagtatcgtcattattgccgtctatatcatgtattttattattgcataccacaaaattctttcctgatttagaggttgaattttcgctgtatattccgccccagccgttttgaagctctaaatctgatattataatatcgcttgacgaagcctcaagttcaattatattctcgttcagctttccgcctccatctatcaccgcatgcgcgccgggagccgcctttattgttatcggctctgcctctgtgccttttacgcccacatatatattttctttataggttccttccataatataaagagttttacccgatgacagcttcgatacactgaaatcaaccgttctgaatggctttgcaaacgttccgtctccgtcggaatcacttccttcaacagatacaaaaactgaatttgcatcatctctgtaagtataaagttcgttagtgaatactatcgtctccgaaataggttctgcactttcaaaatctctccaaacaaagactcgtactgattttacagttctatctgcactgtccaaactaagaacgcattctgccgtttcccccggagcaatatttaaatcaccggtactgctgatacttatgatattatcttcctcatcatacgctgccattaatagcacctcagaagaatccgcactgtcagtattcttaatttcacttgttataaacttatctgagtacgaaaaaacatcatttcttaatgtcaatccgttttgatttttcaccgttacttccggctgggcttgtcccgccgcaaatactaatgttatacacgacatcagaactacaatcacagcaccggcaaattttaaaatattcttcatttatgattccccctaaggtatctattggaataataatacaccaaaaccgtataaaacacaagctaaaatcacagtaaaataaacttgcatacttaaaaaataccttaaaagccttgaaatattaggaattgtgtgttaaaattatttgaaataacgttgtataattatatgggaggtattatatatatgaaagaacagcttagcgctatcaaaaccagcgccgagtcagcgctcgaaaaagcactggatttgactgagcttgagaatctcagagtcaaatatcttggcaaaaaaggcgagctcacatctctgatgaagggtatgggcaaacttacgccggaggaacgccctgttataggacagttagccaatgaggtcagaggctttatcgaaggaatacttgaggaaaagagtaaagctctcataaagctggcaaaagacaaaaaactcgcttctgaaaccattgacgtctgtctgcctggcaacagacctgaacacggaaaaaaacaccccattactactgttttaaatgacttaaaggatatatttataggaatgggtttcactatagccgaaggtcctgaagttgaactggattactataattttgaggctttaaatcttccgcctgaccaccctgcaagagatacccaggatacattttacatcaatgaagatactttgcttagaacacagacctcttcagttcaggttagagttatggaaaaacagcagccccccatacgtatagtttcaccgggcagagtatatagaagcgatgcggttgacgccacacactcaccagtttttcatcaagttgaagggctggttgtggacgaaggcataactatggcagatttaaaaggtactcttgaagtgtttataaagagactttatggagaggacacaaaagttagattccgtcctcatcatttcccgttcactgaacctagtgcagaagttgatatatcttgctttaactgcaaaggtgaaggctgcagaatatgtaaaggcgaaggctggatagaaatacttggatgcggtatggttcatcccaaagttttggctaactgcaatatagaccctgagaaatactcaggtttcgcttttggaataggtcttgagcgtgttgctatgttcagatatggtatagacgatttaagattgttctatgaaaacgatctcgggttcttaaagcaattttaatcatgaaacgcgtaatgataattggattttcaggcgcaggaaaatctactttggctcggtttatagctaataaaatagggacgacccctacgcatcttgattcgctccactggcttccgggctgggtggaaaatactcctgaaattgagtctgagactcttcaaaatgtgctgaatcaagataaatgggtaattgatggaaattattcaaaggttctatatgataaaagattagagctggcggatactattatatttttggactttaaccgatttttatgttttaaacgaatactcaaacgctattttaactacaaaggcagaacccgtgaagatatgggtaaaggctgcgatgaaaaaattgattttgaatttgtaagctgggtacttcacaaaggaaggaaaaacagaaaaaaatacctccgccgtcttgatgaagccggcaggaaatatccggggaaacaaatacttatatttaaaaacccgaagcaggttcagaagtttactgagaaccaatgttctaatatttaggaggaaacaagtatgaatttaccattatcctggttaaaggattatatgaatacagacggcatcagcgagaaagagtatgcagacaaactaaccatgagcggttctatagttgagggcattgaaaaccccggtgcagagtttaagaacgttgttgttgggaaaatagacaaaattgaaaaacatccagacgcagacaagctggttgtttgccaagtaaacgtcggagaagacgaggatatacagatagttaccggagcttccaacgtatttgaaggcgctgttgttcctgttgcaaaacataaaagcacacttcccggcggtattaaaatcacaaagggtaagctaagaggcgttatgagttatggtatgatgtgttcaactgatgaattgggcatttcaaaggaacgtgcttccggaatactgattttaccggatgatacacctataggcgaggacataaccgaaactttgggtcttaacgaaagcgttgctgaatttgagattacctccaacagacctgactgtatgagcatcatcggtcttgcccgcgaaagcgccgcaacctttaacagagagttcaaaatacctgaaataaaaccaacgggaaacaatgaagacgttaatgattatgcaaaggttgaaattgccgacccctccatctgtccgcgctatacggcaagagctgttaagaatgtaaaaatcggcccatcgccccagtggattcagcgcagactgactgcttgtggtcttaggtctatcaataacattgtagatataacaaactatatcatgcttgaatatggtcagccgatgcatgcttatgacttagataatattgaaggtaaaaaaataatagtcagagacgcgtcagacggtgagacgcttgaaactcttgacgaacagccgagagaactgaaatcaggtatgataacaatagctgatgaaaaaagggcaataggcgtggccggagtcatgggcggagccaacactgaagttaccgatactaccacaaccgttctgtttgaaagcgcgaactttaatcctatacttgtaaggcgtggagcaaaatccttgggaatgagaactgacgcttcagctctgtttgaaaagggacttgattctgaaaactgtttaaacgctataaaccgtgcctgtgaactgattgaggaaatgggcgccggggaagttataggaggctgtatagatatatatccaatcaaaaagactaaaacagttctgccttttgaacctgaaaaaatgaacaaatttttggggactgatataccgtcctctgatatggctgaatatttaaaaagactggaatttgaggttaacggttcaaatgttgaagttccgacattccgcggagatatcgaaacaatggcggatgtagccgaagaagttgccagaatatatggatataacaatcttcctactaccatgatgaagggcagagtaacaatcggcggaaaaacacttaaacaaaaaaccgaagactgcataagagagcttctgactgcatatggtatgtatgagaccatgacttactcttttattgaccctaaggaatttgaaatgacaaaggtaccggccgataatgttgtcaaaataatcaatcctcttggcgaagaaaacagtatcatgagaaccaatatgctctcgtcggtaatcaaaactttaaagattaattataaccgccgggttccgaaagcaaaaatatttgagctgggtatgacctatattccggttgaaaatcaaaaacttcccgatgagaaaattgttgtggctctgggtatgtacggcgatgtagatttctttgatcttaaaggaatagtgcaaaatcttcttgatgaccttggtatcaaaaacgctgagtttgaagccgacacagagtcgccggcataccatccgggaagatgtgctaaaatatgcgcgggtggaaaaattatcggaacaatcggtcagcttcaccctgacatagccgagaactttaagctggacaccgatatatattgcggagagctggattttaacaccataatggaattttcaacattcgaaagagaatataaatctcttccaaaattcccggcttcaaaccgtgacattgcgctggttatagataagtcaataagcgttggcaaaatagagaaaatattaaatgacacaaaacacggaattttagaaagttataaactctttgatgtatatgaaggacagcaggtaggagaaaataaaaagagcgttgcgtattctctaacctttagagctcctgacagaacacttactgataacgaaataaatgacgtcctaaataatatactcgaaaaacttaaaaattgcttaggcgctgaacttagataatcaatataatatatttaatataaaggcaggtgaaaactatggaaaatcaggaaacggttaaatttaatgttgaaacagaacgtgctgaccctaaaaaaataatactgtctgtataccaagcgctgtctgaaaaaggatataatcctataaatcaaatcgtgggatatattttgtcaggtgacccgtcttatataacgtcatacaacggcgcaagaagtttggtccgcaaactggaacgcgatgaaatcttggaagagcttgtgtccaactatgttaaagacaagctggacgaataactttataaatttctaaaataagctgattttgacatctaaaaattgcacttgacattttaaacaaaataatatataatatttatcgttgttgccgatatagctcagtcggtagagcgattcactcgtaatgaataggtcagcggttcgattccgcttatcggctccacgaaaaaagcccgcagccattaggcagcgggcttaatttttacttttttaagattgaatttcttaatgctttatagagctgttcagcgtcaaatggttttggcaaaaaccctgtcattccagcttctgccgctttctctctgtcctctttaaatgtatttgcggtcattgccaaaataggaacttcagccgagtcttttctattcattttgcggatttcagctgcagcagtcaatccatctttttcaggcatatttatatccatcaaaatagcactgtattcgccgtccgaactttttgcaaacatattgacagcctcctgtccatttggagctctatccacggatatttgcttcatttttaacagctctgtggcaatttcggcgtttatatcattatcttctgctaacagaacacgcatatttttcaaaatattttcatctaaaacaatattttttgttttatcagctacgttatttggttcactcaatttgccactatatattggcagttctatgataaaataaaattccgaacccttgccgggctcactttttacttttaaatctcctcccattaaacttacaagactgctgcttatagaaagacctagtcctgttccgggagctcttaaattacttccttccgcctgttcaaaagaattgaaaaccctatcaatatctttctcatttatacccacacctgtgtcttttacactaaatctaagctttgattcattctcgttaatttttgactctgtaactgacagccaaacactgcctcctctgtcggtgaacttacaagcattagacatcaaatttgcaagcacctgattaatacgcattttatcccctaaataacatgtatcttcaagttcacaagttacgtcaaaatttaatttcttctcgcttatctgtgggacgaacataatttttatctgctcaattaattcatacatatcaaaaggcaatttttcaaccgtcatttttttactttcaattttagacatatccaaaacatcattaagaatagacaaaaggaatttagcggatgaatcaattttatttaaatcctcttttaatgcaggggtagcgtctctgcttaatattgccaaattcgtcagccctattatcgcattcataggcgttcgtatctcatgcgacattctggataaaaagtctgattttgcccggctggtctcctccgctttttcaagctttacagccatcatttttgtacgcatactgtaaaatataaacaaaacagccattagggacaaaataaacacaaaaccgacacatataccaatcacgagaacaggattagtataaaggacagttttaagtgtaactacaccgtcaggtaaacttaaatttggctgtgacacaatatgggctgtatcctcatcgctaaaactattaacagccttactcaggacagaatacatttgaacatttgcaggagccttcattgctagagtcagtgtttcctgaatatttgtatccgctacaatagtcatattagcataataatcctttgtataaaaaccttctataaaagaagcaggcattcttgtataatccgccaagccattgtttacagcttccatacagtcttcatacttaggatacctgataatagaatcgttttttcccgtagtctttaaggatagagtttcgggtacagccatcgtaagaccgtcttgcttgtcaaaactttgtttatttctcaaaataattgagtctaaatcagcatatccggcagttcttataagccccaaatcatccgcagatgtatcgtcattcataaaggctccgattatatccgctttcccggatgctgccatttcaacaagttcactatatgtatcagcatacacatattcaaaatcaagattcgtccgattagaaattagtttcaaacattccggtacgattccgctttttttcccatcgctctcataaaacagaggataacggtctcttataacagcaacttttaaagttccgcattcctttataaatttatcttcttcatcagtaaaagttatggaatttatatatttatcaggaaagtatttattatagagttcctctgcaaaatttggattcgcagcataaatttcttccatcgcctttgataactgttcacataattcaggcttatcttttgacgtaaccaaataatacgggtcgctgtcaagtttaacggcaacattatacccgtctttcatatatacgtcactgccgtaaatcaggtcgacatctcccgaatcgatacatttttcgtataattccctatcatcataatacacaagctcacaagttaaattattatattcaataaacttttttaaccgttctattttactggcggctttgccaaaaactcctatgcgtttaccgttaagagtgttgtaatcataacctttaatatcactgttatccttttggtacatcaagagtgaataatttgaacccataatatatttcggatagttaaaatactgctcatattcctcctgataaaacattccgcccatgatgtcatattttccttcaatcattccgtccagtaattcagtggtcgcttcatcatttgattcatctgcggtttttatatcatatttccagccggtatacttagaaatttctctaagccaatcataaacgcatccgccataagttccatcttcataaacctcatttattcccggactgacaggaaacgcaacagtcaaaactgtctcatccacgtcttcagcaaccacagccggacaatatgaaagaaagataaataaaattactgcccatgcaccaacagatttacacactctgtgaataccgccaaacttaaatgaatgtctttttttacaatagctcagctgctctttcatatctctcattagctgctcactcctgacgttttgaaaatcattctattaaatacgcaatcaatctacaattatatttctaatcaaaatatctattgtaaaaaaagaaatgtcgattattgaataactttatactttattttaaaaacaaaaaaattttttgagttcatggcatagcactcagaaaaatttaattgtataaacataccccattataactttatttaattatatcacattatttatataaatcaactaaaatttcacctataaaatatatagtttattgctatttactttaaactacattacaataatgcagtttatgcgcggttttaatattttatagccaatatgagaaaaaaagccgcatttctgcggcttttaaaaataaatacaatttattaattgtatatataatataagaaataagtatatatcttattatcttctatattttgtcaggatatttctaacttcttcttctgtagaacatgccatagcttcttctgcaactttttgagcgtcttttactgaccattttgatatttcatttcttgttgacaaaacagaaaccggattcacactatattcttccagtccaaaagcaaccaaaagcggtatcaacagtggatcagaagcggcttcgccgcacattcctacctcaataccttctgcccttccacagtatataatactttttatgttcctaagcactgccggattatatgcagaatataggtaagcaacattagcgtttcctctgtctgcagccattgtatatccagtgaggtcattggtgcctatgctgaaaaaatcggcttcctttgccaaaaggtcagctattacagcggcggcaggagtttccatcataactccgacttttatgtccttattgtatgccactccgttctgatccagttcagacgctatctcagctacaagcttcttaacagctctgacttcttcaacacaagtgacaagcggaatcattattcttatatcaccgaaggcgcttgcacgcatcagagctctcagctgagtcttatacaggtcttgattcttaatacaatatcttactgcacgaaatcccataaaaggattatcctctttttccaagcccaaatacggaatatccttatcgcctccgacatccaaagttctgattgttacaggctttcccttcagagtcattgcggcctttttataagcttcaaactgctgctcctcaccgggttgttctttactgtccatatataggaactcagttctaaacagtcccacaccttcaccgtcacgctcaataactaaagcgcagtcatccggcttgccaatattgcacaaaagctctactctcctgccgtcggctgttactgtgggcttgcccgccagtttcaaaagctctttcttctcatcatcaaaactctttttaagctcccggtacttttctacttcttcagaacccggcgaagcaatcacgctgccgtccgttccgtctactattaccacttcaccgtcaatgagttcttttgttatgttatctatacttaaaactgcaggaatctcaagagcccttgccaaaattgcggagtgtgaagttcttcctcccacttctgtgattatacctgagatattctcccttattatcccggccgtcatggatggggtcaagtctctggcaactatcacactgccggcaggaagggcgcttatattcacctcttccacccccagcagagttttaatcagcctagtctttatatcacgaaggtctgctgcacgctggacagtcaattcgtctcccgtagcctcaaacattgaggcaaaaccctcaaaaacttgttctgtagccgcttcggaagtaagcccgccgcttataccttccttgacttcatctgtcatcgcaggatcgctgatcatcagcacatgtcccatcaggatttcagactctttatcacccacattattccgcatttcttctgccattttctcagttctctgagtaaattcctgaaccgcctgctcaaaacgagctgtttcatcctgaaccgacaattttgattttggctcataggtcaagtcttgctcctttatcattgcgacttttcctataccaatcccctctgagcctgctattcccttgaacatttcatcacctaccctgcggactgcaccagctcaaccgccttttcgagcgcttcagtctcgtcgcttccgctgcattctatttcaatttcgctgccgcattttatacaagcggcaataacattcattatgctttttccattaaaactctttccgtcaaaatttattgtcacatcagaatcaaactttgacatctctttggtaaacactcctgccggtctcatgtgaagaccttcaggatccgtaacagtaaccgtttttgaaaccataatatacactcctttaattattttcactaaatatactataatattatcactatattttagcaatgtcaataataatttaaattattttaccgtaactttatcaccttttttaactaatccggctttttcgcccaaaggcttttttaaaaatgcgagcaggagcgctcccacaaccgaacctataacaagcgctgctatatatcccaatacgtttcctacaaccgggaaaacaaatattcctccgtgaggagccataagagtacaaccaaacgccattgacaaagcacctgaaactgcgcttcctactatacatgagggaattacacgaagcgggtcagcagcggcgtatggtatagcgccttcacttataaagcagagacccataatatagttaacagctcccgactttctctcactgggcgtgaacctattcttaaagaaagttgtgcaaagagctattaccaaaggaggaaccatacctccaaccattacagctgccattatgtcatagttgccttcagctattgaagcggttccgaaaacataagccgccttgttaaatggaccgcccatatcaatagacatcattccgcctaacactaatcccaaaactatcttgctggcgccgttcatcgcttttaaaccactattcagcaatgtgtttaatccacctattatcgggttgaagaggaacattatcagtcccattaccaaaatacctattaacggatatatcagcacaggctttataccctcaagtgactccggaagtttagagcaaagcttctcaagtccgagagttaaatagccgcccacaaaaccggcgaacaatgcgcctaaaaatccggctgatactacatttacgtcaggattcataagtgaagcaaacgtagttcctgccactgccagagctccgcctacaaaacctactgcaagaccgggtctgtcagatatactcatagcgataaatcctgcaagtattggaagcataaagttaaacgctactcctccgaccgtcttaaagaaagcggctacaggtgtattcataccaaagtttgacggatctatagaatagtcgtcaagcaggaatgccagcgctatcaaaataccaccgcctacaacgaaaggaagcatatgtgaaacaccattcataaggtgtttgtatactgagtgccctactccgtcgccgccttctgaggtagtctcagctcctcctgtatgtgagtatacaccggcagtaccgttaactattttctctattagagcttccggcttatggataccattagaaactgtagtctgaacgatatgttttccgtcaaatcttgccatttcaacattcttgtcagccgctataattactccgtcggcatcagcaatatcacggcttgtcaaagcattttttgtgcctccgctgccgttagtctcaacttttatttctactcccatttctttggccttttgttcaagagcctcagcggccataaatgtatgagcaatacctgtaggacaagccgtcacagcaactattttaatccccttgcttgtgctgcttgaagcctgcgttttttccttaggctgttcatttccatacttctcaatttctttttcgtcaatatactttaaaaattcctttgcagacgttgcgctgagcaatttttgtctaaacttttcgtccatcagcataaccgtcagtctggataaaacttcaagatgaacgtctccgcctgatttcggtgcggctatcataaaaatcaaattagattttccaccatccatagcgtcaaggtcaatccccttaggcactgtcacagccgctaatcctggattctttacagcggcactttttgcgtgaggaatagccactccatcgccaattgcagtaggtccctcttcatctctcaaaaacaaatcttttttatactgggccttgtctgaaatgtttccggctttgctttgcaagtcaattagtttatcatacaaagcttctttggaatccgtattgaagtttagcgcgattgcgttcggcttcagcaaatcaataaccttcatatttacctctccttttctttattatataaaaatttataatttataagttacaagattttcataagttcttcaactttctctttttcagctaaacctgcggagaaagccgtcgcacttccgcaggcagttcccagtttcagcgcctctctgtaatctccgctctgcaagtatccaaaaataaatcctgccaccatagaatctccggcgcccactgagtttaaaaccttaccgctcggcactcccatttttataacctcaccgttttcagcagacaatacagcgccgtctccagctcttgacaccaaaacattccttgcccccagctgtctgagttttcccgcatattcaataatttcttcctcagtattaatttcaattccaaacaattctcccagctcatggttatttggcttaactaaaaacgggtgatactttagaacattttttaataaatctccggttgcgtccactacaatattggaaccgctgtcttttaaacgctccattattttttcatatatatcatctggcattgttgcaggaatacttcctgcaagaatcagaaaatcgcctctctgcaaaacttttagtttatctagaagccctgatatcgcctcatggcttataaccgggccctgaccgtttatatcagtctcttcttttgattttatcttaacatttatccttgtgataccattttcaagctctataaaatcggtttttataccgtttttattaagaccgctctcaatagctttcccagtgaagcccgaaataaacccaagcgcaatattttcagcgcctaaattacttaacacagtagaaacatttatgccttttcctccaaaaaatatctcttcactctcggttctgttaacagcgccaagttctatatcttccagatgtataacataatctacagccggattaaatgtcactgtataaatcatgcaaaagcctccttaacaaccgcgtgttccctaaattcattatcctcaagctcatcagtaactatacaagcgtctttaagtataccaaatgttaccgcatattctttgtcaaatttggtatggtcacctaaaataaaattgcttctccctctttttaatacctctgactttacggcagcttcctcaacatcaggagtgctgtatccgcctttaacactgataccgtttgttcctataaaagtttttgtaaaattatattttctcaaattatttatagcttctgttccaacaaccgcttcggttgtaagttttatctgtccgcctataatataggctttaagccctttttgaataagcttttttgcatgaactataccattagtaacaaaagtggctctgacattgtcgtaaataaaatcaatcattgccgccgtcgttgttccggcgtctataaaaacaaaatcatcattagtaacaagcccggctgcaactctgcctatcgcttccttctcagtaacattcagtgctgattttgtagtgacatcctcttcaaaaacagtgctcaccctatgaatagccgccgctcctccatgcaccttttttaccttgcccattttgtctaaagttaccaaatcccttcggatagttgattctgaagtttctaacccttgtgataactcgccgactgtgaccgtatcctgctttgtgagcagttccaatattttattatgacgctcctgcgtaagcatgacctgtcaacccctctttttcatttttaagatttgatttttaagcttcatttttcatttatttatcttacaccgtaatattatcaccattttcaatcattgtcaagcgttttcggtcataaatatttcacaaacaagcatttataatcattttcattcatttttactaataatatagccttttctagaagaaaaaatacattttttttagtaataatgtacactaatttaatggcacgcgtttgcactatatttttattataattttaattgtggaagacacttaatctccacaaaataaaatatgaaaggagcaaaaatatgctcggattcggaaacaaaagacaaaggccggcggccggcggatatagggaacaaggaaacggctataccccaccgcagtcacaaacggcaggttatcaaggcggttaccaaaacacccaaatgggtcagcctcaaacggcggaatatccaggcggttatcaaaacgcccagcaaatggggcagtttgccggatacggtgaagaccagcaggatttgcaggattatatcaataaaagaacttcagaaattgacgctcaggtcaaggaattttcagaaaaaaatcctaattttgatatgagacgtgaaatacaaaaccctaaattctgcaattatgtttggggaaatggactaagcattgaagacgcctactatctctgtcatagggaagaacagaactacggtgattcccagtaccgcagccgcggagaaaagccgtccgccgaaaggcgaatcaccgagaacggtacaggcaaggcaggaagcggagctatggttaaaaagaaccctgaggaattaactgacgatgagcttgacgaaatagttaagagagtcagaaacggtgaaaaaatttcattttaagagtttataaaataagtaaacacaaggaggataataaatgagtataaattataatacacaaactacatcaaccaataatcttggaaataacgttactcctgaattgaaagcgtattacgacagacagatgattaggtttgccagcccaaaactggttcatggacagttcggacagaacaagcctatcccaaagggttcaggaaagactattgaattccgcagattcagcccgctgcctaaagcgctcaaacctttaaccgaaggagtaacgccaaagggcaaccagctcaatgtcacaacagttgaatccactgttgaccaatacggtgattatgttacactctctgacatattaaccctgtccgctattgacaacgttatagtagaaacacaaaatgttttaggcgatcaggcaggaagaactcttgacacagtaataagagaaaaggtaaatgccggaaccaacgtgcagtatggaaacggcaagtctgaccgaaatctgctggtaggcggtgctgaaaactatgaggataacgattatttaaatgtggcggctgttaaaagagctgtagcaacactgaaacgaaataacgcccagccaatgaaagacggctgttacgtggctataattcaccctgatgttgccaacgatttgacaaacgacccggactggaaagagataaagcagaatgttgacccaaaagattggtacaacggcacaataggcaaaattcacggcgttgtattcgttgagtccacagaagctaaaatattcagggcagctccgctcagaaccgttgaaaacatcgagaccggagaccctgaaagccttactgttgcaaaggttaacggtaaaaccattactgtttcagaagaaatagccgcaaaggacgctgctgctctgtccggcaaagctgtacagataaacggatttgactactctatcacctcagcggcagccggaagcgcaggaagcgcaagcatcacgctgtctgaaactccaagcgctactattgttcctggaacaactatatatccggcaggagccggaaaggatggcagggacgtatactctactctatttattggtcagaatgcttatggggttactaatataacaggcggcggccttgagacaataatcaaacagaagggaagcgcaggaaccggagaccctctcgaccagagaagcactgtcggatggaaagcaactcagacagcagaaatactctctccggagtttatggttagagttgaaacaacttgcagctattaggaggtaaacatggcaaatacaaaacaaactgttacagatgaacttgaacaattttataatgaacctgtccctgtgacattaattaaagataactggaagaaaaaagacgatttgaccgttaccgttaacggaaccaattatcaaattaaacgcggcgttgaagtaatggttcctagaagtgttgctctcgccattgaaagaagcgataaacaggaaattgaggctgaaaaatatattgaaagccttaaagaggcttagagggcaggtggatacatgaaaatcataaacgcaatttcagctgcagacgctctcagccctaatcaatttactttcagtgaaaagctgcactggtgcgacgaagtttcactcgctttaagacgggacataaaaaaatattactccgttattgaaactttagtaacatgccctgatgaatttgaactgcctgatgatatttcttttgacgatattgaagctgcgtatgtggcaggtaagttaatagataaagcagatttaagaagcctgcctcatctatgcggttcactgacctcagcattcagcaattcagctcctaaaatacttaaactagtgtatctcaccaagcctgataacatcagaaacattgaggtaaaaggtacttataaactgagtgagaatatcatattcggctctgagcttccactttttgagggggacaacatagaatgcgtacttctcgaaaacttagatgatgaacccaactgggactcctgcctggatagctatgtatatcaaaatgacggagaagcagtctatcttacagatgatatatttactccgcaaacctcggcacatttggcaattcggcgcgtcatagacgacgaaacagaggcagaccctccatatgacagactgtatatagaatatattttggcaaaaatggcgctctatcagcatgattacgacgcgtattctgcccatatgacccaatacaacaatttgtacagcgaatacaaaaaagattataaaaccagaaatcccttgaacgatttggcaaggttcaaaaatttctggtaggaggtgaggaatatgtatctgccgcccagcggttcgtccacaagcagcaacacaaaaaaagtggatattttaaacttctttggatatgatcaaagagaaaaaattgacgacagacaaatgtctgaaatgtataatatgtcctccgattctattcctgccgcctcgccgcgtaaaccgagagaacacattgtttctttaaacggaatatcagcggttacggctccggaataccagccgggaagtcttgactcattcacaggggtagcagaaaactatttttactacaagggcagctctgtcacaaacattaagctcttggacggtgaaaaatctatagtggactttaatgggaacatatgtattttccctgacaaggtgtactataggtatcttcctgaccctgacactggggaaatagggaatgagttaaagaagatgggacgtcagattactgttacagacgcaaaattttactcaagtcataatgaaataagcggagtatatactgcttatatacagaaaagcggcgcggaatttgacgacatttttaaggtaggagacagtgtaatcataagcggctgcagtgaagaccaaaacaacacccatgtaataaactcaaaaaaagattatgcttctgacagccaaatagtcagtgcggtagttgacgaggccacaacatctaaactttcacttcttttatatactaaaaacggcagttacgggctattcaaaaacactactgacagcaattctgtgactattgaaataagtattcctgatatcagctgggcatgcgttcataataaccgtctgtttggaacaggaaccaacggcgaatacatatatgcgtccaaactaggcgattgtttcaattttaattcctttaggggtctagcagatgacagctggtacagtgaaatcggcactgccggcgagtttacaggtatagtcagctacagaacagccgtcgtcgcttttaagagcaactatatacaccacatctacggagactcaccgcaaaatttttctatacccaagcaaacctgcggcggtgcaatagacggaaaaagtattgctgaactcggcggcatactttactatatgggagccgacggcttttatgagtacagcggcggtgaacctgagaaaatcagcagttgtataaaaaccaactatttcacttgcaaaagcggaaccgacggacagcgttactatgcgtgcgccggaaactcaaacggtaacgagcttttagtatatgaccctctttatagtctttggcataaagaggacaacacggaattcattgactttgttcgctataacgaacatctttacggcgttactaaaaccgatatgtataaattttcaggagagagcgatgaagagataaactggtgtgtggtatccaaaaaatttacccttgatgattttgatttcaagggaataaacacagtatatctccgcctggatttaaaatcaggctccaaagtcaaaatatactcagcctgggacaatgaggattttaagttttgcggtgagattcagggcaatggttttatggttcacaaagtgccggttagattcaaaaaatgcgacagttttcgcataatgcttgagggcacaggtcaggcggcagtgcacgacatagagataatcacatacacaggaggtagaacaaatgccaaacacatcagataaatatatcacagataacaaattggcggcagcaaacaaatccccctccctttcaaagaaacagacagtaccgtccagggaggacggtactgtcggaatccgctccactctgaccaacatggggataagcaatgacctgattggctatgacgacaggagcggaaccgtcaccttgggcggccgaactttgatgaaaccatcatatatggatgaaaacgccggagtttcatatgcgagcccatctgaaatacagaacagtctggtaagctattactccaagtctaataatccaatagtacaggtttcagacgcatattcaaaatatgcgggacaatatggagtatcagcagatgcgttaggttacagcaacggctcggccactatagggggaagaccgctgaacaccttatatacagatgaaaacggaaaggcatgggcgtatcaaaacgatattgaggacctaacatcagattactttaacacccttggggtctcaactccaaacgaaatattagatgagtacaacaaccgctatttaaattcaatcacaaacctgagcaggtctataatgaaccgaaaagactttgagtatgaccctgacgatgatccggtttatcaagcctataaagaaaaatacctcactgagggtaatagagcaagtcaagacgctatggcgaattatgcggggcttaccggcggttatgggaactccgccgcggctactgccgcagcgcaaaccaaccaatactatatgagcaaactcggagaaatggtgccggagcttgcacagcaggcatatgaacgttatgcggacagctataacacggacataaacttattagaaaacatgctggacacctacaactcagcctacagcaacgcatatggagccaacaacaaaactatttctaatatcaactcagttctcgcttcaaatacagaccgagacaaagcggcatatgaaaattattggaacacactttttaaccaacaaaaatatgacaaaaatgaacaagattatcgctggacagaagccaataattctcaggattataactggaacgaggtactcaacggtcaggaatcaacacaaaataatttggatatagaggattccagaatggataatgtaatgaaacaaatatatatgcagtattacaaccaaattattaataaccagttaaattctgaaagactgaacaaccgtttaacagaagaacgaattaaccagcttatgcttcaaaacgctatggggtattaaagataaacaggagtaatattataatataatccggctgtagtgtaaaaatattttaagaaatcacactaatataaaaaacaagggactgcaaatgcagtcccttgtttgatgaaaaactaaattaattgcaaatagattataaaaccaccggcgtataataagcaattgctatataatataccagaccttgcttattaccatatgtcaatttaattgtaccatcagcctgtgcatcagaagcgtcaattcctctgaatacgccttcagccattgctgccgctgccgtaatagtaccaaacttgcctgcatttgcaccctcaagttttgctattgttgtatcagcaacagagtttggcgacaacattgtgaatatctgacaattctgatctgcataagaatctacgagacccaaatcaataaaatatcctgctccatttgaacccttagatgctttcttgttccagcttatgcttgttccgctaagaggaagtttccccttaatatcaagagccgttgctactccatagcttttagatgtatttgtcaatgtaaatactggagtaggatgtgtaccaccttgatatgttatagccggtgcagttgttgaattaatagacgtattgtgcgaaccatcaaacaaatactcaacatatccagtaacctgagcaaatattgctcctatagtaacatcagatgcaggcattgtaaacgtatattttgtaatatccgttgatgtaattgtttctgcagcttgtgtttcatcaaccacatatacttcctgagttacgtatccgctgttcggagtaactgtaagagttactttttcaccctctgctgcggttgctttatctgatgaaacacttccgtttgtataagcatccaaattaacattatactttgttggtgtaacaaactcaacagttacttcaacattgctgtctctaacagtaaacaaattcttatctgtgtcaagtgttgctccaacaactgtaatctttgcaacttgttcagcaacatctggtgtagctgtaatacctataacagttccttccggaatactgttataattagctgggtctattacagaattatcagcagcattataaagttctacactgccgcctgtagctgaaacgcttacactacgtaaagcattataaactacatcaactgtaaccgcctggtttggcattataaacttattatctgcagtcaaaggaatctgaattcctccggcagtaaccgatacacttactgcatatcctgttacatctgatgtttttatttctactacatcaccttccggaatatcaccttcataagctataccgttagaatcaagtaactcagctgatgcgccggctacatctgtaacattaactgttgctgcgttagctgcagcttcgcttaccggtgctatagcaaaagctatagggtctgaacagaaagatgtatcagttctgtaatactttgctgtataagttcctgcagttaatgcaactgtatatgtcagagccttaatagcataaccatcacttgctgacgccagctgaggacttatgtctataagacgagcatcaaaagccggagtagaagaaccactctttgttaatgacatactatttccattattaggattgtaaacaagcatatatactttgtataatccgtcttcaggaatctcataactcattgttgtgtaattatggctcgagccgccgaggtatcccattttcttagctccggcttttgaaaggttctcaccaaatattgctggataaacccctgtatagtcagctgttatatccttgaaagccacatcagctgtttttccgccgtttgatgtgctcattccggattcagctgttacaattgttaccggcgccattgtaggagcctcagttggttctgctgttggctctgcagtaggagcctcagttggttctgccgttggctccggtgtttctgttgcaggtgcagctgttgctgtaggagccggtgtttcacttggctctgcgccttctttgaatgcaacatttatctccacatttgcttccggcatactaaatgtataaccttctgcattttgagaaacaacagttttatttccgttttcaggtgtatagcttacttcgtctactgaatatccatcgtttgcagatggcaatactttaattgtatcaccggcaaatgcctcggtagtttcaatatatggtgtaaactcgatatatccaactgcaatcttagaagccggaacgaatacataataatcgtatccaaccttcatctcaataggatcagatgtatatgcagcttttgacggagctgttaccttatataagtatgatccggttgtttcgccctgtttagcttcaataactgtaaatatcttacctgcattagtcatatagttaactactgcctgaccgctctttgcagatgtaagttttaaaactgttccatttgtcggcaagtccttatctgaaggagtaccagtcaacgaagacggacgaggattaccatttccgctgataccgtcaactgtatctgtgttatgcttccagaaatctgacgctccgcctgtagcattattaagaggatcaattgtaatatcacctacggtaattggctcaggatctactatattctcaaattttgctaggtcattttttgctgtccacttaactttattagctgtgtcagctgtttttgtaactaactccggatgagatacattctgaacgtcaaatgaaccgtttgttgttgcacccattgtatatgtatatcttacactaggtgtagctgatgggtccggtgtcggcgcttctgtagcttcaggtgttgctgttgcaggtgcaggtgttgctgttgcaggtgcttcagcggccactatagcagcagctacaaagtctgaacactgaccaagttctgaataatacttaaattcatatgttccagcttctaagttatctatatcatatgtatagataaacaaatcctgaccgtttgttcctaccttttcactcttgtcaaccaatgttccctgaacaacctgtgtaccatccttgcttaacgcaaactggttattgctctgtgcatatgataccataatatatgctttatatgatccggtctcatcgattgtgtaattctttgttacatatccgccaaagtttgaaccaaggaatccaactttgcttgttccagccttagagaagttttcaccaaagatattcgaatattcctcagtgtaagcagctgtcggctcttttggtgcgtcattataaacttttgcgctgccgttgagagtcatatcaccggcaatcataacttccgcaggtttagctgtaggagctgctgttgcttccggtgttgctgttgcaggtgcttcagcaaatgttatgtctgctgttacattctgtcctggcattgtgaacttgttattctcaactttaacgtcctgtccgtctgcacccgttactgtaactgatgcaacctgaccggcagtttcagctgttgcgtcaactgttactacatcgccttccggaatcagatattgaactgcaccatcaacaccagcagcgttagctgcaactgttgtatttgtcaaaataactgagaatatatccggcaaccattgttctgttgtgttaaatgttaatgtagcgtttgttaaagctgtttctgcagtaaatgtaaacttatatgcctttaatacacgagatgcattattatcttccctagctaccggaactccgctggctgcagggattgagaaacttatgtctccaatagtagcatcaattgcaacttcgttgttatagcccaaataataaacgttgtacgtacccggctctaagtttattccttcaatgtatggctgtgatgccttactgcctgttccacctacataattcttatagttagctgttaatgcaggagctactttagcagcatcgcttccatccgcaaacaaagttctaatctcttcacttgcttcatcaacaaatgtgcatgtatcgccttcgcacaaatttccacccttaatttctgaggttgatgtatatttatatgttacaggtgtaacaggagctgttgttgctgtagcagcaggctcatctgttggagcgtctgacggttccgctgtaggagcatctgacggctctgctgaaggttctatggttggcgctactgtagcttcaggtgcatatgtaggataaacatttccttctgcatccttaagaactgctgttccgcctgttacgttaactgttgcgatatacttatttggttccggtgttgctgacggatcaggtgttgccggtgcagcaaccggaactacagctatagccaaaatatttctgctgttattagctgcagatgttaccttaactgtatgttctccatttgttaaagtgcctaaattatattctgtcacagtcaaatcaacattgcttccacctgcattatttgttgccatcttacctggagtttgactctcgggttcaattgcagcgccattatcaacactcgctgtaaagtatctgttattatattcaatactcataaccatcagcttatattcgccgtcagccggaatattgattgtcttagatacatttcttccatcgccgttcattaaagcaaactttgctgtgttaacgctatcgattggatcgccaaatgttgatttcatctcatctgttgctttttcagtccatgtataattttgaccagcgttatcgctaagcactgccccgccgtctaaagtcaaatcattagcaggaactactattgaagataccggaaccgctgtcggacttggtgtagaaggagccggggtagctgtcggctgacctgatacggttatagccatatctgcaaattgtgcggctgcagctgtctgaataagacgaacctgtcttaaagctgtagacttacctgcaattgcgcccatctttgctgtgcctgccactgtgccatccggagctgtaacttttaaagtaataaagtctgttccttcatagtcgagagttatattaaacttataccagccggctgtcatttgactataatcaaacagcttattttcttctgccggattaggtccataatttacagatgaattgttgttatttgctacttctgcaaatacatattcaccattaggattctgatagttctctgttccgctctctaaataaattctaaagttctttggaactgccgggtcaatatatacatctaatgaaacattagcctgacctgctgagacttcctgatccaaagttgtgtaaatatttctgctcgttacttcgatagctgcttttccgccttcagcaggatatactacttctgctgccgcgccatctgtggtatcgatttttgcttgaccgatattccagttagcatagcttgggaatacaggtgtagctgtcggaggagcaactgttgctgtggctgtcggttccggtgaaacagtagctgttggagccggtgttgctgttgccggtgcgtcaccgaatgttacttccgttgttacattctgtcccggcattgtgaacttgttatcgcttaccgcgatgtcctgtccgtctgcacccttaactgttactatcggatacaaacctgctgtatcaggtgttgcgtctactgttactacatcgccttccgggattaaatattgaaccgcaccatcttcagccgctgcattggctgtaggctctacagtaaatcctgctataaacaagtcgccgcctgaattgtcagcgtcgttaacagctgtcaaatatacagtggttccagcacttgcattaaatgtaaatactccgcttcctgtttggcctttacccaattcaactccgccgtttgttgtgcctgctgcatatactctggaatcatgagcatttccatatacagttaccgcaacgtcaacggctgttttaaataccaatgagttctgagcgcccttcagacgcattgaattaagatgactagctccattaatttctgaagatttcttgtttgtcgcagcattgtttccagctggtgaatatacttttccgttatcaagcattgtaccttcgctgatcggcaaagttcctgctgaattgaaatcatctgctataaatgtgtagctttctgtaatctctgtaagcggcggcattgtcggttttgctgttgccggggcttctgttggctcctctgttgaagctgttgctgtcggaacaggttcttctgtaggattagaaacttctactaaaggataagtatttccgttcgcatccttaagtacagctttaccacctgttacgttaaccgttgctacatacttctgaatcggtgctacggttgctgttggtaatggtgttgctgtcggctcatccggtgttaccggtgttgccgtcggcttatccggtgttaccggtgttgctgtcggcttatccggcgttaccggtgttgctgttggcttatccggcgttaccggtgttgctgttggcttatccggtgttaccggtgttgctgttggtttatccggtgttactggtgttgctgtcggcttatccggtgttaccggtgttgctgtcggctcaggatcctctgtaggaaccggtccttctgtagggccgcctgttgttgtaacaacaaatgttacattataagcagcatcatcagatactacaattgtgaatacattttgtccgtctgtcaatcctgcaagataatcctttgagattgtgagttttcctgtttcagcatcaaaagtatactgatcagctgtaagcatttctccgctctcagtcttaactccagtaattgtctgaccttctgtcagagttacagttgttgctgcgtcatttccaaatgctgctgttgtcttttcaggatagatagaaggagcgtcttttgccaaaactatagttgaaacatcagacacagttccattatagtttgttccatcacctgtaactacaacttttagatacatgcccttatcggcttctacagctgtatatgtgctctttgttgctccggaaatcttgtctcctgttccattgctttcttttgttctgtaccattgatatgatacataattcttagcagctgccggagcaagattcgtagctgttaaaacatctccaacataaacgttgacataatcagtcttattatcaacagctatttccacgtctttcagatcatagttattaatatgtcctgcatacaaatcgtaattcttgttaacagctgaaacggtcggatcgaatgtagttccgctgcatttctctgctgctgacttagatgtgtaccaaagaccgtcccaattgctttcggtcggtgtaggaacagaactttctgacaacttcttgccctttgttacactcttagtcttaacagttccataattttcgccgtaatggaatttaacagtaagcgatgtgggtccgccgccgttaccgccaccgccgctgccaccgccgcctataacaatattgttaggctttgtggttgcgcttgggtttgtaacattgcctgtgtttgatgtaacgtttgctttttcagagagattaacgatatcccctgaaatctgtgaacctgttatagtaacatcgccgctcacctgaggtgatacaacaacgccgcctgcaacgattccgttaagggtaacgccgcctgtctttatcataactataccgccaacatattctggaccgtatgaaccgggctctgttatgtaaagcttaatcatattatcaataatcttaacgaactctgctctggagatataatccttaggacgaattgttccgtcttcatatccgcctacatatccggcagcggtcatagctccaacataacctgtagcgtagtcagaaatgttctgatagtcagcatactgggtaatgcctgcctgagtattctcaaccgtaagaccatacgcacgcgcaagcattgtcatagcctcttcacgggtcatgtagttattcggagtcatcgttccgtccccgttacctgtgagagtaccagcagcaaccagctttaatactgcatcagcaaaccagtctgtagttgatacgtctgtgaacatattatcagcaattttttcataactgataacattatcggttacctgtgcaacttctgcacgcgtaatagcgtcgtcaggtctgaaataaccgccgtcgccctggattacgccatagccagaccaagtgttgatataactctcagcccaatgaccttcagtatcattgtactgagccgctgaaacaacggtcataccaaaggtggtcaaaaccatagcgatggccaatactaaggccaaacttctcttaaaggttctcattaaaaaacccctccttgtgttttttggaatataaaattcctatatatttaatttttttacatatgtaattactacctgttgtatctaaaaacataaacacaacaaccgatacacaatatatatgtaccgtaactcaaatatgctgtaaatataatacatttaatgtttacattatagcatatttgtaacaaaagcgcaatacttttgtggctaaattattaacaatttttatttcgaacatatatttttgataaataaatgataatataataaatatataaatattacgctttttattggaatataaaataaaaaacaaaaataaataaatattagttcacaaaacaatgcggtgtaatatttatattaaatatatgtgaaaaaaattcacttatatattaacttctataagtgttaaattcactaatacaaaataaactaattaactactaaggcaaactgcataatatcagcaaagatcacttttctttatatattaaacaaaagcccatgacaaatgccatgggcttaattatttatttttatctcaaatgccaaatttctttattataactttcaattgtcctgtcactgctgaagaatccggcttttgctgtgtttattacagcttttctgttccattcatcctgattatctttatataaactatttgcctgctggcaagtgtgaacatacgattcaaaatcaggcaaaagcaaatatgggtctgcaaaactgccgttatttccctgaaccaaagacctatatatatcataaaacagattatgctcgtctccggagaacgtcccgtctatcagtgtgtcgacaatgctcttaatccccatatttgtagcatacaattcagggctcggcgagcggtttgtcgaatatagtcctaaaacttcatctgactgcattccaaaaatgaatatattatcatcgccgacctgctcccgtatttcaacgtttgcaccgtccattgttcctattgtcaaagcgccgttcagcataagcttcatatttcctgttcctgaagcttccttgctggctgttgaaatttgctcgctcaagttagcagctgcaacaatcttttcagcaatagatacgctgtaattttcaataaatacaacttttaaaatatcctttgtcctggggtcattattaacaaccttagctatattattaataaacttgattatcagttttgccatatgatagcccggtgctgcctttgcagcaaatataaatgtctcgggcatcttatttgcattttcaggtgtttcggtaatagatttatacctatatattatatgaaaggctttgagcagctgtcttttatattcatgcagtctctttatctgaacatcaaataaagatgcaggatctacagttatatcattatgatccagtatatattttgcaagtttctccttattattaagcttaatctttgcaaatttatctctgaacactttgtcatcagcaaacggaagcagattttccagctgtgtataatctttcacccagccgtcgcctatcgcttcacaaataagcgaagaaagctcagggttcgccttatacagccatcttctgaatgtaactccgttagtcatgttcttaaacttatacggataaatgctataataatccttgaaagtttctttctttagtatttcagtatgcaaagccgccacgccgttcacactatggcaggcagtcaagcacaaattcgccatgcttacctgtcctctgctaattacagccatatactcaatcttgcctgtgtcaccggggaaacgttcgttcagggcgattctctgccgcctgtctatctcatgaataatctgaccaagtctcggaagcagcgaatccaccatgtccatcggccatttttcaagcgcttcacacagaatagtatgatttgtataagcgaaagttctgccgactatactccacgcgtcgtcccacgacatgccttcttcatccatcagaagtctcataagctcaggtatagctatggtaggatgtgtatcgtttatatgaatctgcacatattccggaatatcaaacatagacaaattcttctgtttatgtttggatattatccactggattgtggctgatacaaagaaatactgctgcttcaatctcaaaagcttgccttcataatgattgtcctcaggataaagcacttttgaaataacttcagccaaatctttattttcattggctttagcataatctcctctgttaaactctgtcatattcataatctcaggcgagcaggctttccaaagtcttaaagtgttaaccgtgtctgtatcaaatcctgtgataggcatatcatacggttccgctatgacagtattataatcaacatgctcaaacttcatatggccgtcttcccacttttcaataatacggccgttaaaatgaacttctttagtgtcctcaggtcttgctatatcccaaacattcccgctctgcagccacgggtcaggcatctcgatctgatatccgtcaactatcttttgcttaaacagtccatactcatatcttataccgcagccaaaggccggcaaatccaaattggtgagagaatcaaggaaacaagccgccaaacgacccagtcctccgttacccaagcctgcgtcagtctctacctcttcaatattttccagcgaaaatcccagctcttttaatgcgctcttataaacttccgtctccatgatattcattaaattgtttcccatagctctgcccattagaaactcaaaagataaatagtaaagctctttctgcggctttctctcacatttttcctgatagcttacccacttttccattatctcgtcgcgtatagtgagcgctgcagcacggtagacttccatgtcgcctgcttttgctattgtttttccaaaatagcgtttcaccttaccggtaatctcatcctttataaagtcctttttcatatcaaactcgggcgttccgggttttaattgtctatgatactcagcaacattttttgccgttttatcttgcgtctctgccttagaagtattgtttgccataaataaaatccctcctgtgcatataatcgctgtattattataatattattcatcattctaatacagctccattatttattgtaccttattattccaattttatcaagtcaaatcgcacaaaaataaggttgtatctgacatctttatgtttttttgtaaaaattgcctattacatcaatcttaattggctcgtctcttatagtctttattgtggtttttaacaaattttaagccgcggaaaccgaaacatgtttccgcggctatataccttattgttattatttgctgtctataagagtttttattctctgcacaaagagagcaacctcaatccttgtagcgtcatcttttggacggatagttccgtcgccgtatcctcccataaggttgttttctacacacgccgctatagcgtctctggcgtaaaagtcaatatcacgccaatcccaataattattaagcgcctttgccgtgttcggaattgccgtcaaaatttgacgggctttcaaaactctataagcaagtgtagccatatcctgcctctgcatagttccgtcaggatcaaacagattatttccaattccccatgcaacccctgttgctttggcttgtcctatttcatcataatagtatttatcaggatatacatcatcaaagttttctgtgaaagttatatctgcttcctttaatattctatataacaaaaccgtagcgtcggcgcgggaaataaatatatcgggtccgaactctgtatcacttatgcctttaactattccctggtttacaagatcttcaatatacggcattgcccagccatattcacccatatcagtaaactttgaggcgtctccgacgtttgttggtgcgctcgtggggtcagcagcaatcggagcgtttgtcgggtcagcggaagccggctcctgagttggctcggaaggcttgtcctcaggtgcctgagttgcctcaggctgaggattaggctgattaatttctcccagcgtcggagcagcggcaggtgtagaatgaagctgttttatgaggttatacagatttgaatttcccataaacgaagaatactcaaacatgctgtaaccacctatatactggctctgcctgcacattgaaacctggttggacaactcatttataccattctgccctttccaagcagcttcagaaccggaagccgccttataagccgcttcgccaatataaagcttaacatttgtcggggcgcaaacacccgcccaccaatttattaaagtattataatcagcgtttggctggccattataccaatatatctgcggcattatataatcaagatattcccgttcaacccacagtttggtatccgcatacaagctatgatatgaactgcttccatttgtattgctgcctcccggtgtgtcgccggcattcgcccaaataccgctcggacttactccgaacatacagtttggtttaatttcctttactgcgtcacgggcacaagagattaaagtagtaaccatacttctgcgccagtccgctttgtttggatatgcgtcctgatacttaaaataggccgcagaatcgtcaaatccgctgcttggataaaaatagtcgtccatgtgaattccatcgacatcataatttcttacaatctctctgattccttcaagtataatgtcgatagaatcagcttcgcccgggttcaaatacatcttgcccgaactgtcggtaagcaccaagtcaggtcttaatacagccggattatttgcagccaatttgccattatcattagacgagttggtaactcgatatggatttatccatgcatgcagctgcattcccctcttatgcgcctcgttaacagcatattcaagaggatcaaacccgtcgctcggagccgtaccctgtattcctgtaagataacgcgaccacggaaatatatccgacttataaagagcatctcctgacggccttacctgtaaaaatactgtattaaaccccatatcctgacagttgtccagaacctcgtccatttgaactctaagctgccatgcatcagcagtaggcgactgcggatagtccaaatttccgaccgacgccacccaaattcccctcatctctgtgtcctcagcagaaactatatcagttttcggtgtatagaacaggttaaccgcaatggcggcacaaaccgctaaaactatcagtttcatactgaaatcaaatcttttcattacgtttcctcctatgtacattttatatcttgtctcactctaaaatattatatgaaacgagtgtaaattatagcacaacttttacactttgtcaatttgacagatacacaaatcaataaataaaaaatttccaaaaattccccaaatcaaaagcaaagtacattaaattaaaaagtttaattcagacattaaaacacgtcttataaataagcagcttcaaattgtacaacaagcacaatttagactgtttaaaaataagacgcgtacttaatataataacttaaatgcagatgtttagtctgttatctcgcaattttctacagcatatctaagcaaaataccaattaattcatttctcgacctatttgtatattcggcaatattatctattctgtcaacgagctcctgttccagtcttaccgaaaagactttaaatccatcgtcccccttcagccttctcttggatatttttaatttatcctctttcactagttatcacctcataataaattatatgttgacaaaagcacagaatatatgttatacttaataacataatatgtaacattaaaacagtttgaggtgatattttgattaactataaaagagcatactttgttatgcgcaaagatattgaaaaagcgattgagcagatacgtaacggccaaatcagtgaagccgatgcaagacttcagttttcacttataaaaacaggcgaaatgtatgatatatgtatgaacgatgaacccgaaaacaactaaataataaaagtttaaaaaatatctcttataaatgttattatatccttatatacgctctttacttaaataaaactcttaatatttttaacacatacagcaaaaagcctccatactaaaaaatggaggcctttctattatctaaaactttatattaatttaaatcaacactctgtggagaatcaagatatggtatgtctcccatatcgctccaaataaacacttttaatgtattggcatttaatccgccgtattcaactccgcttatcataaaagttccgttttcatcaaacacaggagttatctttctaaatcctaccagaattccgttactgttatagatcccaactaatacagcgctgtcttcacagcttgcgtcaactcgcgtcacagtcacatctacggtctgttcagctttatttactacgatttccggttctccaaacttttcgggataaggagacacaattggttctgccgttggtgaaacaaccggagcaaaagttggggtcatagttggcgaatctgttactataggttcctgcgtcggagcagaagttggattcgggggctctgaaactatcggctccagcgttggggcggacgttggacttggagattccgaaactaccggctcttgcgttggggcggacgttggactcggtgattcagacgctattggctcttgagtcggagatgtggttggcaatggcgaagcggacggctttaagctgtttgagccggtataagctttaatacaccaattatatccgctcaaatatatatcaccccagccattaattgtatcgcccctcttcgaagaggaataaaaacatacatttttctcaggctgatagtacgaagcattaacgcctttagtacatccggctattctatattcatcagtggatgtcttcgaatcattagactgtctaacatatatataaaagcttccattaacatcaataggggcagctaaatctaaaaccttgtacccgggtgaagaaaattgtactgattttgaaattacgccggtatccggatctttcaaattcaccctattatttttaaactcgctttctgaaaggttcattggcagcgaagtatctttaggactgctgtcaaccattatttcaaaagtatcatccatatctaacgcatataaaccaatagattttaaaggttcattggcagcgaagtatctttaggactgctgtcaaccattatttcaaaagtatcatccatatctaacgcatataaaccaatagattttaaaggttccttgccgctcgtttcaaaccgtattgcctgatacgtacagccaaaactattcttaagactaatacttcccatcaagccaacataatcataagaataaatattctcatcagtttcatctgaaaatttatacccggaagccgaaaaacctatagttggatccatataagaaatatactcatatccatcattggcccaatcgcttccccagctgtttcttactatccaagccccattctcataattataatcttttccgtcataagatgaaggtttagttttaaagtttgtgtatgaataattatcatcccagcctatcagcgttactgcgtgattagtaggcgtattaaatttatattttatagaaccgtcattttgataaaagctaactttgttattatcaggagctgttccattaagcaaatcactccagcttccgcaataagctccggttttcgaattataatatccgtcatggctttcattagaaagataggacactgccaccgcgccgtatttcataatcccggcttttatcgcgtttataaccgattcatttttatgatacttaatattctttatagaaccgtcttcataactataatctagaacagaactgccctcgtataaatttgtaatactctcctgcgaaataagctttccggctctgtcgatacccaaaagagatgaataatctgttctgtccccggtatactttgaatatttactattatcaaaatcctttaataatacagaacctccgccggtctccctcgacatatacgcaaccgccatagcagtattaccgccggttttgttatcccatgtaaaagttttatatccctcatcattggtataattcattgcagccgccatgtggtattctgaaagtatttcattatcattcttatagctcttgttgttaagaacaacattagaatattcctgggcagcagtatttgcaaacgcccagcagtcaccgtcaatattttggtcccttaccgcagggaagtctttcttgtcttttcctgcatccgtttcagtattatacttttcaggcataacctcttcaagataagcagaagattcgctttttccaaattccacaggctcaggaatgactgtataagccgatggatttttaaggtaatcctgatatgcgccggtctgttcagctacaatcccgccgctgtaaataacatcagcaccgattgactcagcatatccggatccagttatcacaatagcaaaaacgagcagtaatacgatactttttaactttttcataattacacctctgacagaaatttaatttactttaattaaataaccctccaacctatttcttatgttataaaattataaagcattttatcattataccatgatattcataaaattacaatataagacataaaaaatattatagcatgttatggtattttgaggacgacgttaattaatatggcgttaactaatataataagcaaaatttaaaattctgtaggtttgtcaatgatgtgttacaaaaaagattaaaagagttcaccgaaattgataaaagagttgatgtagtcaattggagctttccaattttaaaggtgcataaccgtaactacaataaattcccgatgcgtccgcttaattggaaagctccaattgactacatcaactcttttatcaatttcggcgaaatcttttaatcttttttgtaacacatcattgacaaacctacaaaattttctttttatttttgagctaaataactatatatttttatatcttattttattccttttacatatatcgtcacatgcttttttgcattatgtttttataagattagatatatataacaattgtaacaccattaaacaaacattaatatataaaaacaattggaataataagataagatgctgtcttaggacatatcataatataaagaaatatgaagctatttaagaatagccaatttgactttactgcaaaatattcgcgtcctacagaatacaactcaccctttcataatccaattatctccttcttttattactgtagccgattgacataaaggctgcatagtatttaaaccgctccaccacataaccttaattatttttgcaccgattgcctgaacatcaaaattaacatcataaacattgcggctttctgtctcagccgcaggttgactcattgtaagcagtctgccatttgcatcgtatactgctgcaaacagaatctccccttcaaatataggaccatttagttcgattataatattattatcagctacaccaacactttgtattttctgttgaaccgtagttacagaaacttccttatccatcttcgtacggtccatttcaagaacaagaatccaagaagttgcgtcgggtgttgtaagaggccacctaggtatagttacttcaacatcaattgctccggttgtttcactgagcgacgttatctccaacttaggcgaaccgccggttatggtcacaagagtaaaatagagtaacttatcctcaaaaaaagaggcgtcatatttattcctatcaaaataaagcggtatattgttatagtgatattcgttaatataattatcaagttcttccacagaaaaaactttcaccgcttgcggacggctgtgatcattcacccctactataagtgaagcgttaatctcatcggcggttaattcattaaaatcaattgtttcatctttcgcacttacataaaatcccgaaaatactgttgcaaacataaaaattgcagcacaaaaacttataaatcgtttattcattacttaaccccctacatacagtattaaattttaatcacaaaactcattttttatgtaaagcaaattttatttctagtacattatcactccccacctttcatacaccccattaacgattttaaacaaaatttatctcaaaatccttaaaacttacaatattactttgttatatcttacatcttcattaaatagaacgttttattattatagtttttgagcatttctaattaaagagttcttaaatttaattatatatattatataattataaaaatactttttatttcgcattatattaataatataacataatatctttattttttcaacgatacaaataatatagatgttttttctatataaccgacaaacattattaaatatttttagcaattattactaacacaaaatatatttaatagtatacgaaattttaaataatatattatattactcaaatagaattattttttctaattatagtcatttcttcacaacaatttttaaagcaaaataatgattatcatatattaatagcaaaagcataacagcattaatcatataacatttgtttgattgatataatctgctgttaatatttttatttatataatacatatatttttctataagatttttcttccgataaaacaaaaagttcagttacaattccaaagacttgccccttcttcttctatcttgctttttatttttgattttctgtataatatgtatagtgaacacaaaaaatttatttttgaaatataaatattatttacatttaattcctgtctatatattatgtctttttagtatattgtccctttattttacaaataatattgttacaaaatttgttagcttatgttttgacaaatttagtgctgtatggcaattacaataaaatataaaaaggagcgttaatatatgaaagcaaccggaatagtcagacgaattgatgacttgggacgtatcgttataccaaaagaaataagaagaactttaagaattcacgagggcgaccctcttgaaatatacacagacagtgacgggatggttatatttaaaaaatattcacctatcggagaactcagcgaatttgctcatcaatatgccgacacattaaacaagtctacaggtttactcacctgcatcacagacaaagacagtgtaatcgctgccagcggaaacggcaaaaaggaacttaaagagaaaaaggtttccggtgaagttgaaaaaataatggaaaagaaaacaatgttctattccaagcaaaatgagaacactatcaaaatcattgatgacagcgacaaatacaaagcaggagttgtagctcctatcgtacacgacggcgaccccgtcggaacagttatattcatagccgagcctgaaaagagtatgaacgaagttgagcagaaattagcggaaacagctgcaggatttttaagcaaggctctggaataaaagacatagaatacgcccacggctttaggctatgggcgtatgtttttatacaaaatccgacagtattatatttgacacatatatataatcagattttatttttattatgtccccgtactcttccattgttttgagcaggtttatatgcttattcagctgttttccgaaaacatcaaaaatatcttttccaaacatattcataaactttttttttgaaattccacggtcaagtctcagacccaaaaacacaaattcacacattcggtcatattcagcagttttatcaatctctataattccacttccgctgttatttacacgatctatatatccgctgacacttctttcgttgttaaaacggaacttccctatacatgaatacgctcccgctccaaatccaatataatcatctaaattccagtataaaagattgtgacgtgattcataccccggctttgcaaaattcgatatctcatatctgttatacccattattatcgagataatttacgcagaagtcatacatctccctatttttatcatcatcgggcaagtctaaatttccgtcgttaaaaagtctccaaaagggcgttccctcttcaatctttaatgaataagccgaaatatgttcaggctccagctctgccgtcttttccaaagtctctttccataagtccaacgactggttcggcaatccaaacatcaaatctacagaaatattttcaaacccggaattcctggcacttttaaaacattccaaaaaatcattatagttatgtaccctgcctaaactttttaacatatcgtcatctgacgactgcatacctatgcttaagcggtttataccgcatcttctcagcctgctgagtttttcaaagtccgctgttccgggattgcactctatagtaatctcggcgtcctcttcaatcgaaaaattatttttaacagcctcaacaatcttctctgtcagcgcggtatcaatatatgtcggagttcctcctcctatatatattgagctgagtttagtatcaggcaattttaattttgccgtttcgatttcctttatcaaagcatccgcatatgaataactcatatccgtcattcccgaatatgagttaaaatcgcagtatttacatttttgtttgcaaaaaggtatatgaatatatgctccggtcataatttaatctccaaaattattcatcaagcttcaatacggacatgaatgcttcctgcggcacttctacgcttcctacctggcgcatacgctttttaccctccttctgcttttcaagcagcttacgttttctggatatgtctccgccgtaacactttgccaaaacgtctttgcgcatcgccttaaccgtctcgcgggcaataatctttcctccgacagcggcttgtatcggcacttcaaacaactgtctcggaataacctcttttaacttttcagccattcttctgcccctggaataagctctgtccgaatgaacaataaacgacagtgcgtcaaccatttcaccattaagcagcatatccagtttaaccaggtctgacctctcatatctttcaaactcataatcaaacgaagcgtatcctctggttctggatttcagcgcgtcaaagaagtcatatataatctcgttcagcggcagaaaatagttgagctgaaccctggtttcatcaagatattccatatctatataggttccccgcctgtcctgacagagctccattatactgccgacatattcctttggcaacagaatcgaagccctgactatcggctcctccatataatcaatttctgaaacgtccggcagatttgttgggttgtctatagttaaaattgttccgtccgtttttattaccttatactcaaccgacggcgcggttgttaccaaatcaaggttaaattcgcgctctaacctttcctggattatttccatatgcagcagcccaagaaatccgcacctgaatccaaatcccagagccaccgaagtttccgcctcaaaattaagcgccgcgtcgtttagctgaagtttttccaacgcctcgcggaggtcgtcgtatcttgctccgtcagccggatatataccgctgtataccatagacttaacttccttataacccggcagagcttcctcagcgccgttttcagaagttgtcaccgtgtcgccgacatgaacatcctgcacgtttttaatgctggcggtaataaatccaacctcacccgcagaaatttcatcagctgaaaccaaaccgttaggatgcagataacctacgtctacaacatcaaactcactgcctgtcgccatcatttttattctctgaccggattttagcttgccgtctataatcctaacataaacaataacacccttatacgcgtcataataagagtcaaaaataagcgctttcagcggtgcgtcttcatctccggccggtggagggataagctcaacaatcttttcaagaacctcttcaatattgattccgtttttagctgatattaaaggcgcattttctccatctatgcctataacatcctctatctcctgcttcacctcgtccggtcttgcgctgggaaggtcaattttatttataacaggtacgatttcgaggtcatgctccatagctagataagtgtttgccaaagtctgcgcctcaataccctgggcggcgtccactaccaaaacagcgccctcacacgcagccaaggaacgagacacttcatagttaaaatcaacgtgtcccggagtgtctattaaattaagctcatactcttttccgtctttagctttataaatcaatttcacggcacgcgcttttatggtaatcccgcgctcacgctccaattccatattgtcaagtatctgcgcctgcatctcacgctgggttaaagccccggtaaactccaaaagcctgtctgccaaggtgctttttccgtggtcaatatgagcgattattgaaaaatttcttatattatcctggcgattcattagttttcctccaagtcggttaatcaatataaacgaacatgactgttctactgacataatattctaacataaaccgccccaaatatcaacatcaaatttgcctataatctatctgtatctgtctacatccttgagtgttattccatcatttacggcaatatttatcccatttgccaccactgaagatatatcgtcaattatagtgtcaacatctttcggcgcaactataaagcttccgaactttggttttataacctcttttataagctcatacttttcgtcagccatttcaccgattagctttaaagtctgtcttgtcggcaaatctttcaaaactcctgccttgccctggctggcagcattaaccagcatgtccagcgtatctccggcaattgtagcagcgtctacaaccgtgggtactccgattgcaattacaggcgttcccaaagtgtcaatatttaagcccttgcgcttatttccaaccccctcaccgggagttataccggtatcagatatctgtatagttgtgttgacgcgctccatttttcttgagcagagagcgtctatagcaataacaagtttgggttttatcctgtcaaccagaccccttattatctctccggtttcaataccggtcagtcccaacactcccggcacaatgccgcagattgagcgcacaccgttctgaatctcgtcagggacatactcttttagatgcctggttatcattaatgacgatatgaccttgggtccaagtgcgtccgcagtgatattctgatttcccaaacctacaaccaaaatcacatcatcgtcttttgttataaacttatcagtcaggcttttcagttcctcagcgcatacctggcacattttttcatatattttctgttctccatagaacctgctgggcatttcaatcgttatatagtcacccttaggctttcctaggttttcttctccctcttcatttaatatttttacgcgagtgacttttattatattttcaatagaatattcatcaacggatataccaccgacctcatcagctttttctgccgtttcggaatataattctttcgcttccagcgctaagtcgcatctaacttgttctgccattttatcacctcataaaattttatatagatatattttttcgtttatcttaatttatatactataagattatttataaaaacacacggcgctgagaattgaaactgtttttggattaataaaaaaatttaaaataattttaaaaaaagtcttgcattatggaaaatataatgttataatacgtaatactgatgtaaaaatcaaatcgttattgtttggaggtgaaattatgcctaacattaaatcagctaagaaaagagttaaagttattaagaaaaagactcttcaaaatcagattattaagtctcagctaaagaccgctatcaagaagtttgaagcttctttaaagcaaggacaggcagctgcctccgatgcttacaaggttgttgttaagaagacagatcaggctgttgcgaaaggtattcttcataagaacactgcttctcgcagaaagagccagtattcaaatatgcttaacaaaatcgcgtagcataatcaagatataacaggcggtatgcctgcaataaattgaatccatggttgcttaggcaacatctaacacttggaatcattaaaattctacaaatgatcggagccggacgcggctccttttttatttttaagttgacataagtcatattatatgttacaatacgttcagattttaagattggagttgaaagaatgcgtaatttttcttgctgatattttggcataacagaattatggaagcggatccttccgcctgtttgttatgcccgcgcaggaaagttaccaattcatacaactcaaaatgtttttatatatttaacctttttcattattatgaaattttttgagctgccgggatttactttcttgcagctttcataattttggaggaggtctttttatgtcccaaattaatatttcaaacctgacgtttgcctatgaaggcagctatgacaatatttttgaaaacgcgtcttttcagattgacaccgattggaaaaccggatttatcggcagaaacggccgcggaaaaacaacgtttttgaaccttctaatgagtaaatataaatacagcggaaccatttcatcatctgcaggctttgaatactttccgtttgatattcctgatgacaatgttgacacaattgatattgctgaatttattttcagtgattttgaatattggaaactttcccgtgaaataaacttgctcggcatgagcgatgatattttatatcgtcctttttccaccctttccggcggtgaaaaaacaaagtttcaattggcagttttatttttgaaagaaagtaaatttctgcttatagacgaaccaacaaatcatcttgacgctgagggacgtgaaacagtcgcaaaatacctcggtcagaaaaaggggtttatccttgtttcacatgacagagcctttcttgacaagtgtgtagaccacataatctcaataaacaaaacaaacatagaaatacaaaaaggaaatttttcatcatggcttttaaacaaagaacagcgtgataatttcgaactgaccaaaaatgaaaagctaaagaaagatataaaacggctttcacagtcagcgcagagaaccgccaaatggtcagacaaagtagaaaaaacaaaatgcggaaccaaaaattcaggtctcagacccgaccgaggttttataggccacaagtccgcaaagatgatgaagcgttcaaagtctatagtttcaaggaaagagtcggccatcgaagagaaatccggcctgttaaaaaatatcgaaacaactgactcgcttaaaatacaccaagtcccatttaaaacaaaacaattgattcatatggaagatgtatctataaaatatgacgcaaacataatttgcgataatataaacctggatgttctgcaaggtgacagagttgcaatagagggtaaaaacggctctggaaaatccagtatactcaaactgatttgcggtgaaaaaattgagcatggcggcactgttcaaataggaagcggtttaatcgtttcatatcttcctcaggatgtctcttttctttcgggcagcttaaagaaatattccatagagaaaaatttagatgagacattatttaaaaccattctcagaaagcttgatttttcacggacacaatttgaaaaagatatgaacaactatagtctcggtcaaaaaaagaaggtgctgatagcgcagagcttatgtgaaaaatccaatttaatgatatgggacgaacctctgaactatattgacatattttctagaatgcagatagagaacttgctctcagaatttaagccgacaatgatttttgttgagcaagacaaaatattttgcgatagtatcgcaaacaaaacaatccatatataaatgtattccgcatttgtaaaatacgtagtataaatttgctgactaatatactcgaatttactcatcctgcatattcaatattttcaggctgaatacatatttttcagcccgaataccatatttgcagcccgaaattctctagatttacatgacagcaaaataatgttaagcaaacttgttccgcacttacagccttatatactcctcatttacaatcaaacattttaaaattaaacagaaaaccagacaaaaaattaatggtgtttttagtgaacatcggtaggtgtgaccccacctgtataaggtgggtgttgatacatagtgacctgttttgactaagctacaatgtctataaattacttagttgtgatgtattgcgcgcttgcgcgtctcgttaggtgagctgccatctcacgcgaggcgtgggtataattaaaacagtttgtcataatcctttttattaataaattttcccacgactgcgcgccttacgcggcaaactccgtttgccctaccgatgcttgctaaaccgcatttttataactttataattttaaatattttcttatatgcggagtttttttgcgaacagcggtaggtgtgaccccacctgtataaggtgggtatgatacaaagtgacctgttttgactaagctacaatgtctataaattgcttagttgtgatgtattgcgtgcgagcacgcctcgttaggtgagctaccatttcacgcgaagcgtgggtataattaaaacagtttgtcataatcctttttattaataaattttcccacgactgcgcgccttacgcggcaaactccgtttgccctaccgatgcttgctacaccacatttttctgtagtttttatattccttttcattaaatttatccttaacaatctgttctatttatagtaaccgttccatttcgtctcattctttcatatacataaacttacttcttttatatagtaatcgtatattgttcattgtagcaattacgtctgcagttcttctcagagacaaaatgcttactaaaataatgccaaataaatgctgtatcataatataattgacgtcttgaaatggaaattattatatgttataattatttatactgacattgaaacattttatataaataaattttagaatggagtgatttttttgaacgaaacaattaaaacactgctggaaagaagaagtatcagaagctttaaaagcgaacaggtcaaaaatgatgatttggatttgattctaaaggccggaacctatgctccgacagcccgcggcacacaagcgccggtcatggtcgttgttcaggacgctgagaccattgctgaaatggagaaattgaatgcggaagttatgggaaatcctgaagctagacctttttacggcgctccgacagttattgtagtattctctgacacccgtcttaccaataacgcctttcaagacggaagccttgtgctcggcaacttaatgaatgccgccttttctttaggagttgactcctgctggataaatcgggcgacagaaacgtttaaaacccctgccggaatagagcttatgaaaaagtgggggcttgatgaaaattatattggtatcggaaactgtatactgggttacagagattgtgaactccccgaagccaaaccgcgcaaagacggatatataatccgaacataaaccaaaataggagagtatacaaatgaattttaactggttgaaaaacaaaaaatttactgttatagccgctgtattatcggcaatgcttgcggcaggaactcttgcaggatgttcaaatgtttcaaaatcagactttgacgccctggaaaaacgtgtagaagcactggaaaaaggcacagacaacgagagcggagataaaaactcatctgagacaaacaaatcaggcaaatcaactgcttctcccaaaacctcatcaaagccaagctctgataacggagagtttgactccgaaaatgtaagcaaggcaattgatgttcaggaatacgactatattgacgcagatgacaataagttttctttctttatctttgataacacttcaaacttcgacgtcaatgcccgaatagaaatagtatgcaaagacgcagacgacaaagtgcttcaggaaagcgaaaaaaaagttcccggattatcaaaaggcgagagttcattcgccagttttaaggtcgacaaagacaccgaaacaattgtcagaacagtgtattatgaagaatataaagggaaagacgtctcaatcggcgatatatccgctagagctataagagcccagggcggagccaacattaccattagaaacagcggctcggcagaagctgaagatataaaatatttgacgctgtttttcagcggcgatgatttggtcggatttgattccgataaagtcccggatattgaagcgtcatccagcaagaccctggcttctgtctgctacgaagaattcgacagccctaaggtttatgttgctatagacgacgaataatccgagaaaaatttatatataaatttattaaaattgggaacttatcaaaaattattacgtcttataaaatatagggagaagtttcaaattctgacctatctttagcaaagacggcaaacacagatgaaagtgcgtattcctctgtctatcaccgccgtctttgctaggcacccttataaattattttatggaagtaatccaaaattgggtttgttttcaatttattttctgtaaacaaaatagagcttcattatattgtgtcaatcttcaaatgttagattttttgtctaatttcaaaggtcggctcatattgcttgaagccctatttttttattatctcatattatcgcatacagttattcacatatttcaccggaacgtccattctttcggccgcttcttccactgtcattccgctgtctataaaacgcttacatacgcttttcatattttctccaacctcaataatatgtttatcagggtcataaaaacggacaactctctgtccccacctatgctcgtataccttatgaagatagtctatttcaagctttgatagcctttccgtaaacttgtcaaaatcatcttcttcaaaatatatttccgcatcgtttccgccaaaagaaatatctttatctgacgcattaataaactcgagccacgagtcttttgtttgaagacacaaccctcccgtcagagttatatttgctccaaagtccataatcacacgcagacccaatacttctttataaaatttctttgaattttctaagtctgttactattatcattggattttttaatttcattttgtctacctcactatttttatttaatatcaactgatttataattatctatacaaaacttctaaattgccgttatatcccatactatccgactttcccggcgcttttaataatttgcttttttcattctttattcctgattttttcgataacagtccctatgcccactcctaatatcattccaaataccaagccgtaacacataaattttcctattttcccctgagaaacacctaaagcacaacctactgccatccccagtattgttcctaaaatcatacatatggtgattggtttactaattttttcatagaacatctcttcacacttccatcttcactctcgataagcagcaaactaaaaatcaatacaataactatttataatttttatcctctaaataacattatgaatttatatttaaaaaagttgcttcataagcgggcttcacacacatgcggaggaatattctctataaaaccattgggacgcaattgacagcaagacaatgcgctggacttatccttaaacgcttctgcataatcataacatatatcaacaaattctttataacttttcctagacagctgtaataaaaatcaaactttcctccgccagcccacattttgccccaaaacctcgcaaaccgtacaaattatattacttcacagcggttacattaattctcctgaatgtttcaaagcacctgccgtcaggctgaatcgtcctgctaatcatttcctcaacaacttcgctcctgaactcttcttttaattcgtcaggtatctgctttataaaaggcacaatgctcggctggtctatccatctaatcatttcttccttatcagcaaaaaatctatcttcatttttttcagacacttcagcttttgagaaatttactgatttgattaactctatatactctgcttttgacggcataaaccagggccattcaaaatctttaaaatactcagcgtatttattgcttttcattttttcccgtataacttcaaaaaagtttgaacatgttccgccgccggcaaagttccaggctatttttccattgggttttagagccttataactcctctccaacaaatttttatggtctataatccaatgtaaagcggcatttgaaaatattaaatcaaatcttttttcaaaatccataaaatttacatccatttgaacaaattctaaattttcacagctcagtttttttgccgtctcaatcattcctaaagatgcgtcaatccccaaaacactcccacggggcgttaattctgacaactgctctgtcaagactccgtctccgcagcctaaatccagtattatttcgtcaccgcttaactccaatcccgaaatcagtctgtttccccattctttctgatgtttagaagcctttttgtacttttctccgtcaaattcatacgttcccaatattaaacaactccttattgcagttttaattcaatttattggattattaccaatattttaaattcttttttatttaaatttttagaatattaactcaaaatgtataaatccaactagaaatgataaactccaaaaccgacgtatactctatagaattcaacctttatagaatttattatatctaagaatatactattctgctatctgatttaaaaaatctttaaaactacattacttataaattttaacatataatattaaaaaattccagctttatagaatttattatatctaagaatatactattctgctatcagatttaaaaatcttaaaaactacattgcttataaattttaacatataatattaaaaaattccagctttaataattattgttgagcacaaaatatgaaatttagttaacaacatatttatatgcaataagtatttatataattatttgggtttggatatgcacgcgcagcgcgcggcggctgctcacctaacgcggcacataaatgtgcccttccgatgctcgcttcaaatcttggttttgctatatcttatttttaaaatagtaaaacaaaattgattatgtatataaccattttatatatttatgtagaaaaaatgtgcatttacactcaaaacacggtctattttttaattaatcaatacaaaaaataaaatatatatttatctatcttaaaaagcagatattttggcgagcatcggtaaggcgttcttgcacgcctcgttaggtgagcagccgccgcacgcttagcgtgcatatccaaacccaaataattatataaatacttattacatacaaactaaacgcatttttaagctattaaataaacagatatattactgaaagcttcttttattatataaaataaaacagaagctcaaatattaaaataaatatctgtgcttctgcttaaaacatattttacaaatgattataatctaattatatcaatttacttttttacaatcggtagccatacttcgctcctgtaatcttccgcctgctgataccgctcaggataaacttcaatatccggcgccgcagcatattcatagcctgatgttgggagccattcagatattatacgctgctgtgtattttgtattgattccggcattggtccgacgctttcaaacattgcataggtagtctcaggaataatatattcttccatcccatcaggaacaggtttttcagtagcgacagctataaaatatccggaaaaatctcctttgtcacaagttgaaactcctaatattccctcaggctcactgccgtccatcaaagcgcacaacttgtcaattccgccttgctcgccaacatttttccagaactgcggaactttttcgaaacagtcttccattgtcataggctcttttatagaaaaccctacgatacgaaatgattttttagtcttaattttgtaatccattgcttcttctccttttattgataaagtgaaggtgatacgcggaaaagttgtaagccggactccctctgactttgccttagacggtgaaacaccatgtacactttgaaaagcacggttaaaagctgtcggcgactcatatccatacttaagtgacaaatcaataatcttttcatgaccgtttatcaagtcaaaagcggcagcgctcatacgtcttcttctgatatattcagaaattgtaactcctgcaatataaggaaatattctttgatactgaaacactgagcaggccgcaagctgagccgccttctccatttctatagtttcggtcaaattttcctcgatatattctattgatttatttagtccttctatccaatccacttttatcaccttccaaagctattatacaaaatattatatttaaaaacctctctgcctctgaacaattaaagagagaatttgaaaagtcagcaaaaaataggcagaaagtttaaagttgtttcttttgtgatgtattatgaccacatctgcaagttgggttacatcttcgggtgcttgccaagcacatttttataattttattgaattattttcctatatactatgttctcagtgaacatcggcaggtgtgaccccacctgcagggtgggtgtgagcccaaatatctctttatccttaaaccttcaatgtcaataaattacttagttgtgatgtattgcgtgtttacacgcctcgttaggtgagctaccatctcacgcgaagcgtgagtatattcagagcaatttatcataatccgttttatactaaactgtccctcgactgcgcgccttacgcggctaattccatctgcattgagtatacatattattttttgcgtattcatattattgacattgtaggttaatcaaaacaagtcactatggcttacacccgccctacgggcagggtcacagacattgtaggtttatcaatacaaagtgatatgtataacacacacttttaaaaaaaagtgtggtaacagccctgccgatgcttgctaagccacattttttatataatttttattatattaactttaatatttcagtttaatttattgcattctctccaattgttatttgagtataccacaggttttataaaaacatattaaggacatatccgaatattaaaacggcataactgaaattagttatgccgttagtattaattttcttaaccggatatgtatgatttacactactaagaagttgctgaaatcagcatagccgcccttttcaccgacacaagcaagcgcaaattttgctcctacccatttgccctgcatacattcaaattcaccaagactgatgaaatcgcttccatcaacgctgtatgatacacggcagctcgcttctttactatttgtgcaggaaataacttcaagccttaaatatgcctcggttgtgccgacacacttatcagtaactttccattctctgttatcagtcttaaagttaccgttacagtattcaacaattccctcatcagtcagcgctacataaccatatttttgaccaataaccgccagcactgccttattgtttccaacgcccttaggcattgaaactttaacagttgcaaccatcgaaggcgcctgccaaagctgggttaaaagattcggaagattccagagatatttatcctcttttgtctttaagtcctcactgtacagtctcagacttcctttattttcagtaagtgaataccattcttctttattattagcctgccactgccactggagaccaagtttatctgatgaaaaatcatctgaagtaggaattgtggttatcggatattctgcgccgacatttggcttcttacaacgcataaccggttgtccgcacaggcctgtgtccacgttttcacccattaccggccatccgtcaacccattctaccggctgaagatgaataattctgcctattacctctaaatcctgaaaatgtacaaaccagctctctccgctttcaagctcaaccagtccgccctgatgaggaccgttgatttctgtaagaccttgacgcaatacaatgtgatcttcatatggaccgtaaacattctttgacctcattgccacctgccagccggtaggaacccctcctgccggggacaacacataatacattccgtctcttttataaaatttggggccttctatagtcggctgacttatagttccgttaaatataatcttatcttcgcctatagcttttgttccgtcccaagtcatttcgcagactgcaatatggctcttgattccgcagcggctgttggcgtatccatgaactatgtatgcttttccgtcatcatcccaaagaggacaggtgtctatgagtccaaccccttctttaacgagtatcaaatctgaccactcgccgtatggatcttctgtccaggtcataaatatacctatatcagggtcgccgtaatatatgtaaaactttccgtcattatatcttatagccggcgcccatacaccgcagccgtgaatcggcttattatatctgtcgggaagctttttgacagcgtaattaataatttcccaattgaccaaatcctttgaatgcagaatcggcagtcccggaacatatgtaaagcttgaagcggtcatataaaaatcgtctccgaccctaatcacatccgggtctgagtaatcagcatacaaaattgggtttttaaaagtcccgtctcccaaatccgcaatccattttccttccagtgtgttcataattttcctcctaaatctaaacatatcctaaatcaggcggataaaaatccgcctgataattttataaatacatatactatagttataattttgtattttgttaaaactaaataatatcgtaagttttctaattttaatcaaaaatgacgatatgcaataataaaaatttttagcaatacttaatcacctgaagaaaatatataggaattcttagcctaaaatttatcaacgttagggttaagtttttgcaaatattttagcaaacaataatcccttattaaagaataaagttatattatttaactgataactttatgacagcaatattaactgcttaatacaattttctcaaatgatataccgttaaaactcaaccgctattttctctcatgatacttttatcaaaaatcacataaagcgatttcctgacttttagcagttgccatattttaatataaattcatcaagattctacgccaattatctcatctaaaacaactctaattgattatttcgagttttcagaacttctcactccatcgtaaagataaagcgaaaatctctgcgtataacaatcagtcaaatctataaaaccactccgtctttaaagatagaaatttcacgataaccgttcttctcgttatttgtctgtcttccgtttgctacatctataacaaaatcaaacaaatcctgagtgagaacttcgccgtctactataggtcctgcattaaaatctatccagtgcggttttctttcagccagtcctgagttagacgaaatttttacagttggaaccggagctcccagaggagttcctcttcctgttgtaaacaaaatcaaatgacagcctgaagcggtcagatttgttactgcaacaatatcatttccgggacctgtgagaaggtttaaaccctgctttttcacatgctcgccaatctgaataacgtcaacaacatcgctggtaccactcttctgcacacaccctaacgacttatcctcgagcgttgttataccgccctttttgttgccgggagaaggattttcatatacgacctgattatggcgcataaaatattccttaaaattattgataagatcaacagttttgtcgaacgtctccttatcatgacagcggttcatcagcagagtttcagcgccaaacatctccggaacttcggtaagtatggtgcttcctccgtgagatatcaaaaggtctgaaaactgaccaaccagcggattagcagtaagtcctgaaaaaccgtcgcttcctccgcactttaatcctacaaccaattttgaaacatcacatttctttctggtaaacttctgagcgtactcaacaagctcaccgattagtttcagtccctcttcaacctcattatcatagtcctgagtggacataaatctaattctttcaggattataatcccccagtatacccttaaaaaccggaatattgttattttcacatccaagacctaaaactaaaacaccggcagcatttggatgatttacaagaccctttaaaatcgcctgagtagttttttggtcgtcgcccagctgagagcagccaaacggatgaacaaaattaaatataccgtctgtttttccctcaaacagcttatttgcttcacgtgcaagcagttctgatgtcttgttaacacagccgacagtattgacaatccatatctcgtttctgatacctacgcttccatcatcgcgcacataacctttaaaatatgccttttcgtctgccttttccacacctttaagctgcggctcatatttgtattccaatataccgctgagattagtttttatgttatcggtatgaacatgctctcccttttttatatcgcgtattgcatgtcctataggataaccgtattttataatatcttcgccctctttgatgtcccggtttgcggtcttatgcccgtcaaactctccgcccacatttacttcaacattgtcaagaggacttattttaatttttcccatttgtttatctcctttctcaaagcgaaagaattaacatatcagccgtttacaacttcttccatagcggctctgatacccttttcttctattgattttagataaccgtttattgagtcttttaacatacttaaatctgttccccaatattcttcttttgaaagaatattgtcaacagaagccgtcttcataaattccataacatcaggattatcgttagcagcgtctgttctatagaaagctataagtgcagccagcgagaacacaaggcactttggctccttattgttctcttttatatattcaagaactgacggcagcactctgacctgatactttgatactgaattcaaagctatgctgagcaaatagtgcttgatgaaaggattctggaaacgctctataacatcattggcaaattgaatcaattcatccttaggaaggtcaagagtcggtataatctcatcaaatacaccggtcttcataaagttgaaaacaagctcgtcatccatagcttctttaactgtttcaagccctgcaaggtgtgcagcaagtaccatcatagtatgcgcgccattcagaattctaacctttcttttcttatatggcgtaacatcatctgtccaaagaacgttaagccctatcttatcaaaaggaagttcctctgcatatttcttatcgccttggattacccacaggtggaaaatttcagcagtgtctataatattatcgagatagccgtattccttctccatctcagaagcagtatcacgcggataacctgtaacgattctgtcaaccagagtattggtgaagtaattctcttcctcaacccacttgataaagtcatcgccgtagccaaagtctttagcatacttcaaaacacaagccttaagctcatcgccgtttttatcaataagttcacacggaagcagtaaaaatcccggaagcttattatcaaatcttctcttcatgaacaaagtcagtctgccagggaatgtaagacctgcaaaatcatcaggattttgattcggcttatactcaataccggcttctgttgtgtttgaaattatatatctgagttcaggatttgaagcgcactcaaagaattcatctgtattctcaaatgggtttatacctcttgtgatacagtcaacaactcttgtctcctccaccttttgaccgtcctgcaaacctctcagatacaaggtgtacaagccgtcctgctcgtttatcatagggataagaccctgtgcgagaggctgaactactacaactccgccgtcaaagtctgcttccttattcaatctgtcaatcatccaatcaacaaatccgcgcagaaaatttccctctccaaactgcaaaaacttctcagtaagctgacatttttcttttctctttagtctctccataaattgttcctcctaaaaatatattaacgttcaattttcaagcacagcttatattagtctacgatcttaacaatctcctggttctcattgctctttgcaacaccgttcactgctaaggtagcattagattcagcgtcagtttcgataaaatcttttgccgtaggcgaaaccatagagttgcttatcataatatcctttgattcttttatttcaacagccgtattgcttccctcagaagtgagaccgctgaccttaaccaattctgatttttctatgattattgaagaagttttttcaacatccaaatgcacgttattaaaacttacgtctttcatattagcgcagtagaaaccgtgaccctttgtcggctcaatatgccaagccataatcggcgcacttgccacatcatgatcaccttttgtcatagaacatacaaagttatcaacatgaagactggtaacaggcatctcaggaataccatatatatatccggcagcacacttaacttcacgcgcggtaacattgcttatgtatatattcttaaataccggagtgctgtcttcaaccggttttttatcaagagagaataactccatatcattagggtcggttcctccgcatttataataaccgtttattgtaagcggtgcgaacacgtttgtcatcataatattgtctattctaatatcctcaacgcttccgcctctcttacggcgcgtcttaattcttatacctctgtcggttccgttaaacacacagtttgaaatcgtaacatttctaactccgcctgacatctcgcttccgataacaactccgccgtgtccgttattcatagtacaattggttatcgttatattttcgcatggatacttcttctgcaaatagtcgtcctcggttcctgatttcagagtaacacagtcgtcacccacatcaacctgacagtttgaaacatgaacattagaacagctctcagggtttataccgtccgtattaggagaatcagccggattctttattgagataccgtcaatcgtcacattgcggcagcacataggatgaactgtccacattgcagaatttatgatactgataccggaaagtcttacattttcacacataattggttggaaagccctgggtctctgttcatttttaggatttgaccaccagttatatcctcttccatccaatgttccgcggcctgttacagttatattttttgcatttcttgcggcaacaagtccggtatgcccttctctgttatatccttctaggtcttctttagttatcattgggtagtcctcaggatcagcacttcccaaaattgtagctccgccttcaagatagagcgtcatattgtctcccaagattatcgaaccggtaacatattctcccggcggaaaatatattgttcctccgcccagctttttcagttcaccaataacctcagctatttttttagtgttattggttgttccatcccccacaacaccaaagttggtaacatcaagaacagatgaaatagtgttcatttgtaaaacctccgtttttactatatccaaatttttatttcttttttattatcttacttgccgtttaatactctttttaaaatactatatctaacaaaatactaatatataattgttttactatcaatatatctaataaaacataagctttcaaatttaatatacttcgtgttttaatctaatcagccgggtattccgcaaatttcccaacatatgacatcaacgtttccgcctcgtcatgcgtcagctgcctgctccagtccgcccgttcagacacatctatcagatgtccgtgagaatctgtattattatattccaaatatctggtattcttcgcttctgtcccctcttcaagcctccacggaagccatccaaccggggcgcagtcaaaattataggtacattctataaatgcagtatgtgaattgattccgtcgtcctgcgctctccatgggcgtcccaaatatatacattcacaattttcgtttgcgcttatataacaatgataaaaaacaaaacctgcttctttgttttcagaagtgtttgccgccgttatataagattttgagcgaacacaatttatatcacattcctcaaataacgctgccgcgtctccaaaaataaaatcaacgcttccctcaatataacagtcataaaaaaactgtcttgtttcgctgccatgaatatacatggtatcctgccagcccaaaaaattgcaatgatgaaaaactgatttatcagcaccgcagcttattgcaagcgcctgcgtcacagctctgtcagaatcaattctgttatagctgttctcaaacgttatgttttccgccttaaatccaaccgccgtttcttcaacagtcactgtcgcagatgtaaatgtattatattctagaccattttcatcacaattccccgaagcggcgtcataggtcaatgttacaaagccatctccaaccaaagttagatttttttttgcaatatttatcttttctttatatattcctgacggaataacaataatatccccgtcatttgctgcttcaacagcactttttacagttttgtagtcacgtcttacatatatattcatatttttttaccctaatacgcaagacaactgccaaatatagcattcggcagtatcttgcgttttattaaatttagtgttttagttagatttatttattacttaaatctaatttattatcttactgagcttttgcaagttcagcattttctttctcaatttcagcctttgttctctcataaacagttgtctgaagttcaataaactcctgcagaccaactttgttcatgtcagaaatatacgcgttccactgagcatcattgttaggatcaacatcgcctgagaagaatctctggagatattcatctctcttagcgttaagagctgtctcaaggtcaccgaacttctgctcttcatcctcagtatatctcataggaatctgatcgaagtagtaatacttatcctgtgcctggaaagcgtcccaaagagcttcaactttcttaccgcggatattgtcaaacattgtctgctgttttgcgaattgtgaaccgaatgaaccgaattccttagataaggtcttatctgtcttcttatctgtagccggattactctcgtcataccagcctggaagcatctgcggctcgccgttaactatttcataactttcgccttcaacaccatatgtcatatacatctgaccttcttctgtagcataccagttaaacatcttaagaagtgtgttgtatctgtccatatcgtctgaaataccagcgctgaatgcaggtccccagtttgaatacagagggtctttcttatagatagtacccttttccgggaaagctgttatcatattacctgtccactgccaatcagatactttatcaggatttgttccctttgtcttcttattaaactcgtctatgttataaacatagttataagttataaagcagttatcctgtgcaagtcttgatgagaaagtatccttgtctagtgaaaggatttccttatccataaagccagcgtcattgaacttcttgattgtcttatacatttctcttgcattatctgttgtcaaagcgtatggaacatactctttagtaacagggtcaacatatgaatgctgagttaagataagctcaggaatccagtaagcctggaagaaacctgtgagcgcgctgcccggtgaagttgttcccataccattacaagaaattataatcttatcaggatatgcagctttaatctttgcacaaacatcataaagctcatcaattgtcttcgggaactcagttattcccaactggtcaaatacatcttttctgtaatcccagcacatctgagttttttcctgtctcagtgtaggcagataatatagttctccgtctgaactcttagcgagcgccaaaacctgcttaaagtcttcttcactccataagtttttccaatccttcaagattggattatcacctgtataagcttcttcaggaatcgggtctaggtatttattggtagcccatttcttatactgaggctctttaccgcctgttgtgaaatctgcttcgttaccggttgaatatgaaatgtttgtctttgtttcccagtcacctcttgggattctttcatattcaagttcaacgccaaacatgtctttcattctcttagcaaaatcagtatcctgaccttcagcatactcggtttgatcctgagtatacatattcatacgataagtataaattttattgccttcgctgtcaacatacgagcctctacctgccgagccgcaggaagccagcaaagaagaagccagcactactgatgtagctaaagccacaaccttctttaatttcataagttttatcctcctaaatatatttagtttaattatgcttaacccttaacagaaccaaccataacacccttaacgaaatacttctggatgaatgggtatacacacagcataggcacgatagagataaacagcgttgcatacttaagtgaaacagtacttactgttacagtgttaagttcgccggcagcctgcgcttcagcagcaagctggttctccataactatctgtcttataatatactgcaaaggatacagattcttaactctgtcgctcagataaagcatagcgctgaaccatgtattccacatatacacaccatagaacaaacctacggttgcaagtgcagcctttgaaagaggcaaaataatcttaacaaaaatagtaagttcgtttgctccgtctataaatgcggcttcttcaagctcaaccggaacgctttcaaagaacgaacgcataactatcaagttataagttgaaattgcaacaggaagaatcaacgcccatcttgtatcaagcagtccaaccatctgaactatcaagtatacaggaatcatacctgctgtaaagaacattgtgaatacaatcagctttgtaataagaccgtgaaacggaactctgtcctttgaacgcgacaacggatatgcaagcgttgttgtcagcgccagggaaataactgtatacaaaactgtgttgattactgcctgcaggaatgacattggaaccgtcttacctgtaataatttctttatacgcatctaagttcggctcaacaggccacaaaacaactttacctgcctcaaaagcggcttggctcgaaagtgaaaccgagaaaatgtagatgataggatatagagttacaatcatgagcaaaatcaaaaatatgtaaataactacatccaaaataattgatgatactgtattgtcttttaccattttttagtccccctctcttaccacaaacctgtatcggtgagttttctcgataagaagttagcgaaacatacaagtataacgttaattatcgagttaaacaaaccaactgccgtagagaatgctatctcaccctctttaagacccttgttgtagatatatgtacttagtatctgtgaatgtttatatgtcgcaggctgctgcaaaagcaaagctttgtcagcgccgagtgacattatcttaccaatctgcataacaagcagaattacaattgtaggctttataagctgaatagatatgtgccacattttctgaattctgctggcgccgtcaatagtagcagcttcataaagctcctggtcaacagctgaaagagcggctatgtaaataatagcactccagcctatactctgccaaacatctgaagcgatatagaccgttctgaaccactctgttctctgaaggaatggaataccttcttttaccagatgcagtttaagcaaaaactggttgataataccttcatttgcaagacttcccgcacctacaggagtttgctgtgaagacaagaacaatgtgagcataccagcaactgccgcaactgatacaaagtgaggcagatatgatactgtttgtacgattttcttaaacttagcacctctgagttcgttgatgaacaatgctaaaataatagccagagggaacagccaaatgatatgtaaaacactcaatacgatggtattccatacgtagttccaaacatcaggtatggtgaagaatctaataaattccgcaaaaccataattgtctgcccatggacttccaagaatacctaatcttggctgataatctttaaatgccgctaacaaaccataaaaaggccaatactggaaaattgcataaaatgcaacacccggaatcatcagcaacagcaagaactttcctctggaaaatttgctgcattcatttttgaaccagccggcgataccctttttttctttctttgtgctgccggcactggtatcagacgccgcagccgcggccgcagccgcttttttttctttactcaaagcgtattcctccccttctcaataggataataggcaataaagccatttctataatacttatggtattattatataagatttgcacaaataaatcaagaaaaattctaccatttttgcaaatttcacaataaaactttaaatattataaaaattacaagttttttgtgctttttacataaattttatgctggaatttagtctattttgacatctattttgacataaaattataaattacaacagccgcttctgctctattagcataattgagagggttgaaacaattattttggtcaccctgcataattccaagagcgtataaagcactcacgtatggtcttgcccaatccgaaatcatatcagcgtcgctgaactcctctgtcaagtctccgtaaactgctgttgctccgtccacggctctgcatatcatagccgccatttcttcacgcgtaacatttctgtcaggttcaaacgtcagttctgttgtaccgttaatcaatccatatccatatgctttgtttatatactcggaataccattccgacttatcaacatcagcaaatgaatgttcaccctcagtgatcaccgcatttggatttttagcttcgtaagcaccgacgagcatttttgagaactctgcacgggtaacattaagttcaggattataacatcctgttccgtctcctgatactataccctgctgagtcaaatttgcaattgcgggttcagcccattcaaatccggctaaatcgctgaatgcacctttggagattctaaaatcactcagtttaaattcagacaccttaaagtcttctgctgaagctccgaacagaccaaagtaataattttcacttaaatctgtctcttcttctccgactttcagccactcagctccgtcctgagaatactctgcggtaactttattgcccgtcttgtttattctgagccaaacaggtgtatttttatatttctgctgacctattttttcatatactttgcccttttcagagttctttgtaaacaattctccattataaatttggaaatagaacgcataggaattgtcgccggcactcagtccgtctctcagcaaaaatcctacctggtcatactcgctgacgtcttgggcctcaactttgaatgaagcagtaaaatcaccgttcatacctgtataagcatatgggtactcctcgtttgcaacatccgctactccgaatcctgttccgtatatttttactgtgccgtctgaattaaaatcaaaagcacctctcatcttgctgtctccaacactgacagcgtcccagcccggcatagctgtaaggtcagatacgcctatacttacagacgcgctgtttttggctccgtccttatcataagcaacggcagtaacccagtggctgccggcttccaatccgtcaatcttaacattaaacggagctgaagcgtcttcctgatacaacttaccgtccacatacagttcagctttctctaaagcttcactgtcgcctgaggttacattagctgttatttcatctgttgtataatactggttttgttcagagcttattccgttacggtttgagcttatagaaagctcaacgtcgggaatagaattctcgccataattatcaagagtcaagtccttatatttgccccaagcatatgttgagatttcattggtttccttattgccgtcctgagcaactccgccgtaatttatacctgagaagttaaccattgtctggctgaggaggttccagtctataccgttctcagaatgataagcggatactgtgctgccctctttaaccagctttaaatatctcggcaatacttcaagctttaaaaattcacggttatactttccgtcttgtctgtatttgaaagctatacctgagccgcccttttctatttcgtagttaaccataacgaaatctgacttttcagtcaactcatcacgaatcataagtccgctggcacagttgttattcagccttgaaaccgaggcaatctgtgtagaaagaactgcgttttcatcaacaggctgatacatatatgagaatgaatcagtagtcggatcgcccagcgctatattaaaatcatttccgggaccgataagaccgctgctcttaactgtataaacgccgtctcggtatgaatagcttccgtccattgtggactcgcctatatcggcagtcagccacggcgaaactgaatctgtataattaatatttataacctttatctcagaagttgtagcttctccggcgctgtcaaccgctcttgccgacatatacgctatcccctcttccgcattgttcagagtgaaagtatatgggctggattcagctgttccaaccatctcatcatttttatagaattcaaccttagaaattgaacggccgtcagctgctttggcttcagctttgagttctatcggctctccgtaattgtaacacgtattgtttttaatatttaaagtaacttcaggattctgaggctcagccgcagattcaactataccgttaagataattttccaggtttgtatatccgttgtctgcaattatctttccgtcagccggatcagatttatttaaaccgttctgatcctcataactatccggcattccgtctccgtcagaatcaaaaggtgcttccgcgctgtttaaagttggccatccgccgacttcagattcattattaaccgctcttccggtaccgtttttggtgtcattaataactcttgcatcatatgaatcacgtctcggaacagtagcgccggcgtcaacaagtattttttcgtatgcttcctgagcagtgtctatattatccataggaataagcgtatcatagacaggttcgtcaacatagttcggagcttctgcaccctcgttcagaataacgccctttagattatcgtttgtaacctcactgtttccttccaaaacgtttccgctgaaatagaacactccggcctttgacggattccaaattctgttctttacatccgcatttgtaataggaccggttttgtaatagttatttataacgtttactgtagcttcctcggctccgtaagcattattaaatccccagttgtaaataacgttgtttaccatatcgttgtcatttatcccctcaaaatccgggtgtgtgcttgacaatgacgagtatctcggcaaacggctggtgtgtgtagcaacaagattatgatgatatgttacattagctccgccccatattccgccgtaaccatgacggcctttggcatgaacagcaagcgcaaggctttcgcttatcatacaccactgaactgtggtattggctacgccatacaaagacatggtttcatcagttgaccagctggtagagcagtgatccagaattatatccttttgataccttgcaaacacagcgtcgttttctgcatgagaaatatcgccgggtctgaaacgcatatatcttatgataacgttatccgccgcaataacaatattgtagtctccgacacaaataccgtctccgggagccgtctgacctgctatagtaatattgggctggtccagctttaaagcagatttcaaatgaatggttccagaaacatcaaatactattgttctgttaggtttgcttaccgcgtctctaagcgaaccttcgccgtcatcgtttaaatttgttacgcggtacacttctccgcctcttcctccggttgtatattttccgccgccttctgcgcccggaaatgccggaagattaattgcctgagcctgctcaggtgtcataaatgtttcattttccaaagctgcttcttcagcaaatgcagccggcattatactcacaaccatcataacagccataagtaatgaaacaatatgtttaatactaaagtttcttctcataattgattcctctcttatataaagatacactccaaattaattttcttatgtttataaaatatccgatactccggagcataaaagctccggagttcttacatatataattatacgattttattcataaatgtatgtctcaaaactcaatccatacaagtttattcctgcgtctccataaacatatatagttgtggcttcaccggtataggtatactttgcgctcatttgagtagtcagaacagtcttgttctcacttccgtcattgataacaacgcttcttgttccgctgcttcctgccggttctccataaacgacaatatcagtagttccggccggaacttcaaacgaaacacatttgctggacttgcttccgggaccgcctattttatatctcttagggaaagatataccgtcaattgtttttgatttgctctcaagagttccggttgtagcaactgaaagacctgcatatgtctttccgccctcaagagatgttaaaccgctgaattcttcgcttgaaccaaagttccagaaatgagaatcgagcacttttttaacgtttgatgactggctgagctttacgctgacattatcaatataatatgaagcagtcataccggcttcaggctcaaacagaactgcgtttgttacatcgtatttcttttctgtattaatctgagcacggaaatcagaactttcaataccgctcatatcagcgcacacatttccatcctggtctttgagtaccatctgtgctgtatcaccgccaaatcccatatcagcaaccaaatcaacatgataccattttgaagcactgtattcataccctgtggactgtcctccgaaataaaccaatccatcgtctgcgaatgaaagtttaaatgccttatctcctgattttactctcagataaacattcattccggtcttatcgccggacatcatcaaatcagctccggcagtgattatattagtagaatcctcaggcaaaatatactcgcggaaaatatatctcggagacgaatagtcagaattagtagaaatcttcatctttcctgtctcgtttccgcctatactctcgtttgtccaggacgggttaagaacgtttcgctcctgcttctgccacatccaatcaagaccgtaattaaagttccataaaactgcgcttgaatcagatacttcctgcgctgtaccgtcaaacgggttacaaattggaatcaaatcactcaaattattccaaaggaatattttatatgtatccccatttacgcttccaacatcaacactctcgccgcttatctcagcgttcttagcgtcaaccagaaccccattctcatcgtatccgcacgcaataactgttcctgaggtgaaaccattgcccggattaatagtaaccacgccgttttcataactctttatatatgtttcggttccaccgccaaagctctttaattcttctgttgaaacccagccagcgtcagaagcggcgcttccttctccgcttactgtaccgaatcccatataatagctgtcgcctataccgtcgcactttatactggttaacagcacttttgtcttataaacggtcgagccgttttcagtttgatatatatttatcgtatctccaactttttcagcaataaagtataagttcgcagactggccaataacgtcagttacatcctgaacaagagtcatctcttcgcctgcgccgcttctcttcataagctggtatctcggcttaccgtcctcaccgatgtttccgccgaagtaatatgttacgccgtcggctgttaagtcgttctttataacaactcccatttgtttgccgtcctgcatacggcttctgtaatatatcctgttgtcgccgctgaactcctggcaaaggtatccgaatttgtcggatgttccgccaatactgccgcttgtatctgtagctattttataagtataatcattagttcccaaaacgtatgcttttacgtcatcgggagcatttcctatatcaactatctgccaaggtgaaatatcctgagacacaacaacgtcaacactatcagcacctgaacctaaattttcatcaaagcaatatacttgtaatgtgcctttagctacgcctgtaaattcaacaggaatattaatcgtttcttctctgtccagctcgtttgtactggaagcaagcggagcaccgttaaagtaaacccatacctctgttacctttttacccttatcaggagtaacctttacttcgacattagctgacagacccaatctgtcattattttttatattaacaatctttgcagcagggttagtttgctctgtcacaagctggcacacattaaactttgtaactgtctcgccttgctccacagctgaaacatatgcagaaaccgcagcgtttccggtttgttctccaacttcggcaaccttttcccattcagctaagcttgctcccgcatatagcgacagaacgccttctgactttgaaatcttaaacaacttatatttttcaatgctcttggctgcgccgtcccaaatctgaatatttccggcttctccatagtaaataacttgttcaaagttatcattatacatcttgcctataacaaatttagttccgctggtttcatcaagtgaagaaataccgctttgaacgtttatatttttattagaaagtttatctattcttgcaaccatgtcatagtcgccggaaatattagatttctccatctttccgccgtctaaaacagtatagtcatctccgtcataccacgcattttcagcagtccagccctccggcactgtatcaccggttacagagacggttttaaccgggctgaaaatataacttccgtcgttcttgataactttcactgtgaaatcattatcccctgttggaagttcagaaactgtaatcgctgcagctccgtttacaattgatgaagtttctcctaccttcttgtcgttgcagtacaattctgctttttcaatatttgaaactcctgcacctgatatgttaacagtaaagttaacttcctgattgctttgcacaacgtttttatcggcgcttataccagcttctatatcggttacaggagtttttgttattgcctcctcaacaaatatttcaagccaggtaagtccgtccggaccaatattcttgctgtcgtgaggattagttttgtcaagacccattttgtcttcccaagtatctgctatgccgtcgccgtcagcgtcataatcaccagctctagtctcctgcgcgagcgccggatatcctctgccgtcataatttgtggcgccctctggtatacaatccgtagggtcgtctacaagaccaacgctgcctttgcttccgattggagctgtgcgggtttcaacctcgcctattattcttgtatccacttcgtcacgctttggaagagtggctcccgcgtcactcagaacctcattataaacatcttctgcagcgtccagagttataggataattattatcatattcctgatattgttcatcaggcgtttcaattttcatattggtcttatccgcaacactataaacatttgttgcaacataaacaccggtatgcaaatcatcctgccagttgttctgattaacaagctgggcgtttttataatcgctgtcgccctcgtcaacatctattttatttccggaagcatatacgcttccaagcatattcggcttatacttctgcccaacgctaagctcaaaaattcttgagcgttttcctgccggtgttgccggacccggtctgtaaacattgttctgtatgtatgtcttagctccgttttcagttccgtatcccgccttatcgccccagttataaatgacattatttttcatatcaaccaaagtttggtcatcggtatatccctgggtcatagccacagtttcagatgtaccgattttaggattacggctcttatggctggcaatcagattatggtgtatagacagatttacgccgccccaaattgccgcataactgtgttcgcccttatcatgaacactttggttaagcgcctccgctataatacttctttggatagtaacatttttaacagcataggctgacaagttttcatcagtaccccagcttacactgcagtggtcgataataacattttcgcagtcgtcagttatttccataccgtcctgcgctcttgtgtctttgccctccgcatcatgagctccgacgcggaaacgcaaatatcttaaaattacattatcggctccgaccttaacattgttcgatctgaagcagataccgtctccgggagccgtctgccccagtatagtcatattgtcatggcttatagaaacattgctttttaaatctatatagccggacacgtcaaagacaactattctgtttccttttgaaaccgcatctctgaatgaaccctcaccactgtcattcaaatttgttacatgatatacctcaatctctccgccgttattataagcgcctctggctccctgggagtacattcctccgccttcagcgccgttaaaagctacaacgttcataatatttccgcctgcgcctcctccgccggctactgtctgcgcagcaaaaaccggcagggatacagcgcttaaaccaacagcggcggcagtcagcagtgagccgactttacgcactaacttacctctttttttcattagattttcccctttcctatgtatttaaataaataacaatgtctcagttcaacgattcagagctgaacttcataatataaatcaaatgaaacctgtcgcctaatcagacgaactgattcttctatataataaaaaattaattctcatataagcaccaaaaccgcagcaaatcataaacatttgccgcggcagtttccggtattgccggaaacgtttggcgctttaccgacatttatctattcatttcatcctgatgacctgtagctttatggcttgcgattatgctgtctatttctcccaaactgctgcaggacatatcgcccattacagtattcttaaccgccgacatagcgtttccatactcaataaccttctgcatatcatcacaggttatcataccatataaggctccagccaaatatgcgtcgccgcttccgacgcggtccacaacctcaatattcatatatggctcttcttcatagaactttccgtcatagtatatcttagatgagaagttatgaattttagggctgacaacgtcacgccttgtggtgcacacaactttgcagccatattcttcgcagtaactcttcattatttcctcaagagttcccgttttctgaagcattcttcttgaagtttcctcggacacaaacaaaatatccacataagggaatacagaagtaacagtttttctggccgtttcctcatcccaaagtgacgcgcggtaatttatatcaaaggatattaccgccccgccctctttaaacttcttcataacctctatagtggtctctctgagctgctcgttaagcgcaagagttataccgctgacgtgaaacacagaagtctttccgtaaatagacgggtctatctcgtctatcttaagagtggtcatagcggaattggctctgtcgtatataacagaagactttctaggatatgcccccgtctcataataatatattccaagcctgctttgtcctgagtggtcgtatacgatacagtcgtcgctgacgttgccgtatctaatcatatttcttataaagtgaccgattttattttcgggaagctttgtaataagagcgctgcgaattcccaaaacagctgaacccgaagccacgttcagctccgctccgcccgcttttttgtcaaacgtgtagctttgagaaatcttatccgttcccggcggcgacagacgaagcataacctcgcccattgttaccaaatcatattctttgtttgaatttataaagtccataatatcctcctattttaactcccctgtcatcaaaatcctaaatttctatgccgaaatactctttagcgttattgaaagatattcccttaaccacagtctcaagagtgtccatatcatcagggaattctccgttttcaacccatgtgcccaaaaggttacacatgattcttctgaaatactcatgtcttgtgtatgaaaggaagcttcttgagtctgtaagcattccaacaaacttattaagagcccctaggtttgccagcgctttcatctgctctgtcataccgtctctctggtcattgaaccaccagcctgaaccaaattggatttttccgggaacttcattgccctggaaatttccgagcattgtagcaagaacataattatctttcgggttcaaagtatacaatattgtcttcggcagtttgctctccacctcaagcgcgtttaacagctttgaaagaggagccgcaatacaataatcgcttatagaatcaaaaccggtgtctgcgcctagtttctcaaacattctggtattattatttctgagagctccgatatgaagctggaaagtccagcccaaatcataatacttttcaccaagcttaaccaaagtcttgctcttatacgcgtcagtctcaaactgggtcagtttttcaccgttcattgcctttttgaaaatagcctcaacttcttcatcagacacgtcctcaaacggaacactgtctaaagcgtggtcagaaacacggcttccaacttcattaaagaagtcaattctcttatatacagcggaaatcaaatcctgataactgtcaatttcagctcctgcagtatctgcgagcttctctatatacggcgcaaatgtaggcttgtcaatattaatcataaagtcaggtctgaacgccggcagaactttcgcctttatatgacctttttctttaatctttaaatgccattccaaattatcaacagggtcgtccgttgtgcagataacggcaacgtttgaatcgtttatcagcttagacgggctcatttgagttgctttaatatgagcgtttgccttttcccaaatttcatcggcagtatcttcgcgtataacagtatctataccgaaatatctttgaagctcaagatgggtccagtgataaagcggattgccgatgccgtactgcaaagccttgcagaaagctctgaacttttcctggtcgggagcatcgcctgtcatatatttttcatccaatccgcatgaacgcatgtagcgccatttataatggtctccgcccaagaatatttgggttatattatcaaacggcttgtcctcatacatcatttgcgggctcaaatggcagtgataatcaaaaataggcatgtccgcagcaaaatcatgatataactttttcgctgtctcattgctgagcataaaatccttatccataaactttttcataggtatacctccaaatattacaaaatttttattactttataataggtttatatatttacaatatagttaagcgtatgatagaaattatttacaaaatattcataattccctcacatagctatccttgtatattatacactataacacactaatattgcaaatgtttttttaagtatattaacggattaattgacttatgcgaaaacaaaacctttcattttgataatctgtatttctctttagcaaattttctgtatttttagaaaaactattgatttattgccacggctatgttataataaatcagtacaaaagatttggagggatagcccatgggtttaccagaaggacgcgacatatatattgaccacgaggaaaacgacaagccttatgtgatgaagaattcacacatacacgattactacgaaatctactatcttatggcaggcacaagaagatatttcattaatcacactctgtataatatggagccgggtgacgttattcttgtcaataagggagaccttcatctcaccacgatgatttcatcagaacattactatgaaagatatttgatgacgtttaacgataactttgttgagcgcgtttcccaaaacattgaccgggaacttttcatgaacgcctttgaagttaaaaaggtacacgttcccgtctctaaaagatacgcatttgaggcccttatacataaactcagtacagaatgcgagcgcaacgatgaatatgcagattttctcgcatattcgcatatggctgaacttataatatttcttgacagatgctcaagccacagcgttgttccgtttgatgacatcagtgttcatgaggagaggattcagcaggtatgtaaatatattataaactattataaccagcagattactcttgctgacatttctaagatggcatatatgagcccgacttatttttctaaaaagtttaaaaaagtaaccgggtttggatttaatgaatatctaaataacgtccgcataaaaatggcgacaaacatgcttgttgagacccagtattcagtaaccgaaattgccagattctgcggatataaagacagcaattatttcggcgacgtatttaaaaagataatgggggtttcaccaagcaaatacagaaaagcgaattatacattttaaaataatatcagcgtaaacctgacaaaaacgaaaaatttacaatataaaaagcaccttctttggttttatctaccatgggaggtgttttactttgtcagaaataaatataagatacataaaaataaaaccggctccgcgaaaacggagccggttaactgtttatattttatattttagaatcagaataattattagattatacttacaaatttatgggctcgtttatgttactctttcagatttcataatcattaaactttttaaattttccgaattcttataacacgataacaaacattattcttataacccaatagcaaacattcttaccatcagaccacatcgtaatgtaaaacctcaaatcaaagcgcataaaattgttttattttatattctcaaaaataagtgaaaataatcttgaacataattattctaaattttcatcttcagccgcaccggaatcaatttttaattctacagggttcacatgaaccatgcagtgtttgactttaggaaaattagcttcaatcgcattgtgaacattctcggcaattgcatgggaatctctaagcggcgtattctcatccgctcctatctccacatcaacatataattttgaaccaaacattcttgtcataagcaggtcaagcgaaatgacgccttcctggcttttaatcaagtcggacatctttctttcagtctcatcgtcacacgacttgtcgaccattttgtcaagcgcttctttgcagatattatatgcggctttcacaatgaacaagcatataacaacgctggctaacggatcgcaaatggggaaacccaatctggctcccaaaataccgataaaacttcctactgaagaaagcgcgtcgcttctatgatgccatgcgtctgcaagcaatgccgtagagtcaaccttttttccataaaaccttgtgtaccaaaacatgccttctttaacaacaatcgaaataaccgccgcaactaaagctaacgccccgggcacagccaaatctccgtaattgccgccgaaaatttttttgacgcctgttattccaactccaataccggttataaacaagacaatagcaagcacgattgcagctatacattccattcggtcgtgaccgtaagggtgttcctgatccggatctttcgccgccgcgttcgccccaatcatcacaataatagtgctgaacacgtccgaaacagagtgaatcgcgtcacttatcatagctcctgaatttgctataacacccacaacaaactttatagctgaaagaagcacgttaacaactatacttatgtttgaaacacgcattataatctttttgctgctttggctgttaagtacctcgttctccataatcacactccctatgtctattgaaatcaatacttttaatatgtatgctgaaaaattaattttatgacatattttattccaaataatctttcagctttttactgcggctgggatgacgaagttttcttaaagccttagcttctatctgacgaatcctttcacgggttacattaaactctttgccaacctcttcaagagttcttgctctgccgtcgtccaaaccaaatctaagtctaagcactttttcttctctcggagttaatgtgctcaaaacgtccaccagctgctcctttaacaaagtaaatgtagcggcgtcggacggcgccggtgcgtcatcatcacggataaagtcgccgagatggctgtcctcttcctcgcctatcggcgtctccaaagaaacaggttcctgagcaatctttaaaatttctccaaccttgtcaaccggcatattcagctcttttgcgacttcctccggtatcgggtcgcgtccaagttcctgcactagctgccttgaaacacgaacaagcttgtttatagtctcaaccatatgaacaggtattctaatagtcctcgcctggtcggcaatcgctctggttatagcctgtcttatccaccatgtagcatatgttgagaatttatatccctttgtgtaatcgaacttctcaacagcctttataagacctaaatttccctcctggataaggtcaaggaacaacataccgcggccaacataccgcttcgctatgctgacaaccagtctgagatttgcttctgcaagcttgcgttttgcgttaacgtcgccctcgctcattctcttggctaggtcagcttcctcagcccctgtcaaaagattaacttttcctatctctttaagatacattctaaccgggtcgtctatgctaacgccgtcaggcacagacatatcctccagttcttcctctgtaacctcatcgctttcatccacaacaggttcagggtctatgcttccgacgatttctataccctgtttctctattatttcatatattttatctatctgctctgaatccaattccagttcttccagcttgtccgcaactgttttgtattcaatcattccgagctttttgccgtcctccagcaatccttgaattatctgagcctttttcttggcaacggcaatatcaacttttttcgtctcagccccctgtttttcaaccggcctagaactttcggaaacaccggcgccggtttttgaagcctgttttgacgatttatttgtcacgtcttttgaaccgctctctttagcttccgtattctcaacatccataagctcttgattttcagcattcttatttaattcttcattatttttcataatatataacccccgttattcttttttcttccgctttagctcaaagagccgttttaattcttcttcatccccggaactaatcgccttttctttaatacgttcttcttttgataaagcgataatctccaaaggttttttggaagcttcatatttatcttttatatttttatcacttattaaaatattggatatttctcccacattctcaggtgagcatctgttcagaatatcattcccttctgtgccctcgccgctctcatataattcaaacaaaagcgaagccagcctcttatgtaattctgaacgtataaaatcatcagggactattccggactctttgacaagccctataacccttttatcagtcatcagacacaaaagcagtctttcagcattaaaaagctctctgtcccgatgactggctgaaactcctcctgtcattatgtcccgctctctccgttgtttattttcctcccggcgtcttaaaatagccttttccttattttctattccgcttatgccggctgaaatactttccggactgatagaaagctcttctgctattttgctgatatatatttccctctgagcctggtttttaaccctagataaaattactgacacctcattcaaaaagtcaaccttatcatccaaatcatccaggttatattttaactccgcctcggcaactttatactcaatcaaaggccttgccttttcaatcagaacactaaacatatcagggcctttcatctttataaactcatccggatccttgccgtcggttaccgtcagaactcgcacctttacgtcagcgtcgaagagaatatctccggctcttattgtagcctttttgcctgcttcgtcgttatcataacataaaacggctcttggagcataccgtttaaccaattttgcctgttccggcgtgaaagctgtacccaaagacgctacggcgttattaaatccattctgatgaagagacacaacatccatatatccctccataagaagaagcctgtcagcctttgcgtttttagctatattcaaaccaaatagattatcttttttcttaaacaccaatgtttcaggcgtgttccaatattttggagcgtcggtaccgtcttttactacacgtccgccgaaagctataacattccctctgacgtctataatcggaaaaataactctgccgtcataaaatgcgtcataaaatgttccgttatcacgctttttcaccaatccggcgtccagcatatcattttcattatacccttttttctttaaaaaatttattaaatttgaccatccctcaggagcgtatcccaatccaaaccgctttatcgttgaattactaatcatgcggtttttcagatacgttaatcccggttcacccgccggacttgctaaacactcaaaaaagtatctcgccgcctgagcattaatctcgtatatcttttcacgtttttttgatatggccagctgtttctgcttgtccctgccggttctgttgtccggcatttccatatgtaccctgtccgccaaatattttaaggcatccataaaatcaaggttcatcgccgcctgtatgaaatgaataacgtttcctcctgcgccgcagccaaagcaatgaaacatctgtttatcaggcgagaccgacaaagacggagactttctgtcattatgcagagggcagagccccatcatattattgcctgtgcgttttaaagttgtatactcggaaataatatcaacgatatcgtttctcattacaacttcatctataaagctttgaaaatcagaaccagccattattatttcctttctaaaaaatagtattttaaacttaaaatcaatttacccaaaacttaggtataaacagctcctcataccttgcaatagcgaacgggtcgctcattccggctatataatccatagctattatactattatcgtctgtcctgctgttgtttctggcgtcggcaggaatcaggtcaatatcatttacaaatcttgaataaagcccttcaataatattttttgccttatcctcttctgttgcaacttctgcatttttattcaaataaacattgtcaaacaaaaactgtctcagccccatcatcgcgtcatatatatcaggctccatcacaatatcatgctccatcacaatatcatgctcgcttcctgagatagccgcctttatcatggtatctattcttgctgaatgtctgttgcctaacacatcagaaaactctttaggtatatcgttctcgctgagcaaacctccgcgtatcgaatcgtcaatatcatggttcacataggcgattttatcagcgaccgcaacaatacgcccttccagtgtgtccgctctttttgctccggtgtggcatacaataccgtctctcacctcatatgtaagattcagtccgcctccgccctccaaaacatcaaccactctcaaactctgctcattgtgtttaaacccggtcgggcaaatctcgtttaaaactctctcgcccatatgcccgaacggagtatgacccaaatcatgcccaagtgcaatcgcctcagtcaaatcctcattcaaacaaagcgagcgggctattgtcctggctatctgagcaacttccagcgtatgcgtcagccgcgtacggtaatggtctcccattggggatataaaaacctgcgttttatgtttaagtcttctgaatgcttttgagtagattattctgtcacggtctctttgaaaatcagttctaatttcacaagagttttcactgcgtactctgccttttgactcgctgctccgagccgctttctcagacaaaatttccctttctctgttctcaagcatttccctgacgctcaaacacgacacctccgcataaaacaatgttaaactccctattaatactcgctcttatactattctacaaaaatagattttttccttttatctattgacaaaatgtacttttaataataaaattattttatattactaattttgaaaggtgtttctatgattcctcctacattatcaccaagactaaacaaaatatctgaactcataaacgattcagacgtaacagcggatataggaaccgaccatgcttatctgccggtatctttggtatatagcggcaaatcaaaatatgtcatcgcctcggatataaaaaccgggcctataaaaagagcggaatcaaccgtaaaaaaatatgatatgtctgattttatcagcctcagacaaggcgcaggactggaaacaataacccccggcgacaatgttgatacaatagtaatagccggaatgggcggtcttgtaatctcaagtatcctcgagaactcaccggaaatcttaaatcaggcaaagaaaataatactccagcctatgactatggttcctgaacttagggattatctgtataaaggagactttaaaaatataaaagaatacctggcggttgaggaaaacaaaatatataatattatttcagccgaaccgggtaaagataaatatgaagagccgtcgcctgttgagttattcctcggatgcagtcttataaatgagcgtcctgaacatttcagctcttatgtaaagcggcaggaaaacaaagttctgaagattattgacggactcagcaaatcatcagaacctgaaaatatagaaaaaattaggtattataaaaatttattatctgatattgaaaaatttatcatcggctaggaggaatttatatgccaaaagtgaaggatattgccgaatatattgaaagcttagcccctaaaaccctggctgagccttgggacaacgtcggactaatggtcggtgatatggacagtaatgttgagagcgtatacgtaacccttgatgttacttctgaaaatattgaagaggctgtaaactgcggggctgatttaatcgtttcacaccatccgcttattttcacctcaataaacagagtgattgaacaagacgtcacaggaagcattgtcagaagtctaattaaaaatgacatttctgtatatagcgcccacacaaactttgacatagccgacggcggaatgaatgatatattatgcgataaactcggcctttcaggggtgcgccgctttactgaatctgaatgtactgacccattcggaaaaccgcttgaccaaatcggacgggtaggaatcctagatactccgatagaaatggccgattttgttgactatgtaaaaaatgttttgggatgtatggctatcagctacgtgggaagcgaatccgaaataatctccacagctgcagtgtgcagcggcagcggcggagacttgatttataacgcctataacgccggagccgacgtttacgtgacttcagaaataaagcaccacgaggcacagctggcattggagcttggaataaacttaattgacgcgggtcattttgaaaccgaaaatattatatgtgattttatggaagactatttgctaagccgatttgatgatatttcaataacaaaatcaaccatgctgccttataaaagaagataaataagtacctaatgcgcttttataatttattttaacttaaattcttaatctacgaaccatttatattaattgcaaagtttatataaagaattttttacagattatattatacacatgcagttgcttcattttgtactttgaatctaatacagtgtgaagtcaacagatagctagatataatttaaatggtgtttatagtgaacgacacatcggttgggctgtgaccacactttttaaagtatgtgtaatacaactcactttgtattgataaacctacaatgtcaattgtgactacacttttatttaaaagtgtatgtcttataaactatataatgtgatataaactataaatgccaataattaacttcgttgatataataatcaaacttagttgtgatgtacaaacgaagtacgccgcgtaaggcgcgcagtcgcggaaaatttgtaattagaaaggtttataacaaactattctaaatatgttcacgctacgcgtgagatggtagttcacctaacgaggcagacgtcgtctgccctaccgatgttcactataaacactgtatatacggaaataattgaaaatgaacaataaagtttatcgaaaagtttaggtatataataaaaataaatattaaaattctataaaaatgtggtatagcaagcatcggtagggcgtgcgaagtacgccgcgtaaggcgcgcagtcgcggaaaacttgtaattagaaaggtttataacaaactattctaaatatattcacgctttgcgtgaaatggtagttcacctaacgaggcagacgtcgtctgccctaccgatgttcactataaacactgtatatacggaaataattgaaaatgaaacaataaagtgtatagaaaagttgacgtttataataaaaataaatataaaaattttataaaaatgtggtatagcaagcatcggtagggcgtgcgaagtacgccgcgtaaggcgcgcagtcgcgg

(The sequence listing continues in the following parts.)

The invention claimed is:

1. A composition comprising at least one immunotherapeutic agent, wherein the at least one immunotherapeutic agent is an antibody, or an antigen-binding fragment thereof, against an antigen of *Subdoligranulum didolesgii* strain D8 wherein the antibody or antigen-binding fragment thereof comprises the variable heavy chain (VH) region and the variable light chain (VL) region of an antibody selected from the group consisting of:

MH4 ($V_H$=SEQ ID NO: 9; $V_L$=SEQ ID NO: 10);

MH28 ($V_H$=SEQ ID NO: 57; $V_L$=SEQ ID NO: 58);

MH58 ($V_H$=SEQ ID NO: 117; $V_L$=SEQ ID NO: 118); and

MH91 ($V_H$=SEQ ID NO: 183; $V_L$=SEQ ID NO: 184).

2. The composition of claim 1, further comprising an antibiotic effective against *Subdoligranulum didolesgii* strain D8.

3. A method for preparing a sample fraction for detection of *Subdoligranulum didolesgii* strain D8 in a subject, comprising contacting a sample from the subject selected from a fecal sample, a fecal swab, or an intestinal biopsy with an antibody or antigen-binding fragment thereof comprising the variable heavy chain (VH) region and the variable light chain (VL) region of an antibody selected from the group consisting of:

MH4 ($V_H$=SEQ ID NO: 9; $V_L$=SEQ ID NO: 10);

MH28 ($V_H$=SEQ ID NO: 57; $V_L$=SEQ ID NO: 58);

MH58 ($V_H$=SEQ ID NO: 117; $V_L$=SEQ ID NO: 118); and

MH91 ($V_H$=SEQ ID NO: 183; $V_L$=SEQ ID NO: 184); wherein after the contacting of the sample, the resulting fraction comprises an increased relative abundance of bacteria from Lachnospiraceae, Ruminococcaceae, or both Lachnospiraceae and Ruminococcaceae in the sample fraction.

* * * * *